United States Patent 10,724,096 (METHODS AND COMPOSITIONS FOR INHIBITING AND TREATING NEUROLOGICAL CONDITIONS) - sequence listing, part 43

SEQ ID NO: 903 - DNA, 139204 bp, Homo sapiens
tttcaggaagcactgaattaattatttccactcaggaaaagactatgttggagtccattgctgcttctcgatcccaagtgaactccaggaagaagcaaatgaaaagcaatcataggccgggtgcggtggctcgtacctgtaatcacagcactttgggaggccaaggcagatggatcacctgatgtcaggagttcaagaccagcctggccaacatggagaaatcccatctctactaaaaatacaaaaattagccgggtatggtggcaagtgcctgtaattccagctacttgggagactgaggcgagagaatcacttgaacccgggaggcggatgttatagtgagctgagatcgtgccactgcactccagcctgggagacaagagtgaaactctgtctcaataaaaaaaaaagaaagaaaagaaagaaaataaaagcatcgatagtgtatatagatcaaaggaggaagggacattttccttagaataaaactttaataacgaaaacaataaactccctcctttccactcgtagaatagtcaagcactcatttctcatttgcttctcagccatcagctgtcctaatctgttatctattacgctgtgtaacgaaactcgtcccaatctagtagctgaaagcaacaaccatttattatggcacatgtctacatggtggctgggtggttttggtgatttgggcccaggctggctgaatccaggtgggcttgttcagtggtccctggcagttgggttgggggctggcctgtctagcatggcctcaggtaggaagagttggctctgctccacagactgacccgtgcctgttctcttcctctggcaggttagtccaggcttgttctctcagtggagacaggggtcctacgagaagagcagaagcagtaaaggcctcatgaggcctggacttaaaggacacattgccagttccgctatattctgttggccaaagcaggccagccaagatacaagcggggggagaaaatatgctctaccttttaatgaggcattgcaaactcacattgccaagggtgtggatacagaaggtcactagttgtggccatgaatgccatccatctatcagacctgccaacgtagtttttcttttaggggcggacttagtccgatttcagacattagtaaaactgattcggattccatttccaaattcctaattccaagagaactggaaaagcagagcgtgccaacctcttataatccttcttaatgtgacaaatgtttctacagcgtccactgagccaggctcagtaggtccctgggacatatatgaaacaacagttctcctgccctccaggtgctcagcacagcaggagaatcccggctgggaacagagagcaaagcgaccacatagctctagtgggaatcctggggaagtggtatgtggtcttgaatagtgacttagagttttccagaaagagaaggaaggggagttcattctagaggcctggaggatgtaaagatggttgtgttttcatgaaaccgagctgtggacacaaagggcaaggccaaggttgcaaggggccttgcccgactctctgtggagagaggattttattgtgaagggtccacgaagtcaccgcagggcttcagctggatgagtgtgctctgcttggcctgttggaaagattgctggggcagcagggaggtgaagaggaagctaaagatagggtgaccagttgggagactatttccagtccaaatacatcctcttgggtttgagtttctgtgaccgtcctcctgctggctggaactgggaggtcctctggggtctctaaacgctctcagttgcttgcctagagttatgcaagcgggcgtggggtcggggcaggaccaggaagctttgcgctttctgctcttggctgatttcataacaggttagcttttaaacttctggctcattccagacactatgcctctggccctgggagagaacttggtctcccagaccgcgcataacatttccactttccggcaaacacagtctgtgcgtgatcaggtgaggctggcgcacacaaatccttgatgtctagaccgcctttctccagctgctgtgtttactgcagaaaggttccatcctgggatgatcgcctggggggagttttcttcttgcgacacctagttcagctctgctgagcttttggattcccagcctttctcccaccacaacccggtggtcatgaagtctcacaggaagtgtggtaggcacaataatggtccccaaggatgtctaggcccccatccctgcaacctgtaagtgtgttgttacacggccaaggggattgaattaacagatggaatgaaggttgctaatcagctgactttaatacagggaaatgagcctggattatccaggtggggccaatatcatcatcaaggtccttaatagtggaagaggaggcagcagaggagcgcagagtgttgctttgtgagaaggacccgcccagcgttgctggcctttaagatggaggaagggggccgtgtggtaggagtgtgggggcctcaggagggaaggaaattggctctcccaggagcttccagaaaggaatgcacccctgctgacactttgattttggccccagtgagcctcgtgttggactcctggactacggagctgtaagataataaatgtgtgctgttttaagccagtagctttgtggtaattggttacagcaggcatgggaaagcagtgcagggtgtgtgagctgaacccttgaagacggggttctccactacgtccccagtgtggagcacaagctggctctatgcccggtgctcggaagcattttcagaatgaacaggactgactgagatgaagccgcagacatctgctctctccaggcccctatctggctgtgtgaccataggtgggtcccttcactttcagtgactatgttcccatgtctcttaaggcagttgatgacctcaagggtgggtgacttttgaagtgactctcagatgtgttaccactggagccaccgccagatctcctgactctcctctctctgactggtctcattcttagtctaataccatcattctccaatgctaaggtcattaattagcaccccaggccctcactgactctgctctcaccctgtctctggggctccctgcctacaggttcactgcggaggtcatggtagacgttgctgcccagaacctccaaccgtaggaaacctctcctccttattctcagccatgaagtgtgggagcaaaactgctacacagttttgctcagggtcagacgctgggacatccccagggcctgtaatgctggtctcaccagagctttgactgtgaatgctgcttttcctcatagcagtgtgtggcccctaaggtcccctattcaatgaccagggacaatcatcaaatcaatgcaaagagaaaatgaagccttgtgtttctatctaacgggtgagctacactggaagtataagaagtacttatggggaaatctgctttcctgactcttacttctgtttccagagggtgatataatgtgtgtaaatgcagattcagcttcgaggaaactttcgtctaataatgaactgaaccacattatggcatgctatctccaaggtatgatagtatctgttatactcatggggtccaaattttctttagcttagaggttattctactttagagcaggagttctctattttggccacccactaagaatcactcgaggggagtatttaaaaatccaagccaggctgcactctagagccacagaatcactgggctgaaacagttccccaggtgacgctgatgtgcagcgcgggttgagaaccactccactgccttagctaacactggctactcttgcctttgcctttgctatttacaaaaacaattattttttagtatctaaaggccaacatcaataaacccttacttgttatactagaagatgctctgtcctcattgacctgagtcccatcttagtggggcttattataatgacccaggcacgtgagtctcatgcaaaccagtggggcaggctcttgggagcagtggcttctgcattatgcctggaatgcaggaatacatggggatcagtccgactgacaaatgcaactcacccaaagtgactatgaatgactgcaagggcatctgggtacagcagtgggactgtagttcaggtcagggatctggtctctggtgttggccctgggcagggagggagctctaacaggaaccgaggcacccagtgtggtacctgcagtttccctgacccccactgcaatccttcacccccgggctccccttggtttccctgcctcacccacagtcattggcctcagctggtaaagggcagcttgagccagtgcgtcctcggagcgttagtcccagccagtttttgctgactcctctcccttcccagctgccatggcaagtgggtgcccagtcccacagcagcctctctttcctaagtaaaatcccacgccccgtggctaactgttcacaacctgaaggaagaaatgttctactttcaaaggaaaaacagccctccttccatgtagctcgccagctgcccaccgctagccaggtgtcgcttgcaatccatggacaccgttcccgtagcaaccccaggtgactgtcacagctgcccctgacacaaactgctttagcaaaggggtgtcaaaaaatattttaaaaacaagttttaaacacaatttttagggagaaatcaagagggttctcaactgaggtaattgaccgacttggtgggggttcagtccatgaatgtagcttcactcttgtggctattaatggcagggaggtggggggacagttggtataaaggcaatgagactacatatcaagatggaagggggcatcctaggcttggcatggtatttggaaaccttgactagccttttatgcccaatgctgtttggaaatcttgctgggaatcacagaagctatagatgcttaatggtgtcagcactgatatgcgccaccatcagcttgaattacatattaaccacccatctgcatttaatccctatacctggccatcttctgatgagacgagctatttcctctctctcctctcttgtactctccagtggataagtgagtttctctccatgccttctctggagtgggctgtttcgcccactggagggggattctcaaggtctccaccactccttggaaaaatggggtgaggactccagggctgggaaagggaaagtgtaagatgatcctgaaccagcttatggtgcctggaagtaaggaaatgctagaaaaatggtgagaacatgtcagaagatcacaggagccagcttgaaagggctcaaaacagccaaacctagggaatctgagcaataagagaaataataacagtggattgtgacctgtagagtacaatggatgtattctgctaagtgagagaagccagaccccaaagtctacatactcaaatccacttatatgacattctggaaaaggcaaaactataaggacaaaaaccagatcagtggttgccaaaaataggaggtgtgggggggttgattaagctgtatgagggattttgggggctgatgcagctgttctgttgcatgactgtggtgtagatacatgactctacattgtcaaaactcatagaactgcaaactacagagagtgaattttactgaatgtaaattttaaaaaattaagatgtttgggagccccaaatggaacccaattacaaataaacccaaccaggctgggcatggtggctcacacaggtaatcctagcactttgggaggccgaggtgggcagattgcctgagcccaggagtttgagaccagcctggggaacatagcaaaatcccgtctctacaaaaaatacaaaattagccaggcatggtggcgcatgcctgcagtcctagctactcagggactgaggcgagaggatcacttaagcctaggagattgaggctgcaatgagctgagatcatgccactacattccatacattccagcctcaatgacagagtgagtccctgtctcttagaaataaaaaaaaacaaaagaacccaaccataatacagatgaataacataaccacactgaagggggtagggaagaaaagaaccaacctgagtacccagggaaaatagggttttgacttgatacacaaatactgtatggttaatacacttctcatgggcggggggtggaggttaggaattctgcaactactttctgtgtatactaaagctgaaaaaataggtacagctgacccttcaacaacacaagcttaaacttcaagggtgcacttatccaaggattgtctttcacttctgccaccctcgaggtagcaagaccaacccctcttctttctcctcctcagcctactcagtgtaaagacgatgaggatgaagacctttaggatgaccaccttctacttaatgaacagtaaatatattttctcttttttatgattttcttaagaacatttcattttctctaactgtattttaagaatatgtaataaatacatgcaaatcaacttatcagtaaggcttctagtcaacagtatgctattagtattaatagttaagtttatggggagtcaaaagttatatgtagatttttagccaggtgtggtggtgcgtgcctatagtcctatctactgggaggctgaagcaggaggattgcttaagctgaggagtttgaggctgccatgagctatgattgtgccactgcactccagcctggacaacagtgcaagactctattaaaaatttttttttaaattatctgtggttttttgattccacataggagtggcatcccaaccctcacattattcaagggtcatctgtaaatgcattaaagatgttgagagccaggtttctcaccgccaaagaagttacaaataagaggaaggggggctacaatgaaccctgtcatgttggattggaatctgagctatcacagtatgaatttgttttttaacattttatgtatatacagttacagaaatatagatgtgcatggcttagtatacatatgtattatttcaagctctgttctctatgaggccctagaagcaatgacatccagtgacaataaacacactcagtgcccagatttttgtttctaaataaaaggaaccaggcctccctggagcagtgattgattccaggctcctaggcagggaaaacacaagaagagcctggaacatcttgaaatgcaagaaagtaaggaagtgctcatgaaaggatggggcaggtcacaagtgtgcaggagccaacctgaaagagctccccgtggccaagctgggacaatttgagcaataaaataatgatggtattataatccataaaataaatatccatgagtccatactcatataaacaagcaaacaaatagatgagaaaggacagtaattctccagatagaatttcaattacttataataataaatgaggaaatcatgataattaatgagggaaataaaaaatcaccattaggcaaacactacagtaataattattacaggcacaatctactaatagatgttaagatgactgggcaaaaatttgaggtgaatcaggatatttgcatagccttaaactatctctcccaagatatttattaattacaaaggtaaaaatagtaactttacagtgaagaaacccagcagacacaactttaaccaggcgaccaaggttaacatcaccagtggcaggacatagcagcatcctatcccactaacaatatgcattgagggtttattaccttggtgatattcttcgaaggatggataacctacatttaatcttgagaaaacatcagataaactccaaatgagggagattctacaaagtaactgaccagtactcctcaaaaatgtcaagatcatgaaagacaaggaaagatagaggaactatcacagatgggagaagaccacagacctgaccactaagtgcagtgtgggatcctgagtggctcctgaagaagaaagcagaagttagataactagatagacaattagtgacaatttaataagctctgtcagttatatagtagtattgcctttatgttaatttcctgatttttttttttttttgagacggagtctggctgttacccaagctggatgtggtggcaccatcttggcttactgcaacctccacctcctgaattcaagcgattctcctgcctcagcctcccgagtagctgggattacaggtgcgtgccaccatgcccagctaatttctgtatttttagtagagatggggtttcaccctgttggccaggctggtctcaaactcctgatctcaagtgatctggctgtcttggcctcccaaagtgctgggattacaggcgtgagccactgcgcccgaccagtttcctgattttgatctttgtactttgggtgatgtaagatgtcaacacttgggagatttgggtgaaggattatgggaattctttatactacttttccaaatttttttcaagtctgaaatcatttcaagatgaaaagttgaaaaaaatcgagggtcagaaagtacatagtatgcttcttttccataagaatattagagaaataagtatttatattttattttaatttgcttgtatttgcttacaaaagcactggaaagataaatgagaaattaataaaaactgttacttatgggcgaccagatgaggaatgggtggatggggcagagtgagagtgaggcttctctgtgtacacctttttaaattatgtaaatgtactatctatcctctgtctcaaaaaccaaaaccccaaaaaactaaatcaccttatagttcataaaggcaaagatattttatttcatagtttctcacaatgaaataaatagtaattatcctatgaggtagttactattattatatcattaccattttagacatgagtaaatgagggcatatatgtataaataacttattcaaagtcattagctaatgaggccgggcacagtggctcaggcctgtaatcctagcactttgggaggccgaggtgggcagatcacttgaggacagaagtttgagaccagcctgggcaatatgatgaaacctagtctctactaaaaatacaaaattagctgggcatgatggcaggtgcctgtaatcccagctacttggaaggctgaggcaggagaatcgcttgaacctgggagatggaagatggaggttgcactgagccgagattgtgcattgcactctaacctgggcagcagagcaaaacttcctctcagaaaacaaaaacaaaaaaacagtcattagctaatgagaccccagaacctgcacagggagattaccaacagggaaagcagatttcagaaaatgcagcctggccaacatggtgaaacctcatctctactaaaaatacaaaaattagctgggtgtggtggtgtgtgtgcctgtagtcccagctacttgggaggctgaggcaggagcatcgcttgaacctgggaggcagaggttgcagtgggctgagatggcgccactgcactctagcctgggtgacagaacttttgggaggccaaagtgggcagatcacttgaggtcaggagttagagaccagcctgggcaacatggtgaaaccccatctctactaaaatacaaaaattagccgggtgtggtggcactggcatgcaatcccagctactcgggaagctgaagcaggataattgcttgaacttgggaggtggaggttgcagtgagccaagattgcatcattgcactccagcctgggaggcagagcgagactctgtctccaaaaaaaaaaaaaaaaaaaaaaaaaattcagaaaatggtatggaaaagaaaggcatggtcctatggccagagacttgaaagggagttccagaagaaagaaaacttcccactgtcttagtcagcttaagactttgtggcttaaacaacagacatttatttctcatgcttctggaacctgggaagtccaagaccagggtgctggaagactcaatccttgataaggtcccactttttggcttttagtcagctgcgttcttgctgtatcctcatgtgactcagacactggtttcctcttcttataaggacactaatcccatcatgagggccctaccctcatgacctcatcgaaacctaaggacctcccaaaggccctgcctcttaatcctatctcattgaaggttaggccttcaacagatgaatttttggaggacacattcagtccataacacttcccaccccccaacacacaaacttttaaaaatctgtgttaagtatgtactttgtgctgtaaagtgctatgggttttttgtttttgtttcatttctgttatccaggctgaaggcagtggcactatctcacctcactgcaacctctgcctcctaggttcaagcaattttcccacctcagcctcctgagtagctgggactacaggcacgcaccaccatgcctggctaattttttgtatttttagtagagacagggtttcgccatgttggtcaggctggtctcaaattcctgacctcaggtgattggcccgcctcggcctcccaaagtgctgggattacaggtgtgatccctcatgccaggccaaaccatgaatcttttatctttctctatagttttgtcttttctagaatgacacattattgaagccatacgatttgtagtcttttcaggctggcttctttcacttagcgacatgcatctaaggttcctttatgtcttttccatagtttgatggctcatttatttttaatgctgaataatattacattgtatggacatgccataccatagttcatttgtgttttattttatttatatatatatattttttgagacagaggctcactctgtcacccaggctggagtgcagtggcgcgatcttttttttttttgagacagagggcacgatctcgactcactgcaacctctgcctcctgggttcaagtgattctcctgtctcaattccccaagtagctgggattacaggagcatgccaccatgcccggctaatttttatatttttaatagagatggggttttgccatgttgcccaggctggtcttgaactcctggcctcaagtaatccacctgccttggcctcccaaagtgttgggattacaggcatgagccactgcacccggccttagattacttttataataaaaaaataaatgcattatatgcacaagaatcgtgcttgaacctgggaggcagaggttgcagtgagctgagatcacgccactgcactccagcgtgtgtgacagaccaagactctgtctcaaaaacaaaaacaaacaaacagaaaaccaactatgaaaaagagagttagccctataggcatgtgtgatatatcgcaatgcataagcatacaggctctggaattggacaaacctagatttgaatagtagccctgtcacttattagccgtgggcaaattctataatctcgatgtgccactctcctccttgcaccatgggtttaaccacattgcctgggctactgtgcggattggatgagatgatgcatgtggagtcagcaagatgcctgtcactccccctccctcccaggtcttcactgatgaaagcaggtatcaaagtcaagcagatggaaatgaaactggcaattttattattggtggagttattggagaacaataggaatatttcaaaaaaaatgatgcctgcgtcaacataaaagcattttcaacaaattgtgttataatatccaggtctgcataagaagttttttttaacctacatgtatcttaatacttctttgttggtgcctctccattagttcatttgaataagagaaaaatgtcaaaatattttggtaatttttatagatttcataaggggagtttgtcattagtttgtgtggattttttttttttttttctggctgtggatgctttgaatggtagaagactgaagggaagggaagtgtggtgaggtggggcttgaacaagatactacatgttataagtgattttctgaatttctttttttaaaataagctaatttgtaatattttataactagatggttttattagatgctcataaggtctcaaacgtgcactaatgctcagattttacatttccatcagccagaaacctgttttttatttttttatttttggacagagtcttgctctgtggcccaggctggagtatagtggcgtgatctcagcttactgcaacctccacctcctgggttcaagcgattcttctgcctcagcctcccaagtagctggaattataggcacgtgccaccacgcctggctaatttttgtatttttagtagagacgagatttcaccatcttggccaggctggacttgaactcctgacctcgtgatctgcctgcctcggcctcccaaagtgttgggattacaggcgtgagctactgcgcccggcctagaaaactttttttaataaaaataaataatctcctttcttccttttgtcatatgtatgtgtacacacataaaatcaaaatcataaccacaatgtttttcttttcattttttgtttttctctacaacctgggcccaggagctccttcatctttttttttttttttaattgtggtaaaatctgcataacataaaatgtaccagctaatctattattaagcatacagttcagtgcattgagtacatttacagcgttgtgtaaccaccatcaccatccatctccagaaagatttcatcaacacaccatgtttcaaacttctcgattttataaagtgcctctcattcaaatagtaacagctgaagaaaaaaatgcaggtaccatgcaacatctgacttctcagctgccacactcagaagtaacaaagaacccccttttgaaaatctcttcccattttatctttctttacaactccatagcaatgttgttttatgcaaacaaaatgtaaaacagagaacaaatagtttgtcccctgctgctatataaaaaccaaagtttgtaacaaggtaactattttatagccctccaagctcaataaaagtacattcttcctgttgtgttctatcttttgggcaggtatgtaattaagatagatggtgtgtgatcctaagaactcccttaccggagcatgttctggccaaattcagtgtgttacattatactgttcctttatatgtcccttagtattatacttcttagctgtccacatcatatccaatataggtcactttccttcctaaaatgttttctaccatttttatatctactgagggcgttataattctgagatatctgaattttattgctgaatggttaaatctttttctggtgtgaattcattaaggtgctgaaacataaattgtactatgtttgtgggagttatctttcactttttctttgttttctgcaaattttttaatcctctgaaaataggccaggccaccttatcagtgcgaggtatccagagctccactctcttctgagcttaagaatgttctagaatattgtaaggggggaatggagtactcaggagcaggagagagggaatgtgcaaaatctctgggcacaagtgggtgttcccctcccagctggtaaccaggtgatgggctgactgcagggaagggaaggcctcgtccaggaagggacagctggtgcagcctgcggcagtctagtagaggccacgggctcctacttgcgccttcgtgctgggaaaccggatttttttccttcttcatgttttaagggcttcttcagcacagctttgccccaccacctccacagtcttctctccccctagtctggaataagatgttctagtccctcaaatcaaatcccacatgtaagcctcacatttccccaacttttacctaggactgcagacctccaagcccagaggctttggaaacaatcttcaactgctttctctctgctttccaccctgtgtccccctgcaggcagcttgcaaagagcagaggcttggaaaggagaagtggggcaggaagcgcagaaagtgcaggattctgcggttagcatttcaaaaacattgcccttctctgatataaagaagtggattttctctgatagaaagaaaacacagtcaagtcctatgcttggaatattgatctgtagaacagtggcccatctccagcctcaaaggctagtcttaaaagaaaaaggagaaaaaaaaagcaataggagagtttgctgctgcgaagcttaaggtcctatgaggaaaatactattagagccaggagcacaattctggctgcaattagagtcacctgggagaactttaaaaaaatgccaaaaatagaatgcctgggcctcgcccctggagactttgatttaattggtcttgagtgggcccccaagcaaagctttttttttttttttttttttgagacggagtctcactctgtcgcccaggctggagtgcgttggcgcgatctcggctcactgcaagctccgccttccgggttcacgccattctcctgcctcagcctcccgagtagctgggactacaggctcccaccaccacgcccggctaattttttgtatttttagtagagacggggtttcactgtgttagccaggatggtctgatctcctgaccttgtgatccgcccgcctcggcctccaaaagtgctgggattacaggcgtaagccaccgcgcccagcccagcaaagctatttttaaacgttccccaggtactgagtgtagggcagaaacccacgttatgttagcagggcccactcatcctataggcatagcaggcacagcacttgggcccaccatacttccaggacccacagaaaagttcaatttcttttagaatcagaagaaaaagaataaacttttaggtggaagaaaatgacttcatatataatattaacatgtatttctttatatcaatgaattcataaaatacaattttgggggctaggtttggtggctcatccctgtaatcccaggattttaggaggccaaggaaggaggattgcttgaggccagaagtttgagacccacctgggtaacatagcgacaccccgtctctaaaaaataaatttaaaaataaaataaaattacaattttttttaaatggggaaagagatccacaagtcagaagtgcatacggcctacaaaagccataatgcagccctatataaaagagacacgtggaggccaggtgcatgtggctcatgcctgtaatcccagcactttgggaagccaaggtgagcagacacttgaggtcaggagttggagaccagcctggccaacatggtgaaaccctgtctctactaaaaatacaaaaattagtcgggcatggtggcgtgtgcctttaatcctagctatgtgggaggctaaggcaggagaattgcttgaacccagaaggcagagtttgtagtgagccgagatagtgtcactgcactccagcttgggcaatagagtgagactccatctcaaaaaaaaaaataaagaaagaaagaaaaaagcccggtcgcggtggctcatgcctgtaatcccagcactttgggaggctgaggtgggcggatcacctgaggtcaggagttcaagacccgcctgaccaatatggtgaaaccccgtttctactaaaatacaaaaattagctgggcacggtggcaggcgcctgtagtcccagctacttgggaggctgaggcaggagaattgctcgaacccgggaggtggaggttgcagtgagcctgggatcgtgccattgcactccagcctgggcaacagagcgagactcggtctcaaaagaaaaaaacaaaaacaaaaaacacatgtaagggtacatctttgaatattactaaaaataattattcagttcacattaacacagcattgaaatacaccaatgatgtgtacaccttgcgctggcaatgattcctaatttttcccttatcattcccctatccactgcaagtggttcaaggtaggctccatcctgcttcaataagctacttataaattttgctgtgttgccaactcagacgtttttgagcgtctagtctttcatccaaacacacagtgcctttcttttcatttttgttttgtttttgttttttagagatgggagggtcttgctttgtcacccaggcaggaatgcggtggtaccattttggctcactgcagccttgaattcctggctcaagggatcctcccacttcagcctcctgagtagctgggatgaaaggcacgcaccagcatgctcagttaattttaaaagtttttttttttttttttttttttttgtagagacagggtctcgctttgttccccaggctgatcttgaactcctgggctcaagtgaacctcctgcctcagcctcccaaagtgctgggattacaggcgtgagccgccatgcctagcctctggtggctttctaatgtttgattccgagatgctcacctcagttcctgagatttcagagacacagtggattggaggcctcagagaaaaggaagcattggccctaagaggtatggagcgaatccagagcctcctcaatgtgagccttttcccctgggctttgctggcctctgtcgccccagctcagttccctcctggctcctctggcaggcagagcttcctaaggttgagttacaaaaaccaccgtggtcactctcacttttccccttttccaaacagatacccatatttgaaaagtcatcttcttcatattggcacaaactccagagttctcctggcaagggaaaggcatgtggacgccaatctccatgtccttgaatttcatggaagggaactcatgttgagggagactgaggtatcaggcaggaaagaacaggtcaatactcattccaccggcaccgggtggggcttggaaaagccagtcacctgcacttgctggttgcaagactaaagcacacagatggagactcacaggaaaatcactcatctgaaaactctctgtggctgccagaggctctgatgtcccttggctccgggtaggagctgtcaaggagaaagccaactgtggtctgaaatgagggaagcaaggcttgggataatgatcccttagatgccttctggtttgaggtcttatgactcttcagcaaagctctggttctgacagacccaggtctcaatctctgcttctctatttatttatcaagaataaataaatttatacattttatttatccgtaaattggagataagaacatgtacctcatgggttgttctgaaatttatttttattttttaaattaatttatttttgagatggggtctcagttctgtctcctaggccggagtgcagcagtgtgatcatagcccactgcaacctccacctcctgggctcaagcaagcctcccacttcagcctcctgggtagctgggaccacaggtgtgtaccacaagcctggctaatttttgtattttttgtagagatggggtttcaccgtgttgctcaggcttgttctgaaatttaaatgttgagtgtggaattcttcaaattgcccaagaaatccaagttccctcttgtaatcactgtcaccttgactgtagggctaaaagcggaaggaatcgccagtttgttgacttcagcctgctcttgggcagaccagctcaaaaacccttacatgaaagttttatgaaaataaattgtactacttctgcaagactaaatttgagttttcattatttcagccctgccaccaaatagtcccagcttgctacttttgctttagacatatccaagaaaaatgtgttctgaaaggtgaaatcccttgctagaaggctttggcagtcagaaatgagcaaaaatgcagaatttttttttttttttttttttgagacggagtattgttctgtcacccaggctggagtgcagtggtgtgatctcggctcaccacaatctctgtttcccaggttcaagcaatcctcctccctcagcctcctgagtagctgggattacaggcgcgtgccaccacacccagctaatttttgtatttttagtaaagatggggtttcgccatgttggccaggctggtcttgaactcctgacttcaggtgatctgcccacctcggcctcccagagtgctgggattacaggcatgagccaccgtgcccggcctaaaaatgcagaattttaaaacatttgtactggtgttttttggtctcatttgttgcccaattggtctgaatataatctgacaatatgtcactcaagatcaactataaccaaataattcaagccaaagaatggttgattaatttgctacaaataaaatgtggtccacagagtcaaaactttttaaatgtttcaaggtttttttttttttttaaatttctttttttctgagacagggtctcgctctgtcgtccaggctggaatgcagtgacacaatcatagtttattgtagccccgaccttatgggctcaggtcatcttcccacctcagcctcctgagtagctgggactacaggcgcgagccatcatgcctgacaaatttttttgtattttctgtagagatgaggtttcactatcttgcccaagctggtcctaaactcctgagctcaagtgatctgccctcctcggcctcccaaagtgctgagattataggcgtgaaccactgtgcctggctaaggttttgtttttaatcttggaattggagctatcctgactttgcccaaagcatggttcgaaagggacttttcgatttggagttgtttcaacataatcaaggacacattcccaataacatttagtacatgcatgtttattgaattagtattagttggtgttttggggatggctgaggggatggtgagtgtaaacttgccttgtttctggaaaattcctccttccactggtcagcagagctttgacattcctacactaagttcttcagtctccaagacaggcagtccaagcttctagaaactcaagccatgcttggatccaaccagggtccaaccgaccacaaaatgtatctaaaatacttttgactatgctggatccctctaatgttgctattggttctctcttgatttttcatttaccttgcacgttgaagtaactgtgggaagaaatctgtgttccccttaggggaaatactggaggattagcatggagtcaaactcaagctattagatgtttttctcttactgagaaacttcactcctctatcaacatttccaccatataatggggtatactacctttagagcgaattaaaaaaagtaatagtttatcttcttgtctctcccatggaataaggatgtgcaatagcatactgggtttcattgccttcctccatactatacacatacacagtgacttttccaaaggctacttaggaccatttattttgttttgttttgttttttttattttgttttgttttgttttttttagatggagtttcactctgtcacccaggctggagtgcaatggtgcgatctcagctcactgcaacctctgtctcccgggttcaagtgattctcctgcctcagcctcctgagtagctgggattcaggcacatgccaccatgcccggctaattttgtatttgtagtagagatggggtttcaccatgttggccagactggtctcaaactcctgacctcaggtgatctgcccgcctcggcctcccaaagtgctgggattacaggcaggagccaccgtgccctgccgaaccatttactgttttttgttttgttttgttttgtttggtgagatggagatttactcttgttgcccaggctggagtgcaatggcgcgatctcggctcaccgcatgctccgcctcccaggttcaagcgattctgctgcctcagcctcccgagtagctgggattaaatcatgtgtcaccacgcccggctaattttgtatttttagtagagacggggtttcaccatgttgcccaggctgatctcaaactcctgacctcaggtggtctgcccgcctcggcctcccaaagtgctgggattacaggcgtgagccactgcgccctgtcatttattgttaattaggtctcacctcttctgctatgaggtcaataaatatcacctgtctttgcaggtccagggatccaggctacacgttactagtcaaaggccatggggcaagtctttattggagatcagatgggctgggtcagtctggcctggccacaagaagtgagcctcacctcaaaacctgttccacaatggcatttcctgactggctatgtgtgtgtgcactgactagcatgtgctcattcattcatcaaacatttactgaacacctgctatgtgctagtggctagagactcagggaggaatctgacccattcccttcagttaagaaactcagtgtgtgggagggctgaattataagtaagtaggtgctatgataaaacaccccacaaggcagaaagggaggatgaaggaggaggatttcttagaggaggagggacttaagctaaaccttgaaagagcaagacggaagggtgttttagatgaaggaaccttgacagcaggcccagagtgtggatggctggctaggggcatagccctctcattgacttatctgccagtcagggccagattttgagggcttgccacaccttgccaaggggtttgattctttttccgtaggcctagcaagtttgcctgcccaaggggctctagaagttcaaacggaaacttaatatgattgtttgatgtattaagtctcttccctcaacacttgtaggagtgaacactttgaaaagtgaacagtttaagactgagattcttcacttcatgtgggaagtgtgcaaagtccaaaaatgagattgagcacccaaggaattagtctcccctctgctcctgctcagagccagaccttgttggagaggacacagctgggtctcactggaggggaaagaagtttctatggcgtcatgcccatggaacctactggtaatctgacctctggggttctggggaaagctgtttatggggaagcagagttttggtagagttgctccaccacacaacagcttggagtagagggatagtgccaggagaggctgctggctgtggaatgatgtaggcaccaggtcctgaaggagtcctggcacagcaggggcagagcttgaaaccatgtgcactgcagcagccgggaggtgcagaagctataggtgctgggagagctccctggaagctcagatcaactttgtgctgacagctttccatcacaagtgagcacttttgttccaaggagccctctcagcatgggaggtgggtagcctagaagtaggggtaaggcatgtaggagcggtctttgctggagacttggaaaaatactccagctacctgagcttcaggttgtcaattctggggggcattcagcatcttcccaggaggtcccaggggaatcaggccccctgcatatagcaccagtctcattaacacaccctaatactggcctttcctccttgcctgtcgcactcttcctgcttcctctctccggcttctagggatcaccctaaatacaccaccagcaggcaagtcttgtcacaggctcctccttcagggcaacccgtattaaggcagcctgtttcccaatgactccaagcaaaagccctcttcccaggtgcccttcccaatcccatcttgcttcacaagcggaatagcttttccacttcaatcaaataaaccgtgtattattttttgttttgttcacttcctcctgtttccctgtctcgggtgtatgaccacaccttccagaaatgccctccgcactctttctgttatccatgtgcattacatcttcttctttttcttttttcttttctttttttttttttttttgagatgaagtctcactctgtcactcaggctggagtgcgatcacgtgatcttggctcactgcaacctccgcctcctgggttcaagtgattctcctgtctctgcctcccgagtagctgggattacaggcgtgcaccaccacgcccggctaatttttttgtatttttagtacagatagggttttaccatgttggccagggtaatctcaaactcctgacctcaagtgatccacccatcttggccttccaaagtgctgggattacatgtgtgatccaccacgcctggccttgcattacgtcttccaagtgcacgccataagacctattccatgctgcagcctcccttctgtcactcttcctatattctgtgtcactactcaaatgtcatttatactgtagcacttatgtgaatatttttgtatcatgtattttatgtacagaaaatttggaggagaaaagaggtgatttttctctactcatcctcctggaaacttctctttggcaagttgctgccactgaccccgctcttcctccccttaatcgttctactggctcaaaaaccataattaagggagccagacttacattaaataaaaaaaaagacaaaaatgtttttcagaagcattccctggaaatgtttgctttaagttgaggttggtggggcttgagcattcatcttgacaataagagcaacgaaagcagtatctctggtagctgatctctctcacctctgtctttacctccaatgactcctcttatttttgtcatcagcaaaatatctgtatgggaggggaaattgctgatgaaatgcttttttgacagttaacaaatatttcctgagtgcacactctctacagatccttggaagggcccatgtgagaagtggattcgtgacattcggcactgccctctccttcaggagtccctcacccttgggcttccgtcaaagactcctgggttcttcccaacagctctcagttaccctcctctttctcccttgggtgatgccctctgcttcctccaccctcagtgaaggcactgcactctcctttcctggctcctggtcctcactctcccctcaccctccacatggatgctgcccagagacactcctccacttcccagctgcctgctggggcatttccactgaaaagttccaccattacttcatgctccatggaaccttcaggagctctcctgaaaagcagcctctttccatattgttcctatttctgatgctccaaggcacccagcctggaagcctcagctttgcctttgccagttccactccctcattgcacacatctggtcaccaagacatctggtcttccaaacaagagcccttcccttcccttttcccttcccttcccttcccttttcccttcccttccccttttccttccctgtgcttcccttccccttctccttcccttccccttctcctgccttccctccctccctcctttctctttttcttcccttccctttttccttcccttccttttccctcccttccccgtttccttcccttcccttccctttttccttcccttcccctttttcttcccttccccttttccttaccttctgcttttccttcccttccccttctctctctccttccttccttcattagttccttccttccttccttccctccctcccttccttccttctctccctccctccctccctctctcctttctctctttcttttcttttctttctttttttgagacaatttcattctgttgcccaggctggagtccactggggcagtcacagctcactgcaacctcaacctcccaggatcagttgatcctcccacctcagcctcctgagtagctggaactacaggcacatgctaccatgcctggctaatttgtgtgtgtgtgtgtgtgtgtgtgtgtgtgtgtgtgtgtgtgtgtgtgtgtgtatgcgctttttttctttttctttttcttttttttttggtagagacagttttcgccatgttgcccaggctggtcttgaattcctgtgctcaggtgatccactgccttggcctcccaaagtgttgggattacaggcataagccactgcacccagttggaaaattctttcctgtccctccctgctgcaactccccatctaccccatgactctgctggttcctaggccatgggtctcccccatctggttcccagggccatttaggtgccctctattgcatgcaggttccattctagtcattttgaggtgtccaagtactgtttggttgccttgagccccctcactttggcatttgatgccttttccaccctctgaccccatccacctttctagtatgcctcatcccattttctagcatgtgtgtcctgccccaggcagcctctgctcaggaaagctggtccaccctctgggcactgttcacacaccccatcaccttggctgtcttccccaacctagacctgctaactctggaatagtgcaataccgcttcctccaaaaagactcccttgaccatgctgcccacttgggataagtagcatctttttttttttttctttctttcctggcaatgaatcactattattaggtcggagcaaaagtaactgtggcttttcccattgaaagtaatagcaaaactgcaattacttttgcaccaacctattactttttcaagtccttttatattgttttgaattgttaagttttcaagggtctatttcattcaatatgtcagcaaacatgtattaagtacaggttgggcagggcgcagtggctcacatctgtaatcccagcactttgggaggccgaggcgggtagattacttaaggtcaggagttcgagaccagcctgaccaacgtggtgaaaccccgtctctactaaaaacacaaaaattagccgcgcgtagtggtggccacctgtagtcccagctactcgggaggctgaggcacgagaatcgcttgaacccgggaggcagaggcaatgagccgagatcgcgctactgcactccagcctgggcaaaacagcaagactccatctccaaaaaaaaaaaaaaaaaaaaaaagtacaggttgttgttttctcagggaatcctcatagctggtgaagtatccagcttttcattttacggatgagtgaactggggtttagaactgataacattttgcccaagttctcacagctagcgagaggcgtgccgcagtttatcgtggggtgggtctaaacaaggacctaaaaactgtattcgaatcccagccctactaccgccagctgtgtgaccttacgaggcgcctcactttactgtttctccaacagagacagacatttcttgttaccgcgcaagtgggataacctccccaccagtgtctagacacagtaggtgctcaataaataggtgtgggtttgcggtggcagaagagcgctatcccttaagtttctgacagtgagggggaaaaaggctaagcagggaaaggaagggaaaggggtaaactgagctcggcgcagtcgagagcgcgaaatagggagggcttcctgcaggccaggaatttggagaggccgaggctgggagaagaaaaatgcccggtgacggcggaggggaggtggaaggacgaacggctccgggaaggggtgaggtctaagcgcagccccgggcccagcggagccgagggcgggtggtgcgggggttcctgggtaggttcgtcccgacgggccgcgggcggattgaagggagggttgggcccgccggcagccccggcgggtccaggcccccggccagcccctgcccctcctcccaggagggcgggcggcgactgcggggcggggcgcgggctcgctcggcctcccggcggcgccgcggcccttgcactccggccgggctctgctggctgcggcgggagctggacgcgggaggaggcggcggcggcggtgagtgagctccgggctggagcggggcggggtgtgcgccggcagccgggtttcggggtgctaggggccgcccagggcggcgggacccccaggggttcgggctcagccaggtgcactgtgctcagtccgcgcgtccactctcggtgacccgcgccgcgcgtgtcctggggctcgaagatgcgacccggactcccgcgccgcgccccgccgagggcaggcgcagaacagatgcgggcgatccctggggaacccgcttcggggcggggtgggagggaggaggccctgcagaacctccctttagtgaagagggactttctgccttcgcacccctgcctggaccctccggctctagtgacagctgggagagactcacacgaagcagtttctgacctatcctgtcgtacacaagtcctcggcgtgctcggccggaccatcccctggaaagaaaggggcgtgtgacctttctctccccgatcctccagaccactgcgccgcccagggaggtcatccccgagagagcccccgcctcactcggagcacacattctagctctccccgggacttttccaagttgcatcactgtttggcctctagacaggtacttggctgtcatgttggagttagttacacaggatttttgaaactttgtatatttgctttgtgtgttcttcaccctaaggccgctgccctcccgactctgcttatgccgctcaaaacgttgctcaaagctcgctgggaatgcttttgcgggcattggttctcaaacttggccccacatctggagagttttaaaaaatactggtgcctgtgtcccactcccagagatctggattcggcttgcctgggttgcagcctggacaatggaatttttaagacgccgcaggtgattctaatgtgcaggcaagtttgaaaacctctgctttgagagttgctcccaccagccactcttcggacggctcaagatcagtcctgatctagaactcatctcaggtcctcatagctcttccctaatccacctctccacctgaagaacctgttgattggtgctttccaactttagacagtagatggtgcctttactgaagatccctttgtttctacctctctgtttacagtcaatactgccagggcactttctgccaaggaggtgggagtgtaggcattagaaccgagcagtccttgtcagggtcaaggttataatacagggttgtcctattcagggaaaaccaagtgataatttgacttgtcatattcgggaatgatttcagattaaaaggagaaaaaatactttagggtttggtcagcttttggagaccctccggagactcccccacgtagataatggagttgcataaatgtggagaattttccttcaaaaagccaaagctaacaacatccttaaggttttgtggttgatatttgtgttaacataagtccatttttgtagattaaacttattctggaagtatgatgaagccctgcagacagaacacagtgtataacatggcacatctgagatgacacctgagacacctgtcacatggtcttaaaaatgatagagaagtaggactaaggaaaatgtaaccatgcttatattggctaaattaggtcatatattttatcaagaaaatgtgttttcactgccctttttagtaatgtgatagtctccggggatcttggttaatttacttttgtaccccaaatatgatgtttgcattaaaatttccaccctgatgttgctacctgaccacaaatcagtggttttaagtttttcttagggggtggccctctatgtgtttttttttttttttttttttttttttttttttttgagacagagttttgctcttgtcgcccaggctggagtgcaatggtgcaatctcagcttacggcagcctcggcctccctggttcaaatgattctcctgcctcagcctcccaagtagctgggattacaggcacccgctaccatgctcggctacttttttgtatttttagtagagacagggtttcgccatgttgtccaggctgttctcaaactcctgacctcaggtgatctgcccacctcggcctctcaaagtgctgggattacaggcatgagccaccgtgccccgcctgtatttttattaacagtgggatgacatccttccaagaatgccttgctgaagtgaaagaacatttacattcatttctagctgctaatgtaagtccaaagaacattcattttgaaaaatacaaaaatgacataattttgcccacttggttttctcgcttttccccaacttccacgaccatgctctgctgctactactgtattcacttgctggaggtgtgcaccctgtgggagccgtcttcattgtcttggctttggcttgaaatggaggttacatgcagcgcattgtcttacagggtgtcccctgacccgaatcatcaccctttggggagcaagactatatggaaagtgttttcctactgttttttttgtgtgtgtgtgtgtgagtgagtgagaccatgccaacaaaatgaagccatattattaaatggtttgttaacttccaaatcttgtctcaattgggaaaagaaaaatgcttattcgaggatgctgttgaattcatggtgtctgaaaagtcacccctgaacagcaatagttacactgtgaatataataatacactctacccccccaaaaagaaaagtttatgtaaatgtgggcctaagcacatttattgcaatttctcactttggagtagcagctctaatatcctaaagtgattagaagaaagtaagtgaagaaaaatatgaagaaagggttagtgagatactttttcatttagggaaaggggatacagcaactagaaaaggccttgggtttgtgttaagaatttattgccctggtggcttcctttttttctttgtttaatttgcttgtgctgatgggtgagggagagttaaagaaatttaatggcctcctaactctctttccccgtgaaacccatttatctaagagatgccattggccttttaaaaatatccaactgattttatgcttttcctttcttttcatcttctgatctcggcactaaagggcggtggcatggctgagaggttggcatcagagcaggaaaacaaagttcaaggggaaaccaaaaattgggtaattttctctgaatgaccaagtgcttacttttttcaggcatgtgacattgctgttatcaagaaaccagttatgacatgaaaatcctgaaaatggaaaaggaaaaaagaaaaaaaaagggaatggggtgggggatggaaatagcaccagggttgactgacctttaccgaggagggaaggcttagtgttttcagcctggtgtcccccgtgtcccgattgcagccccctgtacttctctcctcatgcaccctcctgcatccctcaagccaatatccttgggggagatagtgcttcatcttaaattcacactaaggtgtctttttgtttttgttatttgagactctgctctgtcacccaggctggagtgcagtgatgtgatctcagctcactgcaacctccgcctcccgggttaaagcaatcctccctgcctcagcctcctgagtagctggaattacaggcatgcgccaccataccccgcttatttttgtatttttagtagagatggggtttcaccatgttggccaggctggtctcgaactcctgacctcaggtgatccacctgcctcggcctcccaaagtgctccgattacaggcatgagccactgtgcccagctgttagtagcccctgttactagcaaaagctatgtattacccagagttgttggtaaacaggataaggttcctgccttaaggggcctgagtcaggtggggatgtaaaccctgggttgcaataagttaggaacttttctaatcaagaggaacacagtggcccgtggggtactgtggggcacctggctagcctcgcctgggtagatgcctcctcaattcattggcacaggaggcataagacatgctttacttgggtttacattaaagcttattctattaggcccgtaccccaaatgactgattttggaaatgtccgactccaggagcgagaagggtgcaggtatccatcatgcaaaggggaggtgggaggtggaggaagagaacagattctggcaggtgtcttttgcttctggagtctactgaacaggggtacttcctgggagtgggaagctcatggagaatgtggctggatccatttttggcacattagtaactggtaaagtaagcttagtagcggctacctccgcaacagagctgaaaggagaatgcaaagtgcagtgtgaaagccgcagctgcagcactttttggagcaagtggttgggtttgtatctatggctcctgccaatgggcagacattggttcctcatcataccatggttgctgtagctcaggcttccttgggcaggctgaaaactggacttcacactgtttttcccttgggtaggtggtttccaaatagctgacccatagggctaataacctcatggttataatagttactatttgtttattgactgcctttcaagtgccaggtagcatgctcagcacttttcgttcattactgtaaaccctttacattcctgagaggcaggtggcagtgacctcattttacatatgaggaaactgaggcccaaggaggtgctgaatcctgcaaaggtgcatagtagttgacagtggcaaagttctcatgcctgtaatcccagcactttgggaggccgaggcaggtggatcccttgagcccaggaggtcaataccagcctggacaacatgctgaaataccgcctctacaaaaaaatacagaaattagcctggtgtggtggtgcgtgcctgtggtcccagctactctggaggtcgagatgggaggatggcttgagcctaggaggttgaggctgcggtgaaccatgatcatgccactgcactccagcctgagtcacagagtgagaccctgtcttaaaaacaaacaacaaaaataaaatggcagagttgaagttcgagagtactctggtctgtctgaatacaaagctaagttctctctactgtttctcgctcctcttaagctgagctgattaagaaattgtgttctcagtgccttgtttattttttaacatcacagtctccttaggtctgaactgatttactattttcctctacctcgtgtaaataggaattttactattttcctctacgtgaggtagaggaaaatagtaaatcagttcagacctaaagagaaagtattccgctaaaggccactgcgaccttgtgatcccaagggaaatttatggactgctgcttttctaggtgtcttaaagaagagggtagattaggctgtgcagaaagtctctgaacgggtcccacatcctaggttagagagacgtgatttccacccttcttcaagttctgcaaacctctgagtttctgtagataattggttgttgggtaagagattaaaaacaaaattcagcgttgggcattctagaataaaacgaagctgtgcacatccaattcctgtttatgtggtactcgcgacaaaaacaaaactttgctgcatagtaattacctcaagctcttaaaattacaggtagtaagggcttagaggccatatggagttataattagagatgagtttaaaaaagggctagtgaatgaatgttcattactacaatgagcactagctgaatatttcaacccgagaaggatcagctccaaggaacatttccagggagttagcggagggtcgtcatggagttagagtgtttgggattagtgcacagagcatttgttatgaacgtgcaatatttctgccagcctggccagaagcctctttgtttacagggcagggtttcttccctgctgcccaatcacagggatttctgctttgctttggtagagtacgtaatcgttcaggtgattgctttgtagtgtgttaggtctgtaaagctcctcgactgttaataatcttttcctgttacttatctctttgctggaagattgaggtaagatgacctctagttttggcctcaagaattctcttgtttttgaccttttcccttagttttctatctttgtgtttcattgcattcaaaacaggccctctgttttcccttgcaaatttatagtccacatagggaagaggaacgactgtgaccaggactatccaggaatcctgtgatgggagtgttgttagtcccattttccaagtgaggaccccttcctctctaaggctgggagtttgggtattccaactaggactgttaaactttcaacaatggggctcttttgacttgattacaaaagaaaaggaaatggcccagttttcaaagtcatgaagaggttctagtatatcttatgaactaatatatatccttgaactcttttgtagctgacagtattaaaaaaggtttgattccccaccttttttgcctgtgtggtttttatcttcctttctataaacaatgacttactcagaattatacagcagcagctgaaaagttgattagcctccgtccttgccctaatcaagtatcaaaaacctggaatgttcacttagagtggtgattactgtgaaagctttaggtgctggagaggacctgataaagaatggagtgagagataagagagagagagaaaatagcttgcaaagggattgcagggtggagtttaacaaacttaagatttctttcttcctttttttttttttgtttttttgatacagagttgcccagccttgttgcccaggctggagtgcaatggcacaatctcagctcaccacaacctccgcctcctgcattcaagccattctcctgcctcagcctactgagtagctgggactacaggcacgtgccacgacgcccggctaattttttgtatttttagtagagatggggtttcaccatgttagccaggatggtctctatctcctgacctcgtgatccgcctgcctcagcctcccaaagtgctgggattacaggcgtgagccaccacatctgccttttcttttcttttcttttcttttcttttcttttctttttttttttgagataatctcactctgttggccaggctggagtgcagtggtgtgatcacagttcactgcagcctcaacctcccagactcaggctcaagtgattctcccacctcagcctcccgaggagctgggaccacagatgcaggctactatgcctggctaatttttatgtgtgtgtgtgtgttttgtagaaatggggttttgccatgttgcccaggcaggtctctaattcctgagctcaagccatccacccacctaggcctcccgaagtgctgagattacaggcgtgagccaccgtgcccagcccaaacttaagatttcttttacttgtgagtttcaggtttggggcttaaatgcatttggtctggttgtggccagactagctcagccctaacagtctgtgctgccttgggccacctataagctttggggagtggggtgggtgggttgggaggagaaggtagggtgaagggagaggggaaatagtgggtaggagataagacccaccagttagctgattctccaggcctggcttgctcatggcatgactgcttctccctgcaggcctgagtccaactttctgggtgtgaggcagctggatggggtacaaaagagggagagagttgccagacactttccaggagacctgcccaagatcagtaattctcataatagcaaatgctcccatagcatttgcctccagccccatcctagagcttttactatagcaattctatgggataggtgctatcataaacccattttacaggcgatagaaacaaggccacgggaaattgggtaacttgtcaaagtgctgaaatccagggttgaaacccttgctgtccggctctgagctatgctaacaactaccacctcattaggcatagaggcctggatgctgcacctgctcttcattcattccttgaactcacccacgtatttcttcaacaaattattgatagcctgtatatgcctttatcttggcaatgagaacaacataagtgctctttgtttatgtgtctgaattcccataaactttattttctttcttttttaaaaaaattgccataaactttcaaacaaacctttaaagagacgagacctctttactgaccttgtatacctggtgtctggtagaaaataggtgctcaataaagctttgtggaagaaggaagaaagacagtgttttgaaacttgacatccttgtatttcctctgtctctagcagccacagtgatatctaaacagaaaaacagacaagccttaagtaaagtgagagtgtgtggggagtgttttgcaaaaataacaggagagaatttttgataaaagcatgctgtcttgtatgcatttcaagttctcatggtgaatcattttttgcttgtttgcttaaagcatttcttatctgaagggcatcccgacacccagcttgcagactactgagtgaatcagggaggcccttcagacttccatgcattgttcggggctgctcttgtcatcagggtctgcagaatatattttctttgcagttgaggaccaaatacctggtaaggttcaagtccaccatccattttcctgtttaacatttaaatgcatgagctagtagaaagtagtttcaccttgggctgggtgaagtggctcacgcctataatgctagcagttttggagtctgaggcaggccgatcagttgggatcaggagttcaagaccagcctagccaacatggtgaaaccctgtccctgctaaaaatacaaaaaattagctgggcgtgggggcgcatgcctgcattcccagcttggcttgaacccaggaggcggagattgcagtgagctgagattgtgccactgcactccagcctgggtgacagagaaaaataaagtagtttcatctcctgtattttcattccttcttcacactgtggggcaaagaaaggtctcattcacttggattggaagctctatttgacgatcactaggagtgatggctctttggttcctcttccatttcaggtttgtttcctcctctgtaaaatagatgtaatgcctaccccatacagtcaagccatatctctttgacatagtacagtggttctcaaacagggtccccccaacctccccacccgggggtacatttgacaatatctgggggcattcttggtagttatgactggggtggtgatggctcctggcatctaatgggccaaggccaaggatgctgctaaatatcctttgattcaaaggacagtcccccacgggaattatctggcttaaaatgtcagtagagccaaggctaagaaaccctgacaaagtggaacctcaaacaacggtagctctttttaacatctctgatccaagggagctattggccagggacaaagatccctcctttcttaagtagggtggaaagaatggaatttaacgttttattgatgcctctgggtttccccacaggtgcccctgaggtgggaacacctccttttctctccattaaacatgacttaacttcatttgaaacttgcttgcatcgtttacatataaatagccatgctaaaaccagtgaaaccacttagcctgtggggtggttaaacccattccctgcagaggacattggtggagtggggcctgtgctgctacaggcttgtgagcctcgcttttctcccctgttaaagggcagataggtaattgtgtcaccctcccatctcgtcatgttgctctgactctgcacgtgtgaaactagctctacgtatgtgaatgtgctgtgtgattcctaaggtatgccttttgaaggcatttttcacgggatccgtttcagtcaaggacactaaaatggttggggctcaacaaagaatatctgtgttacgggcatagtaggaggccccccaaatagttcctgcagcagggtgtgtgattcgggaagcagtgtggcccagtggttgacagcatgaggtcagccactcacaggctgctctgtgtacaacctttggcttttcccgtgcttgttgtgtgaccctgggttagctacttcacctcgttgcacctcagtttcctcacctgtaaaatgaggataacgacagtgacgacgataacacccagctgaagatgggtgcgaggcttcagcgactggtccttgtgaggtgtgcggtgaagatgggagcttagctcaataaatgagttgctgttagtaaaatactatttgatgttggcttgtagcttgtgtatttttactcagatgaagagcttgctcctgatttaggagctgaaaaaggatctttctggttcttggtattttttttggtggcaaaatacagcataaaatctccattttaaccaatttaaagtgtacagtgcagtggcattaagtacactcacaatgttgtgcaaccatcaccactatctaattccaaaactttttcatccccctgaaaggaaaccctggacccgtagagcagtcactccacgttcctcccttcccccagccactccctccctgcgagcccgctcatctattttctgtttctgtggaactgcctagtctagatatttcatataaatgtatttcatgcaatagatggccttttgcatctggcttctttcacttagcataatgttttcaaggtgccatctgtgtattgtaacatgcaccagcacttcaccactttttacctggtgtcttttttgcagagcaccccaagcctcagtgtcatcaggcctgtggttctctgaagtcatgccctgttttcaagttttaaactgtctttcttcattgattttgatccttcttggccagccttattttttccacttttcccatccagtacttctaatgacccttgaaatgaatgtggaatgaagccctcatgccaggttcttggtgctggggaataggtcttattaggtatcttacttctgtgaaagaattagcagcaggagcacacataggggccctgagtggtgcttcatttccccatgactctgcgtgacaggttttaaaaacaagtgtctggaaaacaccaccaggccccttttattcatcagtttaaaagcttcccacaatgagaagtggccctcaattaagtcgtttaataaaaacctccccctgttttaaagcattcttgggaagtgtttacatttgacgccactgcaggcttctaaatgaggagctgtggagtgagtgatccttaacctgtgactttaataatatcctttgctttagatttccaggtggaggcctgggccagatttgtagcttgtcattgacccagactgggttcagagatgggggctgggcagggggtggaggacattcttggctatcctgcccccctcagctgccactagtagaagattcagaaaggctgaaagccacatagatatgtaaaaccagctccttggagagagactggactggaaggaggtgaagcatttccctacctgggaagggcagttaccctgccccacttctgaccttatctgcagtgtcggggggcttcagtgggcagagattaaagcatttaggagagcagtgccaggctcctgagattctggggccttagggtctgagagctggaggaggctctacttttttctctgattctggagaggtgagtaggccccgagaagaggaagcaggctgctttagcttcagggaaaactccggagttgtcattagaggagtcctgggaaaagctaaaataaagaaaattctagggtggtctttcctttgtgctggacgaagacaggagggtgaggggagcccggagctgctgacacgcactggtgatttgtagaggttgccaaggtgggcagttagcagtctggattctgggcctggactgcccggatctgaatcctccctccggggttctgttctatgaattcttgtgtgtccagtgctcagagcagtgtctgcagaggtagctgtagatatgtgtgctcgcacgactgtactgacacttcactttggtgagtttctggttagaatcatagaaatgcttcttgttatcagagctaatttgcctgcatacctggcagccttgtgcagtccatgggacagggtgatgttactggactctgaagaaaacatgactcgcagatggagaaattatgcttggcaaatctattaaagttctccgagggagagaataaatgtgggaagaaggacaaaccagtggatctagattttatttagacttccaaaagattgttggaaagacttcatggcaaaggctattagatgtgggagtctcccatgactttctgagtggaggtgaatggaagaaggagtctggctgaaatttgtctttttccattgtcctttagaggaggaatcttcacatttgcagatgaaataaaattctaaaggtaaaaatgaagacttcggagtcaaactatagagaggtgttttttttttctttttaaatttaaattttgggcacgaggggatgtcaactaccctttaaaataattcgtgatcagtggctgcacctgggcagctgggctttggaactaggaatgatgtgtgtgctgctttctagcaaagttaaaaatcatgtgcctggggcatcagagtgctcaggaaataaatgaagattagtggaaccaaggagttcattaaaaatgattcaagttccactccagcctgggcaaaaagaacaaaactccatctcaaaaaacaaaaaacaaaccaaaaaaacctgtagtttccaactgtcttttaagtgaatagtacatttgtagaaaaagtagattctgctatcaacaaatgtaagagttcacttaaatgcacagatgttgaatttcatgccttttgtgttttaacccaggatagtaaatgaatgaatgaaatgagcagacactttttcaacacagacccttccctctcgcccaataggatttaggaagcttggagttacgcttgaccaaaaagacacgtgcaggagttagttacctttgtgtttttctttttactcagtgtcctgtgggccttgcctggtgccttatgtataggagtgctctgtatgtgtttgaatgataaatggactcagatttccttaacataagcgtaaatattttatcatcgtgtgtcattatgtgccaggcaaacttagttatatttgctcttacaatggttgtattggatattgctgcttaatattgccgtgtaacaagcaatcccagatctcagttttttgtttttgtttttttttgagatggagtctcactctgttgcccaggctggagtacagtggtgccaccttggctcactgcaacctcccacctcctgggtccaagcgattcttctatctcagcctcccaaggagctgggattacaggcacgtgccaccacacccagctaattgttatatttttagtagagacagggttttgccatgttggccgggctggtctcgaactcctgaccttgggtgatccacctgccttggccttccaaagtgctgggattacaggtgtgagccaccgcacctggccccagatcccagttctttatgaccacaaaggttcattttcccctcgctcagctgttggttgggtgtggtttggttgagccaggctgtgcttcacttggccaagccagactccaggcttccatctgggttgaggtctattccacatgtgttttattcagcagcccaggctgcaggggcaacaaatatgcagggccagcttgccttgggcagattacagaggcataagaaggcaagcagaaatgctggaagcctcttaaagctttggtctataagcagcccactgtcagttctgccaagattcccttggccaacacaaattgcattgtcaagccccacatcagcagggtgaggaagtatacctggccagttctagtaggaggtaactcgaagtcatatggcaaagaaggtagatgtatatggaggagcaaagcactgagaacaataatttcattcacaatggtagagaatgaataagacggaagagagcagtttgggccaaactagccttttgggagcttgcgagacctaggctgactgggtgaaaaatcatatgcatttggtgcaggtaccagcccaggccttggcatttcctgtacattcgctggcatgcgctgcctctcggctggctggacattgatcatatcctttcactgcgatggggctcgtgggagtgctgcctatctgtgggaggagcagaaggatgggcctgattttcttcgggttagccatcatgacctgacaggctgccagctgtggtggcaggagtgtgacaagctgagagggcaaagaggacaaagaaggaccacagtgttgaaggaggccaggggcttgcctcagcctaagtcccacctgtaatagtcagtgacaggttagcatcagtgcctgtgtgtaccatgtcccaatcttcataaggatcctaggctgtagcttccagaccctgccttttacatccaaagaaacaggcttcaggaggtgaggtgacttgtcttcagccaaccagctcaaaaatggcagatgagagccaggccaccctgttcccagtctagggtctgtctttccacaccctgtggttgtcatagtctagcagagtccggactggtgttgtgtgttatagtatattctggccctgtgatgacagagtctgctttggaagaagccatgtgagcctcgtgcccataagggatgacataggcgaagcagaatgagtgaaatactggccaatgataagcagccttgctgttactgctttgcaatgggccatttctttagtgaagagctgctagactttgaggaagaaaaggctctagccacttgtgaaaatgaaccaggaatagatggggaccaaaaccttgtaaagccaagggtgtgaggagacagacactctcacatgtgctgagtgtgggattataaattcactgggcttctatctagagagcagtttggcaatggggctgcttttacttgcaagtaaacaaaactcagttgaaggtggtttacataagaataaaaacagcaaaaagtggttaaaaagtggtttaaataagacatttcaaaatgacatttgttacctcatgtaaacaagaagtccaaagtctgggctgttgggggagttagtttgaagacccaggcttatttcctctttcctcgcctcagtgtttgatgtttgccttcaagcttgtttcctcatgatctcagtgtggctgttgctgctccacccatcgtatccttattccatatccttattcagagtgatgtccacaggcaggaaaagaggaaagaacagaaaagatgcaaatcagcatgtattctgagatcccatttttttgttcgcaaaaataaacaccttcacatttttctttcccccccctcacctgacaccatcacaataaaagtcttaattttttcagcaccataagatggtgaaaaaaaagtcttaatttttgattgtgaatatcaatttctggaaccaagaattttggttatttctgggccatgggatggtgctgtggttttgttttccatttcatgcccttcttggctgtttgaattttataaatatcactgcatgtattacctttataatacaaaagaaagtgataggtgttttcttagtaggggtgggagatattaaagagaggaaaccaaggccctaacaggggcattatctgagacatgatgtgataggataggagtgcatttagctgtgtgtgatcagcctagagggaggttggggaaggggaaaagtccaggagtgaaataaggtcattttaaatctcttttggtacctggcacagtgtcttctacctagtagagacaaaaactcatttgaagtatgaatgaatgtttaggtcaagacctaacacaactttatgaggggctgaaacccaaccaagcagctcaagtcagcaagaaagtacattctgctggaaatttatcttgcaaagaagtatgactgtcatttcctaccttttccttgagctcccagaatctaattcattgctaaggaaacagtgtaagtatgagaccttctgttcatcatctgtctcctactgaaggctattgtcccaggatctggataataaagctgtataaggtttttacaactgagggtagagcaaaggcaagaaaccaccatctcatgttaactgtgttaatagtctgtggcttgaatggagtctagatgtttaaagtctactaagtgtagaatgaacagtcatttttttttaaaggaaaaataaagttctttgataccctggactaatacataaaaaattgttatcttaatgatgtgacacagataacagttgtgagatagggattttcaacctgattggccagtattagtagaagagtgtgaatatgcctgttggtgagatgaaagaattatatgtagtggtattttcaagtctaattctcttccatatacaaaaataaaatgggtattgaaggcctttttaatggcaagggtggaaggaggggaggtagagtactacccttacattgtgccatagtcttaattcccttgctccagggttctaagtttgatgctcataaatcaaaagaaagaatgttgtaactgacatttctattgagttacttttaacttttgtacccttgggttttagcattgaggccttctgcaatggccaccggatacccactttattcagacaatgataatatcgttgagctatggtaagatcatttcctttggaacaaaatgaaaagctttcagtgttcacaattggaggaaaatgtaaaagcttagtaggcctcctctgctgcagggtgaagagtttgtgtttgaacaccatccactttgctcctcaaatgtgcagtggaatgattccagtgtgcttttgaaatacagaaaacaagtgtaccttttcagtgtgtgtgtgtatttatgcatgtgtgtgtttaatgggttcttggaaatacttggaagaaaagtaatatttaacatctttttttgggatcattttgggatccaaagaatctgagatcattggtacgttatgttccagagtagccccgagttaaatttcttgagagagagagaaagtgcatgtgtttgtgtgtgtgcataagtattactctaaagaccaaatgtcatgcttacttgacatgatcttagtatatatccttatctgcttctcagtctatattatatctgcagattttgtgactaagtggtgtaattttacatgaattctgcatctgcatcagaaagtatgataacaattaatgatactaacacttctatgtcactaaacagtgcttgatactgttctaagtacttaacatgtattaactttttttttttttttttttaaagccaaagccttttgtcacccaggctggagtgccatggcacgatcatggttcactgcagcctcagcctcctaggctcaagccatcctcccatctcaacctcccgagtagctaggaccacaggcacgcaccaccaaaccagggtaatttctgtttgtttttttttttttttttgagatggagtttcgctcttcttgtccaggctggagtacaagctcatgttgcccaggctggagtacaatggcgtgatcttggctcacggcaacctccacctcccgggttcaagcgattctcctgcctgagtagctgggattataggcatgtgccatcaagcccagctaattttttgtatttttagtagagatggggtttctccatgttggtcaggctgctctcgaactcccgacttcaggtgatccacctgcctcagcctcccaaagtgctgggattacaggcgtgaaccaccatgcccggcttatttggtttttatagtaacgctattgattccatttttaccaaggaactgagatacagagagatttagtaacttgcccaaggtgacataactagtaaatggtgggggtaggttcaaaatcaggcagtttgctatttcttatttaaagccacaattcatgagaattgagccattctcaaatgtacaggttattcttgtaaattggagactattgtatcagtgttacaaatgacctattgtaatctcccatccaagaactaaccatttctgaccctgcttagtgtcaatagtcaggtgcattcagggtggtgtggctggagatgatcttatatgatctgagccccttgcttcatgaacaatattttcagttactttacacagtaagcacgtacttaaacaattatttggctgggcgcagtggctcatgcctgtaatcccagtactttgggaggctgagatgggaggctcacttgaggttaggagttcgagaccagcctggccaacatggtgaaaccctgtctctactaaaaatacaaaaattagctgtgcatggtggcatacgcctgtagtcccagctacctgggggttgaagcaggaaaactgcttgaacctgggaggcggaggttgcggtgagctgagatcatgccactgcactccagcctggatgacagagtgagactccgtctcaaataaacaaacaaacaaaaaccccaccaaaccaaaaaacccaattattttaattataaatctgaactgcattaaaagatagtaaatttagctagtcaacttgaataacttttaacagagagttagttgtctcttctgtttccttagggaagaaagatgagttccttcagttcccaaatgagtcctcaattcaacatgagtgatttcaccagaataaaatcttcttacttctgcaaaaagcagctaatgctttcggaagctaaataatcccaatgtgtgactcctgccagtttcttttctttgaaacctcagcagcagcataactagtgattcacccttcttgaaatgaatgctgtgattcgcgttatgcacagatggctactgaatgcccaggtcacagcctttgcgtctggccttgactcgttaataagaacaggaactgggcatggtgtattgcacagtgattaagggcttaaagctaagagcagtgcctggccccaagtaagacatgagtagaactttgctgctgctatttttgctgttgtatattgggctctaccttgtgctgggcactacgttaagcacgctatgtgcattgcctaattgaattctcatcacattcccatgaagtagttgatggttttgtttttatcttcattttcaaatgtagaaactgaagcttaaggttatgacatttgcccaagaccatgcagctggtaagtggttagcgccatggtacgaaccaagttaaaaaacattttttttaattcataaattataatgtacagaatcttctagaagctttcttgtgcctcctcctgattgttatttttcaacaaagttgcctactattctatcaccacagaaaagctttgactgttcttgaacttcataaaaacagaatcatattcatacagtatgtactctttgtatttggctttttttacttagtattatgtttgtgaaattcatccattgatgtgaaatacatggatttgcatgtagcgataatttgtttttcctcattgctaaatatattgctacatttcttattgtatagtttaatgtacaaatatgcctcactgttgatctcttctactgttgatggactttggttgtttttagttcttggttgttatttattgtgctacttactttctttctttgtttttttttttttttttggaaacagtctcctctgttgcccaggctggagtacagtgatgtgatctcagctcactgcaacctccacctctgggttcaggtgattcttctgcctcagcctcccaagtagctggggctacaggtgcatgccaccatgcctggctaatttttaatttttaaaagagacagggtttcgccatgttggccaggctggtcttgagctcctaacctcaagtgatcttcctgccttggcctcccaaagtgctgggattataggtgtgagccaccatgcctggcctaattgtgttcattcttgtacatgatttgtatacgtatacggctctttgagtacatttctaggtcagcactgctgggtcttaataggtgtggagctgtattctatactgtgaaactgttttctacactcccacctagcagagggttcagtggttctgtcctaacactgtaatgactatcatcattctggtgggtgtgtagtagaatccatatcaaacttgatatggattttgactccatagcctatggacttacctggtaagaacaattttaacaattatagcgctcttgctatacggaaggtgttgtgctgatatgtaataatgaatataacttgatttctgccctctaggagtttatagtccagtggaagagaaagactcagaaatcacataatcatagtccaacacagaatccatgcatagggcactgttggagcactgggagagtctacttcaatctgtgggttcaggacggggtcgctaaagtcttgcagaaagaagtcagtcttctgggatatggcttcttcgggaaggtgacatttaacctgaggctgggggggatgaaaatagagtcatgtgaagaggaatggatcagaagcctgtgtagccacagggaggaagtgaacaggtgatggtaggctgaggtcaaagagccctggagtccatggcatttgtaaaccattgcgggccttgaagtagagagccaatgttgctatgaagcagtcaaaacggttctccttcatcagcctgtgacccacaggggacccgcaggcctttgtggaggctgcctccatttggcggagtggtggtgttggagaaaatggccttactgactcctgaactaggaagctcctgatcctaactctcttagtatctcatcttgcgaattactaagacagggtctttaagatgtcttatttattttttgatgtacattttgtaaattaatttttataatgcttcaaaagctaatttttaaattataaaagtaatagaatcacattacagaagccagaaaatggagaaaaaacccccactatcattttattatatagtttttcccatcgttttaattgtagggtatagattattttatgttatccccgtgtcctttgacatgtgacgagccttttttcttgattatgtagtcttcattactattttattattgtagaatatgaagtggaacaccttgtaccacttaaatttcctctttttttttttttggagatggagtctctctctgtcgcccatgctggagtgcagtggtgtgatctcagctcactgcaatctccacctcctgggttcaagccattctcctgtctcagcctcccgagtagctgggattataggtgcgtgccaccacaccatgctaatttttgtattttcagtagagatggggtttcttcatgttggtcaggctggtcttgaactcctgacctcgagatgcgcctgcctcagcttcccaaagtgctgggattacaggcgtgagccaccatacccagcaccatttaaatttcaatctttctttcacttttaattgtaatgagaaaaaaccaatagatgcttattgtaaagcatttggaaaatacagaaaagtataagatgaaaattaaaaacttttcagttctaccatgaagataaacacatgttaatatttgggtatatttcttttttcccctctgcttttatttacatatatgtatgcttttctttccttttttgtttttttgaatacaaattggggttttttttcctgcaagcaagatactgttaatggggattttggatggccatataatgaaataggaaaacgattaatggaagcccaggaggaaagacttggtgttattataggtttgtatcatatcaccattttcctgttctatttggaggaagagggaaaggggaaaggaagccagcccttattgtgtgcctgccacgcacctggtcctgcagtgctgggaagcactgtgagctctgactcccagaaaagtagacgctggcactgtgggaaagtgggaccctcatggcagcgtgttgtttgaaaaaccagtctttcaaacataataactgagcatgttggaaaaccaggctggcgtcatggtgtaaattgagtttactcaaaccggcaggttgttgggaaggtacacatacctctattgttttaacccacttgaagattaaaatgtgggaagagcattttgaatagagaacaccgtactttatcatttggtgcagaggccttgtatttttaacaaaaattgccccaaagtttcctccaaatgcattaaatccatgtttttgttgtttaaccatgaatattttgaaaaaatttattattttgaaaatccaggccctttaaattttatttttgctctcacaaatccttctttccttttgagttggcacataattgtacatacttatgagaaaacaaagtgatattttgatacatgtatacaatgtgtgatgaacattaatagaggattggctaaattatgatatatataaagtgctcagagaggtggaggaggtaataagatagaaggtggactttttagggaagtcctttagagtaattagtatattcatcacctcaaacatttgtcagtcctttgcattgtgaacatttgaaatcctatcttctagctatctgaaaatgtacaataaattaacttatttctcctatctagctgtaactttgacctgttcaccaacttctttctatcctaccctcttctctacctttcctagcctctaataaccatgattccactctctacttcttcaatatttaatttaatccccaaattctaattgtagtccatatttgaatacttcatattattggtcacaattttgggctttgtattattggtcacaattttggttgattattttttgaaaagtagaatcttgttttttgaagccaggcttaatcacctgaagacccaggacatctatagttgttttttttttttttcctaacaaaattctgtatgcggaaaataggaaaaataatacaagaaagacacaagaaatggacagtgctacatttctgattttacatcttcatgacaatgagtaaagatctctgagttttgtcttcggatcggagtatggaatctgtccattgaggattgcaggtcgagtgcaggggctcatgcctgtaatcctagcactctgggcggggagcctccagcactgaggctggaggattgcttcagcccaggagtttgagaccagcctgggcaacatggtgagaccccatctccatgaaaacttagacactaaataaaactcactattttcattcttattaatcttatttattacttggagatatccttagaggctctaggtgtgtaagtctccttgttcctaccctaaatagctatagaaattgctgtatttctaatacctttttttttttttttaatggggtctcactgtgtcaccaaagtggtggtgcagtggcataatcaaagctcactgcagcttcaaactcctgggctcaagtgatcttcctacctaagcctctcgagtagttgggagtagagatgtgcaccatcatgcctagccaagttttaaatttttttgtttgtagagatgggggtcttgctatgttggccaggctggtcttgaactcctgacctcaggcccgcctcggcctcccaaagtgctgggattataggcgtgagccattgcacccagcctcttctcattcttaggtctgccttttgtggttcttctgtcactttctgtaactgatactgttagcagcttatgcttttgttgcttctacttggctttgggctaaggattgtaacttccatctgtgtcaagttgtgtgtgaaggaggctgagtttgaattgtgttttatgctgggtgctgtgcttgaggcagcttgttgcctaaaaagaaaatggtgggcttcacagcacacacagctttggatgctcaaagcccatttgagcttccattcacttattttctttcttattgtaaaaacaatacatgtttgtgcgggcatggtggctcatgcctgtaatctcagcattttgggaggccaaggcgggcggatcatctgaggtcgggagttggagaccagcctggctaacctggtgaaaccctgtctctactaaaaatacaaaatttagctaggcttggtggcgcctgcctgtaatcccagttacttgggaggctgaggcaggagaatcgcctgaacctaggaggtagagtttgcagtgagccaggattgcaccgttgcactccagcctaggcgacagaatgagaccctgtctcaaattaaaaaaaaaaaaaaaaaaaaaaaaggcatgtttgcaatgaaaattgaagcattacaaaaatgtgttatttaaatgaaaggtaccctgttttatcatctctagtcataactacgctttaaggatttgataatttttttttagatttttctgtaactttatattttttacagagatggggttactctatgttattttggtactgatttttgtatttttaaaaatatatttgtatactttctatggctgtgtatataaatttttgttggttgtttttaatagcttcctggtgttccttggtatagatatatcgtaatttagccaatcttctattaatggatatttggactattataaatacctcatatataagtatttgtactctctgaagtgtttgtataattcttctgttcagagttaattactggaaatagggttggacggtgtatacattgagccagtgcgcccagctgcttttttcttttttaaatgcagaattttaagcctcaactccaaaccgtccgtcagaatttccaagaatgggtctcagggatttgaatttttaaaaagttcccaagtgattctgctggtgcccgagttctagcatgcctaagacatttccttaccagctcgagtgtttcataaaatatgttcaattcaaaggtggatggttgtggaaaattattcaaaacagcttcaacctgatgaagtgtttagttgtccttgaagaatcatttcatttgagccttcatgctttaatacctatccttttttctactaccaattcttctgaacttagtagcactccaaattggctcattctcaaatttccttatgacgcattctgtggtaaagactgctaattttatatccagcagtctttatattctcctcttcttcagtaaccaaaaacttgatttttttggagggtgtacagtgtgccatgccaaaagacagtatttcccagcctccccttctcctgttgatgggctagtgagttaagctctagtaagtgaaatgtgaaggcttgtggaaaggttctagggactgacttctatggacaatgtaccctttttctttttctctgtccttctacatactgcttggaacatggacacaatggctgaagtccagcagccatcttggattgtgaggtaacgatgaagatggaagccatgtgatatggcttggatgttttgtcccctgtaaatctcatgttgaattgtaatcccccatgttagaggtggggcctggtgggaggtgtttgggtcatgggagtagatccctcatgaatggcttggtgctctccccatagtgagtgagtgagttcttgttctatttcatgtgagagctggttgcttaaaagggtctggcacctctgttgctcctgctcttgccatgtggcatgcctactccatctttaccttctgccatgagtaaaagcttcctgaggcctcactagaagctgagcagatgctggtgccatgcttgcacagcctgcagaaccgtgagccaagtaaacctcttttctttataaattacacagcctcaggtattcctttacaccaatgccaaatggactagcacaccatgctctaagtagggcataaagaaaggagcctggatccctaatgactgcagagccatgatcccagccctggactgcttgcctccacacttctgtcttattggttaagccaaaattattttgggttttccgttacatgctgcagaacctaacctaatgaatacccctgctctctgttggtttcacagtgtgtctccaacaccatcttgaaggtgcagtgacttgcatatagtaggtgcttggtaagtgtttgacaagttaagtacccaatggcattgaggtaaagagttcaaaggcttcagctgctctgacctgtccccttttctgctttagattaagttattcatggggaccttttgttttttgccatctcaccccccaggaaggtatttcccagccctcagtgcagggctttagggctacaggcttgaatcattttgacaagacagcaggcagaagacattggagattctaactgcacatatgcgtaattccaaatgaaaatataaggggtgggcacttttctgaatctcctagagaaactggaggtggtggttcaaatgatgtcagaaaaggccaccattgaatcctttgctatcatttggaggctgtactttccacaatgcttgccaggacttgatgtcagggaagactttcaaggagccttgattgccagctattgacgaaggggtctgtctgctcagtggcaacctccatggtggtcttggccagaccagcctgcccctgactcatgctgagctttgtcagccaggttgaaacgcccctctttggggcccaggacaacatgctggtttcccggaagcatctgggccaagactctgctgctaagaaaatgatattgtttttgcaagcatgggagtgtgtttaaaatgcttcccctttccccccaacaacattaaacctccatgcaaagaaacacgaggttaaaaaccatctcccaaacccagaaaacagaatgcaaaacctgggaggtgaattaactctttactgatgccaaggagtttatttcaaaacaggattcatcgactacagggatttgcagtctgccctcctgtgtgcccactgagagcaatgggcagaggctgacccgcagccctttgtggggaaaagtaaattccatggcagacctcagtggctgaagattatttgcttctcctggaaataattagaaaaatacttactctttgaaaggcaacatctggctggctagaggcaggctggaaaatactcaatctaaatagatggaggtgacgttgtgcagaaggaaagaaacatcccgagggagtgtccagtgggttttaatggccgtgtctagagaggcactcctgctctgtacaagggctggcttcttccctggatctaggggttgcccctgccttttagaagacagatgcacagccccagagcctagttgcctcccctgaccccctccaagccttccatagaggaaaggggcctcccatagcactggctgatgctcagagccaagagtttgctgcccagggagtaccttgagctagtgctgggtgtcagacttgactttccaactacttccagtgcaattcaaggtgttgattttgactgctggaactgtctcttccttctcagccctttctcaaggctgcctgtgtgcttgttcttattaaccaagcccagaagccagggatctggaagcctggcagtatttccaggaaagtagcttatttctctcacttgcttctccctgctgagcttagaacggcccagctttggacctcttgaaacatcagggcaaatttttccccctctttcaatttgcatctacctgctggtgaaaaaagcagaacagcatcttcatggatttatgaacgctcagagtttttaaaatgttttatagcttgtaagatattttcaagtgaagaatgcagttctaataaatccaatgaacctgtcacagattttctgaaaccaagtgtctatgaaaaactatggtgatgacatgttgaaggtgcttattgaaaaatatggatccttgtagcgaacatttttgcaaagggtgcattttcacataaaaatgcttttagtagtggcttcgtttagttattctgcagctacttggctgtgggttcccagagagccctgaggcaacctttataaaaggcctaggtttgacttctctttggtcacttcagctttagagcaccctaagaaggctcagagaaccccaaatttcttcccagtaaagaggtcatggaataaatctggaggaactcaagaggggcgcctgcttttgaacagtcattagccaaacatgggtagattcctattaatcatgtcaagagggtacttgggaatcaagttcatgtggaattgggagattaaaagggttaggagtccttggagccgtaagacccctgaagttccaactatgctacttgctttctgtgtaatcttggataagaaatcacttgacctttctgagccttgatttccttacctgtaaaatgggaatgctaatcattgtactgcccaccatactgtctttttatgtgaatcaacaaagccacatttgtattggtgctttctttcctttcttttttttgaaatatgagatgcttcatgaatttgcatatcatctttgtgcaagggacatgctaatctctattgttttaattttagtatatgtgctgctgaagtgagcccatattggcactttctaaagtgtaaggtgctgcgtccacattaggcattaagatgatggctgcctttttcacttcacccaccccattgcctccattgtcaatgatgacgttaacatatcattgtttccctactcttgagcggggctgctttctatctcacactctgactcgggtgtctgatttctcccatcactctggcattgactctgggctacccttaggtgctgctcccgatttgggagctgtgtgtgacctttgcttttcctgccttcaggtaagattttctctttccaaacctttgtgctgtgatactgtctaggttcctgaatttctgtgacatcctttgatctgtcatttgcaatctccagctctttcctacctttcaagggtgtgtggtaagcttggtgagtggggagcagagtggagctggggatcctgagaaggcagttcattcatagggctctttctgtgccttcttatgtcctcctccctcagcccagactctgagcctttccccagggctctaagaagatagaaaaactcgcagaaggtgtggaccttttctttcttttcctttttctttttctttctttctttctctttctttctttctttctttctttctttctttctttccttctttctttctttctttttctttcttttctttttctttcttttctttttctttctgtctgtccgtctgtctgtctctctctgtttctttttttcctagtggggctacaacttatgcttaatacaaataaatgccttttattcatttaatacagatatttaccaagtaccccctgtgggtcaggccctactctcaccctaaggatacagcaggaagcaaagcagaggtggagaagatcccactaaacacacaggcaaggcacatcagtgggtgatgagcgctaagaggaagtatggccagatgaggtagagggtgaggatggggcggagagaatcctacctgttggcaaagccttttctaccagatggtccaggaagatttatctgataagcaacaggagggtgagacctgaaggagcctccagatcagggctgcctgggggaagggcactgtgaagaggggacagggacgctgaaggccctaaggcatgaagcataagagcaggaggctgctgggtgtgttctgggaacagcaaggaggccacagtagctagagggagggagtgagggtgggggttctaagagaaggagggcagagcattctgaactttacaggctggcataagggttttcatctgatgggagttagaagccagttaagggttctgagaagggtggaggcgagtggctcagctaggagcctagtgaagtagcctagaactttctgtggaatttgttctgcaatcatgcgaagtggcagtggcatggtaacatgggtaagtggtagtgactagatcctgagatgggaactgaaagcctggagtgaatgtctcaggaaacccgacacccgtctggcccagagggtccttatttcaaaactgtgtttaaaatggcaaacacatgagatcatggtaatcaaacttacataagtactgtgcaaatccagaaaatttgtagtgagtgtactgaattatttgccaatgatcaatagtgctgggctctgaatgcaatctgaaataaaaattgttttcctgaatgtatttatcaaaatactgagtgcttaccaaatactggtgcttactgtactagttgacccgtacaatcagtttaagtaagctaacttaaatttatgacttttgacttattcctgatctattcacaggccgcttggaatgttgggccatctgtccttttgacatgaattttccctgtaatgggggtagagctggtaactgttggatcatctgattattggagacagaagtcctgtcacttgcccctgctgttaggaggtgggcttcctgaatggctttctgtatacatgaagaatttcaagaccttccgttaaggtggtcagagctaagtttcagcgtttacaagaggtctcttggctgacttgctataacttacagcaacctgatgtttggacaccttttcctttttttgtttttagtaaatatgatgagaaaaaagactcctcatctgttttgttttattttgtgaattacttctattcttaccactcaaaaaaatgtttaaataagtaattgcgaaaaaatagggggttttgccaggcacagtggctcatgcctgtaattccagcactttggaaggattccctcaatttttagagggaaggactgcttgagaccaggagtttgagaccagcctgggcaacatagtgacaacctgtctcaacaaaaaaaatttaaaaataaccgggcgtggtgtgcatgcttgtggtcccagctacttgagaggctgaggcaggagggtcacttgaccttgggaaattgaggctaccgtgaactgtgattgtgccaccacactactttggcctgggcgacagagtgagaccctgtctcagaaaaaaggcagggtggtggggcttgacaatttgtttaatatctgaaagtattagaaaaaattattctcaattttttttttttttttttgaggcagagtttcactctttttgcctaggctggagtacagtggcatgatctcggctcactgcaacctccgtctcctgggttcaagtgattctcctgcccccgcctcctgagtagctgggattacagatgcccaccaccacgcctggctaatttttacatttttattagagatggggtttcaccatgttggacagggtggtcttgaactcctgacctaaggtgatccacctgtctcagcctcccaaagtgctggcattagaggtgtgagccaccgttaccagcagaaaaaaaattattctctttggtattttcaaaatatgtggcagtgagagggtgcagtaagttaggagttaagtgacctgactaaatatctgtgttctgctgaaatcttgcagaaagtgggatgctcaggaagaaaatagtctatcccacgaagccatttcccacaagcagctgaaggcagggcacaccgttatgtttattttggtaaagggaaaacagagttaagtttctcaggggccccaaacctcaaggatgatgaacacacacattcatacacagaagtgacttgcgttgatagacatccttatcttgaatgcctcactcagagacaaatctttccacaaatgtgcactgcccaggtgagccttttggaatcggagaatcaattattcaagaatgtgacttttaagccccaaagcaaagtttggacagttttcccagagccaaacctctggatattagtccacttttccgggataatataatttaattttagtttagttttttagagatgaggtctccctttgttgcccaggctggtcttaaactcctggcctcaagcagtccttccaccttggcctcctgagcagctgggactacaggcacacagaccgcacccagctcattagtgtccttttctgtcaatgagcataggggttcgtagacgccctttttataaagagatacgttcttgaaattgcctttaggccagacacagtggctcatgcctgtaatcccagcactttgggaggccgaggcagcgggatggatcacttgaggtcaggagtttgagaccagcctggccaacatggcgaaacctcatctctactaaaaatacaaaaaaattagccaggcatggtggtgtgcgcctgtaatccagctactcagaaggctgaggcaggagaatcgcttgaactcgggaggtggaggttgcagtgagccgaaatggcaccactgcactccagcctgggtgagacagtgagactctgtcacacacacacacacacacacacacacacacacacattgccttttgacttcctaccctcaggcatgtgtgcattaattgaggacattaggaactaaccacgtgcacacgcgtgtgtgctgagggaacaaaaggtctgaaatctggtccaggggagagttggcaaggtaaggcctggggaaagcaggctggcaagctcaggaagcagaggggcgccatgcatttggagacgtgtgagtaggtgcagagcctgcgcaggggaggcacatgggctggagatgtctggggcctggtcttgaattccatgctgaggagattgtgtttttatgctgaaagcaaaagaagaaacaaatcactgagtaatttttaggctgaagtacaaatttgaaaagatgacggtggccatggggagaacaggttggaggaaaacaagcctgaagactgaggatcaacttagaaggccacagctgtaatccaatagagatatgcatatagctctaattagggccatggtgtcgggatggagaagtatggctgagaggtttcaggaggcagggtcaacaggaagaaatcactaactgatgttgtgtgaaagggggagggagaaggtaggatgcttgcaggtcccgagagggcgtggagttgactgatgccatgttccatgtaagtcaggagctgttaggaagagtcaagtcgggctgggactgataggacttttagacatttagaagctgctaaaacaagaatagaagttctaagttgagtctaaccagggagttgttcttaccagaaaaaaatagagaaataagtccaataaaaccactgcttggtttgaaaaatcaagtgggaagggaatgaagaacaggaatttctctgcagagcatcttcatctgatgcctcgtgtgaggatctcgccctttctgagcctgagagatggcaacgatccttctgttctggaagattaaaggcacaagccgttagcccagaaggtacttcagctgagatggtttggggttctgaccagtgaggactcaccacttcaaggaagtggaatcctgtcttagttcaggggatcatttgcagtgtgagggtcaggcccgaggtagcctggcctaggaaaggaggcaagagaggactgtggagtgagacagactccgtcaggatcctaggtctgtcagttgtcagcttcacaatcaaattacttgaagtcattgtccttcagttttctcattttacatgtcgttaagtagattaaatgtgaacctaggcaaagtgcacaaaacagtacctgactcatgatagttcctcagtaaaccctagttccttagttgatatggaggatggtttataccaccattgggctgtatttcctacccttggccttttgacctaaatgaggcttgatccctggggctgactgccatcatctctcctctcttctattccatgtcgctggctatgtcagcagatgggagagtgttctggaagctttcccatcaccacctctctctttctaggcaggcattttggctgtgtctgtgtggtcccaacatgtgtacgtgtgtgtagcagggagggaggagtgagtatgaagaggtccaataacaacaattgagaaagataaaataaattctttccacaatatcggaggctatattatctgctaaactagtttttcaaaatgctaaacttttgcctcttaattttctcatgcttatgaggagtgcccttcaaatcttgtattagtcaggatgtaattgtatcgctttagcttcttttctctcttgctaaaaaaataaaatgcaatccttaataagagactgaagttcgtaacgtttgtgtcttgtcagattcagtggggaaaaatcagatttgcttgaaaacaagatgataaatatgtggtgttggtgttttcatacaagaatctaaagataagctgtaacagcttagagaacataattgttactgtaccacaaagaccaagttttttaaaaaataacttttgaaggtcttactaaaatttatcacatttataccatgttggatggtgatattggccatgttttcttaatatcaaaatatgactaaagagtgtcatatgttggactccatccacagacacagagacttttctgacatgagccggtctctgagtcttcctttttagaatacgagcttattttctccagaatcatcacagctgtctagagccttcctgttcctcctttcttggagtcactgctggcttcatatttgttcacttggacgttctcttgtataccaactgtgatctctctggggagtcaaaaccagatctggttttccttgtcctcagggaacttgcagtttagctgttctgatatttgtgccatgcactgtccagatgccactagttttctttttttctttttcttttttttttttttgagacagagccttgctctgtcacccaggctggagtgcaatggcgcaatctcagctcactgcaacctccacctaccaggttcaagcaattctcatgcttcaccctcccaagtatctgggattacaggtgtccgccaccatgccaggctaattttttgtatttttggtagagatgaggtttcaccattttggccaggctggtctccaactcttgacttcaggtgatccacccacctcagcctcccaaagtgctgggattacagcatgagccaccgcacctggcccagatctcactagttttttttttttcttccccaattctcttttgatgtggataattccactggcctttggctcagctgctgtatagagcttcttaatatcttaaaaaacctcactgagagccttggtgctgtcttccacccctttcctagtcctggaagtttacttattttaaacaagagcatcaaatgcttcttggaaaattccatcagcgctcatattttctgtgtttgctgtcgattatctagcattcaaagccccgctaacgttcagagcttcttgttgtgtgacattcgcaggtttccttttgggacaggtttggattgacttccttcctctgccaagagggcaaccagctgatgacagtttggagagtttgtgttggcatcagacgggtgctggtgatgtgcctgaaagtcactcctgagattctcgtttatttctgtcccaggctggagtttcacaggcagtggatgttagtgggtggcccgaaccaccctcatcctagctgtagacagaggcagcttcactcagcagggagccttttatcctcaagaccttttctgtacagataaaacgctcagataagatctggagaaaaccctttgttctttggtggctctgcatcctcttttctcttaaatgctgttccttactctgctctcctctggcctctttggtgtgattatcttgatgttctctgtatctgttaagggatgattgttgtctgagtaaatatgagatggcatctttgattatcacatttcccaggaacctggctgatgcgggactcctttctcaaacctgcttgtgaatggatagccaggccctgtttgccttcctccacctcatggggaactcattgtctcctgaaacagcctagtttatcttgacgcatctctgtgagaaagctcatttccccctttcgattgaagtggagtttgtgtccctggcacatctactctttattggttgttctaacctttggagccacacagaccaagtttaatcttcttttcacatgacaaccattctggtattcatatgtgatgagagttgatcatgcttccagctctactcccctccttctgtacccagtgccatctcttagtatctcagtttctttttttttctttttgagacggaatctcactgtcacccaggctggagtacagtggcgcgatctcggctcactgcaacttctgcctcctgggttcaagggatttctcctgcctcagcctcctgagtagctgggatgacaggtgcgtgccaccatgcccgactaatttttgtagttttagtagagatggggtttcaccatgttggccaggctggtcttgaactcctgaccccgtgatccactcaccttggcctcccaaagtgctgggattagggcgtgagccaccacacccggccttcttctccttctttctttctttctttctctctttctctttctctctttctctcttcctctcttcctccctccctccctccctcccttcttccctccctccattcctccttccctccttccttccttccttttgagacagggtcttgctctgtggcctatgctggagtgcagtggcatggtcaatcatggctcactgcagccacaacctcctgggctcaagccatcctccgagctcagcctcctgagtagctgagactacaaggtgcgcaccgccatgcctggcaaatttttgtgaagatgggggttttgcccaggggttgtccctaggggttgcccaggctagtctggaacttctgggctcaggccatccatccccctcagcctcccaaagtgttgggattataggcatgagccaccatgcccggccagcatctcagtagggaaaccactccttcctggccgctcttttttctcttttcttttaaaaaattaatcaacagacattttatttagaagataagcatagctaactagatttcttcccatacccacattcagtgataaaaagtagatcaaatgctttttggatcccttttgacctttttgacaacaatgttgctgggtagatttttgtgggagttctctaccatcgggcacgcttggctgccacagggcaactgcttggccttttcatcccccagtgtcggcatcagttttacagggaacattctgtggctctttcaaggagatgcctccagagccccatttgcagtcatataagttgtgttgtagtacccggggctatggatctcatgaagttatttgtaatattctaacagaaatgaaaagtcttaaagcctcaagtgacttgaaggcactatgtgaagagaaggtttactaaagtgatctggatgtaatataatctggctgctgttttttgtaaaccagactcttggtgatcagcctcaagcagagggggctgcctacatcagctgggcatggagctgatagcagcatcagcaggttccctttgctaagggggctgctgggctggtggccccttcatcctttgggctccctgcatgttcctcagaggctccgaagaaggcagacggggctggccgtccatcacaggcagatttgaacagggaatctaatgtcagccccacaataagagcaggtttcttccaaatctgagagtcgaggatcccatcttgtatttactcagtaacagtcatccctttatgtatacacagaaaatcaagataatcgcaccaaagataagcatagaggtgagtgcagtgaggaacagtacttgtgtgaagagacagacttttgagatagctgtgtggagttgttctgggttcaaggggagtctgcagtgtggttaactgccctgccctgttgaaactagatatatcatttccagaggtcaccgtggtgtttgccaattatctcacagtgaatttgtcacctgtgttcctcacacttttttaaaaccaaaacaacaacaacaacaacaaaccaacaaaaacaatccaccaaaaccaagatttgctttcacgtctcatccaccctacaatcaaatgattggtttcttaggccgaggttagggttaggggcttcaaattctccttattaaacctcatttttgttagacttgatccatgattccagcctgctgatctgtttggctcctgaactctcatatattgcattgtctatgtttccgaagttgtagtggttaaggacacaggctttgggggtgagagagaatgggcataaatcccattccaccacttagtgggttgtgtggttttgggtaaaggcacaatgaagaatcttctggggcatttcacggagcagatgaatggtgtcttatggaacccatggcaggaggcagcagccttgggaaggtagaactcggacaactgagatcaaatacatctccttatctcatctcagcttcggtctgaacatttaagtcctttttcttttcttcctggaggctgactcttccatctgcatgataggcataacagtgtctctccaaagatgcccaattcctaatcctggaatctgtgactatgccatcttgcacagcaaaaaggatatgcttaatttaaggaccttgagctggggagattatcctgcattatttaggataatcacaagagtccttatatgggagacagggaggcaggaaagttggaatccaagaaggagatgtgacaatggaagcaaagccagagaagatgctacgctgctggcgttgaagatggaggaagggaccaagagctgagaaatgcaggtggcctctagaagcaggaagaggcaaggagacagagtctccctaaaatgaggaatgcagccctgttgccccttgattatttgaatcattttaagccactaaattgccaaaagattccttcccttaaaagtcttccagattctacccaccctcttgcagtaatgagctccccacctatctctgagccccatttggaggcagggttgttcctgctttcacatgtcctccatcactcttgtctccctcagtgcctggcacgggcccaacgtagagcatgttcttggtaaatgtctgtggaaccaaagcccccaagggaaagctgatgatgcctttcagaaatccagctgcatgattacagttctttgggctccttctgtagtagctctgccagaaaagggaacaaggttagtttctcctgattttttcccagcgaacctccagtgggattagagatggcggctgcttccctgagtttccctttgccggccgtgggatccctgctctggggcctccgtgttgtgaatgcacctcctctctgagactgaaccgctgtctctgtagtcctcaaatatcagaggttgggttgaaaaaacccacagaaatacagttttgaggccttctagttcttgagtgtactacaattgaaaaggtacttccacattgctgatcccttttagtccctgtggtagccccttgaagcagccaccctcttttcgatttgctcagtgttttttttttttttttttaaattgtaaggatgagtgtaacaacttctagcctctttacatgtagggttggaaaccgaccattcctttattttttgttcagagttgcaggttggtaacttgcccaaagtctcactgcttgtttaggcagaagaggtttctgttcccagtgctgttggaacctcagctcaccacctcttcaaagtcgtcaggaacattctcattttcctctaagatccctggctagacctttgcatcctgctcttccttctacttaagccagcatcctctcctgacccctctatccctgctgttaagatagccttcttggtgtcagggcctacagctgcctgcagccatcttgcttctgttttgaatttgtgttgctccaggaaggcctccagattggcatgctgctctcagaaggcacttggtatcacagtgtcctaggaacttgtctctactgctggggtgcacacacagatgctttagtcagtgctggagtgttggttacctggaaactgcatcctcagccttctttctcttcataatcctctacaggtggtccccaacctacaaaccagatgagttctaacagcttattttgcagttagttgattgtttggagttaggctgcatcttcctgaggattcagtgtcatgaatggtggttaggttctaggcccccaaccaacatctattccagagttcagctacaatagtagctgttgtatagctgaactctggagtcatgaagagaatggtctttggactcagacaggccttgatgacttctgattctgctctatctgggtgaccctgggcaagtgatttaaccactgagcctcagttgcttcacctgcaaaatggtgttaattaatacttacctggcggggttgctgaacagtgaatataaggtgtttaacatagtacttagcacttggtaaatgctcagtattatttattactgcactattacgtatctagtttgtttaatagcactaaatacctaattgtttatactgccctttcttcctttcctttcctttcttttctttctttctttcttacagagtcttacccaggctggagtgcagtggtgggatcttagctcactgcagcctccatctcctgggttcaagcaattctcatgcctcagcctcccgagtagctgggattacaggcgtgtgccaccacacccagctaatttttgtatttttagtagagatggggttttgccatgttggccaggctggtcttgaactcctggcctcaggtgatccacctgccttggcctcctaaaatgctgggattttaggcatgagccactgcacccagcctattgtgccatttctgtgggtaaactgactccaaggtcaaatgctacattagtcactcagaattgaaatagtgcttttttttttttttccttctggggatttcagattgctggggaaaaggagtctctctcgttcatttattcattcaattcataagcaattgcattatgccagatatactggggggaaaaggtgagcaaaagccaatatagcccctgttctcatggatgttacagatggatgatggagacaaatattaattaaaacaaaaatcatctaaatgtgaaaatacagctgctgtgaaggagaggtgatgggaaagggtctagggaggtgtttcctgggtatttgatggatctctggattggttctttgtcattgggtggcagacactgtcttcagctaagtggctcagagctttgacagcattgactttgcatacgaacaggggtggaggtggcttgagcctttgggggttggtagtagaagcagcagtccaagttgtctgagatgttggggacaccatcagggacacctaagtggcgggttaagggggaagcatttacaagagaggagtagctgggaagaggcattgctggggaggagaggaggcttcttgtctgtggatcagggatgctgggttctcaggtggtgcttattaaggagtgttttaacttggctaccccttgttttcagccaaaataacaccccagtccatatttcctgccactgtggcttcctatggctaaacaagcgtaatgaatatcttgttccatataattgcctccatctcatgcctcattttttggtactcatttcttgctctcaattcctttctgtttctctttttttctctcctattcggtttctcccgttctgctctgtgattaatcagttcggtttttcatccaattatcatgtctgtcttggagaagcatgtttcctggggaaggttggtctaccatggttgcccagctctctgcctgctccttcttccttctgtaagatggcagtttgctgtatttttagccctctagttctactctttggcttgtgggaaactgtccacagctcataaattatcaccacattgctcataatcacaccctaccttgtctagtcccctgagcttggagacttactgggcttctctttatgtacctgtgatgtgatgctgtgtgttcacgggcccagggagatgtttgccctgttcttcctggcagaagaagagcagtgttctgagacctgaccagcatgtgtgcccggtgacctattgaatgatgtgagtttctctgcgctggccgtccgacatgccagagctggcgggtgagtcgggagttggacatgcagccctggagtgaccacactgactgcgtcagtgggtttcactgcctggtgccttttttttttttgagacagagtcttgctctgtcgctcaggctggtgtgcagtggcgcaatctcggctcactgcaacctccgcctcccggattcaagcaattctccttcctgcctcagcctcctgagtaactgggattacaggcatgcgccaccacgcccggctaatttttgtatttttagtagagacggggtttcaccatgttggtcaggctggtctcaaattcctgaccttgtgatccacctgcctcggcctcccaaagtgctgacagtaaggcgtgagccaccgcgcctggcctcccttttcttgacattgctttaaaaaaaaccctttaattttagaatagctttagactgataaggaaattgcaaagatcatacagaaactacacccaatttcccctattatcaatatcatgcaattggtttgccataattaatgaaacatttttgataaattattattagctagagtccacactttatcccgattttcttagttttatttaatgtcctttttctgttgcctgatcccatccaggatactacatttagttgtcatgtcttggctgtgatgctttgagatattccttgtttttgatgaccttgacagttttgaagggtattggttgggtatttgctaggattggaatttgtctgatatttttctcatgattagactgcgattaggaagtcccattatggggcttctatgtgggaggaagaccacagagataaagcacccttctcatcaaaggacatatcaacatgatttatcactactgatattgatcttgataaagcatgtgcttggctcaatcagtgtctgccaggtttctccactgtgaagttattcttttccccctctttctatactctagcttctgtgaggaagtcactatgtgcagcccacacataagaagtgaggagttatgttccctgtcctctggggcaggttatctaaataaattatttggaattctgcatgggtgagttgtctgctcttccccatttatgtatttatttagttataagtgtggattcatggatatttattttatactttgagttatccaacactattttttgggccattgggagatcttttagttggctcctgtgtccctttgatataccttaatcattgtgggtaattttggttccttttttaagtacttgtttaatttctggcactgtaggatactccaggctcatcttgtatatttcctgccctagtcttagaagaataagccatttattcaaagaaccctgcttccttttattggagaacttgttggtattagagaccaagatctgggtgctaggtactcattgatactggagtactgttgtttctaggtgctctcagccaaaagagcaagaaaacatagatgtgtacactagcctgtgtatatagacatgtttataaatattcctatatgtaaccatctacaaatcaggtgaaacatgagttcatactgatgtctccactttcatcaattaaccacatgggtcattctaacctcctccccttgcatgtctataacttctcactccagcagtaagcagactcccaccacctggcatctatttacttaattgttcaattccactatacacatatagtggtttcggaatcgttaatgcattcctctatgggaaacaactttatcaactatagtaaaatacttatgtacagtacctttgcctttggtcttacagattccactcatttctggagttatttagttcagcatgtttttctatcacctccttctgtgaagttgtttcatataatttttaatgcagttagattctttttagtctgatgactcttgaaaagagataaatgagcaggaagataaagactcagccattagggaactaagttagaaaaagcttgtgaacaattcgttttctatctgctgaatgtttggtggctccatgctgctggatgatgatattgtactattttcccatccccttgcttttattcccatccatttgctatgggctgaatgtgtcctcacaaaattcatattagaggttaaaatcctaactcccaaggttacggtatttgaagatgggatctttgggaggtaattagggttagattaggtcatgaggatggggcccttaaaatgagattattggctttataagaagaggaagagtgagagagattatctgtgtgctcttaccaaggaaaggccgtgtgagaacatagcaagaagacagctacctgcaagccaggaagagagccctcaccaggaactgaattgactggcaccttggtcttggacttcttacctcaagaactgtgagaaatatatttctgttgtttaagccactcagtctgtggtattttgtcatagcagcccaagctgactgatacaccattatatatagaaaaagtatagacatccctgtgctgtggagaggctcttaaaccaaatttcctaattcgttttctacccttaaacaccgaaaggaaccctctttcctcctggcttaggagatcctgggcttaggagatctgttcaggtaatgttcttggtggtgcatttagatgtaagagctccaggttaagggtctgacaagacacttttggctaaaacaagcgttaggattgggagaatgtttctcagtggaaacagtataatcacctaactgaaggaaaaaatggcccctttccccaaatattctgagcctgctttagagcaggagagcccacttttacagcaggaaacaccctgagaaggaagtagagaatggtgacgtcagtggccctggatctgggtcccgtccctgctcttcagtatgcagagctgtcaggcgtcgtgtgctcctgtgtagagtgtcaggggtcgtgtgctcctgtgtggacagggacagcagcagggtcctgcctgagatcatgaatatggatgtgagtgattgttcccaggcctaagtgaaaggctttcttgaggcagatttttctctgggatgctgattgtgagtttttaatgtctcccctttcgttattcagtgttcttggcttctttagattgatcatcatgtcttctgcctacaaatatctgctcatattttacaagcagagaagtgactggagctgtaaccagcctagctgaccaaatgaagtccatgtggggccctgtcatttatatgggtgattaaaacaaaaacaaaaaacccttaaaccctgccagagggtaatttttcatggtctgccttttatgtttcttccttttttctcttcagtttttttctcctttccttgcagttattttttttttttcttttattgcctgtttcatttcacaacctggcactattctggtagaaatgtctgcttcctgccaccctcaggaagtcagagaacagggtaaatttgtccagggcttcaccccatgatttctaatggtgtgactcaaggctcccatgggagagatctacccaggaaaataaattgtgtgttggtttttaatacaagaaccttcataaactgagctcctaggagaaaatgaagacatttaaatactcttctctttttgcagtttgctctgtggtcatcagttaaccacccaaatggaagtgcatgtgttaatgttcaacagtgggttaatgtctggaggatggttttggacagcatagttcggagcaggttaatgtttaatgtaaaagtacttagatgagtacttggtacatagtaagagtgtttaagagttaattacattattattattattgcaaactaaaaattgctcccaggttgcatgttgtgagatagtaaggcgaaggtgaggcacctagtgtcagtattggctttaggtggaagaaaataaactggaattgctattgttgcattactggtgtaagaaaagtggtgatggacatggaaatagatcccagagcagaggtttgggcctgaaaatttggaactaggaagtttgaaagtgactcatctaagggaaggcaggggtgtgttagatggtccccaaaagcctttttgccttgagaatgtgattttatgtaagttcccctccacctggagtagtttgggggtagaaggtaggcatgaatggctatgggggttctgtagaggagagggagaagaagtgactctttttgtctggtttggattctcttatcaatgtttttgccggcattcccaggataaggaggtatttccatatgcttctgcaactggtttttgttaaacacagaccatacctcttcagctgatcgtgtcacacccttaggggctcagctgaactcagacaacaggcaacagccagaggaaggaaaaaagtaatagtccataaaattaggtaatggtcctgctcagaaatatttgagcataaataccaggttatatctttttatttgtacccccaacccccatggctgtaaacacatccctggagagaggaaataaatgtagcagatttcatactgggctgaaggggaagagtgtgggatgggtatctgttttatgagacagccttttttttaacgttaatttctgcatgattaacatcccttgaaagagttatttttcctccattcttttgttagcccattctggtccagcttccatgccttccactctgacatcaaagttcttgctaaggtcatgttccatctgcatcccgtcttgtgcaatgatgctccagtctttgcctgcttaatggtagcctttggcttacctgacccctccttccttcttgcatccccagcttctctgggcttctgggatgccaggctctccagatttcctcgcatccccctggtcgctccttctcagttgtctgtgtctgcttctcctcttttccctgtcttcttagtgttggcctgctagagcatagatcctcattctgaatgtgggaaaagcagatgatgattcattggatctcgggtggaatccacgattctgcatctctcatgtgctgccaggcgatgctgttgctgcggggctgcagagccaccgcagctcggtgctggagctccatcctcgcttctccatctatgtgacttcctagctgagctcctccagtccccggctttaagtcacacctcgaatcttattggtgacttctcgccccacttgggtcaaaacccagagttatattcaggcccacgacaccctgtgggtttggctcctgcccactcctctgcccttagctgctctgccctccgcgtctcccactgggctctggccaagtctgccttcccactgattcttcgatttgtctagcacgtttctccttcctgagctctaaacttgttgttctctctacctggcactcacacggcttagatctcatcttctctttcaaagcaaatattcccttcccagcgagggcttccttaactgtctatctagaatggaccttcactaccaccaccatcacctcgctgtcacctaccccagttcattttcttaccatgctatgtgagtttcttattcatcctcactctccctaccagagtgtgggttctgtgggaaaaaggaccttgtctccccatctaactgctgtagaagagtgactagcatagtaataggatcttggtaagaacttgttagtaattacataaagcattagtatcagcatgtcccagatgagctgatgagcacagatactaccacgccattccagtgtctgtgtttttaatggtttgggtatcgggttatattattgtaagtatcatgaactagtggaaagaaccaagatggacagaacacataaacgatgcccttacaccccatgaagacccaacagttttatggcaaactagagaaatgaaggtttcatagttgtttgaataaaaaaaggtggtagaaaattgaggcatctcattgtacaaggtaggtaacatctgtgcaatgaaatcatgacttgcactattgaagtccctgttcacaccatataaggtgatacagtttcagcaaaatgatcatcctacatattaatgttgtgaattggaattatattggctttgtaattgcatttgtatttaatgtgcagatgttttggtattgatggtaatataagaactataatcgttttatatttgtacattttatgagaaacattaagtgaacactaagaatcgttgagatttttttttctttagaggcatctttacattatacaggcttgtgaaagactaaaataggaactaagcaagattgaaggtgtggctgaggacagggaaaggaaaaagttttaaattccaaaactgcttgtaggaagctatttttaacaaaataagaataataggctgggcgtggtggctcgtgcttatagtcccacctacttgggagcctgaggcaggaggatcccttgagcccaggagttggaggttgcagtgagctatgatctcaccagtgcattcccacctgggtgatggagcaataccctgtctcaaaaataaaaataagaaaaaaataaaaagacgctgagtgggctatcaaattttagcatgctttcaagagagtgaaattttaaaatatctacattcaggccaggtgcactggctcacgccttgtaatctcagcactttgggaggccaaggtgggcggatcacttgaggtcaggagtttgagatcagcctggccaacatggtgaaaccatctctactaaaaatacaaaaattagccaggcatggtggcatgtgcctgtagtcccagctacttgggaggctgaggtgggagaatcgcttgaacctgggagatagagattgcaatgagctgaggctgtgccactgcactctagcctgggtgacagagcaagagcctgtctcaaaaaaaaaaaaaaaaaaatccgcattcatatgaatacacaagttgtactgacaaaccctaaaaggttaaaatatattatcctttttttgtttatataattaaaacttcaattttggattaccagtctaatttctggttattgaaaaatgtaaattgtgaaacttttcttgctggagacatctatatattataaaatatttaaatataaaaataatggagtaatggagtagatggcctttactcaccaattctagggcctggcttaggaaggtatgtaggcagggacccccctcccccgccacaattctaacttgtgccccaggccctcctcctttcttctggctcctggagatcagagaggaagggattctgcacttaagaaatggcgctaagaagaagaagacacattctttttttttttgagacagggtcttgctctgtcacccagactggagtacaggggcatgatctcggctcactgcaacctctgcctcccaggttcaagggattctcctgcctcagcctcctgagtagctgggattacaggtgcacactgctatgcctggctaatttttgtatttttagtagagacagggtttcaccatgttgaacaggctggtcttgaactcctgacctcaagtgatccacctgcctaggcctcccaaagcgctgggattacaggcatgagccaccacaccaggccacattttttttttttttttaaagacaggttctctctctgttgcccaggctggattatagtagtgcaatcatggctcactgcagcctcaacctcccaggctcaggtgatcctcccacctcagcttcctgaatagctgagactacaggcatgtgtctccatgcttggctattttttttttttttttttgtattttttgtagagacaaggttttgccatgttgcccaggctggtcttgaactcctggggtaaagtgatccgcctgcctcagcctcccaaagtgttgggattacagggatgagatacagctactggccaggagacacattcatgctttgaaaggagacatgaatggtccttctccctcacacatttcctttgagtgtatgtgtttgtttctacccagttcatttccacatataatttgaggctaacagagccatctatatagatctgtgatgccagggagcctggggcagaagatgaaggctggaatggggtgagggtgctttaggaaggagagagggagctaagggccacagcactgcttgcagtgtctaaatgaatggccgttctgcaagtacctgaggggctggtgagagcaaggcacagcgtgtttggggtgactttaggatttgggtttgggtagtcccccttcccctgctgcccatctgagagaattctggggaggaaggtcttactggggcatgaggtccctggtgtcatcaactttgcaggtaacagctgtcttgaacaacaacagagaacctgaatttatacatgtagcaagctgctaggtttctaaaaatatttcagaaggtttattttgattttatttttaaacattttgggtgcctacacagtgttatcttccatgtttttaatagccacactatacaatacagagtaggtttctgtggacaaatacaggtgcctatcatttatagcacagtctctctgggacccgtgcaaacaactgactcatgcgtttatgagactgggttggtttgtgaatcgatgacgcccagggagctgggaaggctgcatggcatggacgcttccccagtggctctggattttgcaatcatttggctaaatttgctcatgatgcacattccctcacccctttccctgatgaggacaaagatggctaattttccctgattggatctgttgttttgagtgaccgagaagaaagagatactttgctgaaagcacaacatattccgagggagaatactgagctttggaattcactttgcagacatctgcgaggatgttccgggagccaggcttgttatagctggcattgctggaattccacacccccccatgcctcccttaagagatacttgataaccccagggcctaatttctacttttggaacatacataccttgtgaagtggaggctggaggtgggaaggaaagcccccttgaggctgtggatctggttctcatgttttaaacagttttaaatattggggctggagatgcctgaaggatgggtatttgttatggaaaaccttgacttttttttttttcttttacattgttcacattttaaaacaaagttcagagagctgtgtacattgagcatgctttattagttcattcatttatgtgtgaaacactgttctggatgccagaaatgtggcaaggaggaaggcctggccgaggagtgacacttccactgagctctgacagatgagagcttgtcttggtggcacaccagtgccgcgggacatggtgacatgctgtggtccacagccctccagtgaccatgtgagcataattaaatacaaactgtgggaggcagaaaagtgaaaatgtggtctctgctcaagaaagagtgcaggtcttagagacaaagtctgggtctaaatcttggtgctgcccctggcccaggtgtaaggcctcagaggaaattacctgccagagtttacacatctctaaagtggagagaagaggtgctgtgaggatctcatcagacaagatggtacaaagaaatcaccggggctggcctcgtggagggatgatgtgtgtgtctgactcagaatcagtagaaaaagcttaaaatgtggttgctgggacaaaactaatctaccagagaagccgtggctggagagcctgtgttgagctgtgtggtgctggtctgtgctggaatgccaaggaagaggcaggagctgcctccagtaggtgagcctcgaagaaagaacaggattttcataggtgaagggagacagatttttactggaggaaaaaaaaatgtctaaagtaaaggtcataaaaacagactgtgggccgggcgtagtggctcatgcctgtattcccagcacttttggaggccgaggtgggtggatcatgaggtcaggagatcgagaccatcctggccaacatggtgaaaccctgtctgtactaaaaatacaaaaattagctgggtgtggcgacatgtgcctgtaatcccagctactccggaggctgaggcaggagaattgcttgaacccaggaggcagaggttgcagtgagccgagattgcgccactgcactccagcctggcgacagaactaggctccatctcaaaacaacaacagcaataaaaaaaaaaaaagtgcagctgcacagtttaagaacagaagcttcttttgttgggtacttgcaaaaatattcccttcctcttggtagcgtggtctaatggtattaatgccaacagtgtgaacctgagcataaggtatgccctgagtttgagtagcttttcagtgctgagttgactacacaattaccagtgacaacactgagaaatctaagaagactccacttgacttggggggtgggtaatttatttcttggacattttggcttcagtgtaggtttaggtaagtatcatatgtcagggatggcaagtgcattttattttgtgtctgcactaaccaaccaattggtagtgactgcaggggtgcagtgatgaggaggattctgaagccagatttgcgcttagagagaaaacgataataaccctttattgatataatttggacttaggcttcgtagaggaaactgtagcacaaacggtgtggatctgttatctctggttgggaggttttctatgtacatgacagtatgaagatgttcatttattcacccaacaaatatttattaaatctccgctatggacatagcattgtactttagattcttagccctctggcttcttcattagttaataaattatttcaggatattggtggttaatgctgcttggttaattagtgggggtttttagtctttttctcataagtgtttcaaaacattttatgaacaaagccagctttcttgtgcccataaatgctacattgaaatctttctcagatccctcttattttttgagacagggtctctcagtctatcacccaggctggcatggggtggcatgatcatagctccctgcagccttgacctctctgggctcagctgatcctcctatctcagccgcctgagtagctgggactacaggtgcgcaccaccacactcagctaatttttgtatttttcatagagatggggtctccctgtgttgcccaggctggtctgagactcttgggctcaagtgacccacctgcctcagcctcccaaagtgctggggtgactggcgtgagccactgcccggctgatcttcgtcatttcatttagcatacaatatgtgattttcctaattactttatgaagtcatcactgacagtctgactttagagacaggaaaacagagaaattaaagaacttctccagagccaatattggacttgagccgcatgtcagaaatatttcctgcttctgcatctcggagtcaggtgccattacttgtcttcagaaccttaaactttcgtagcttagctctgccctggtaggagaaactttcagaaatcattttaagcctcaagaggtgaaaaggatgaatgacttatctaacactttttttgggacatgaattctgtatttttttcagtaaccatgaagaatataaaatacgaaccactgaatttattaaagtaatacaaattaaaaagtaaaagttaaattgataacatatggacaccgtaaattaagtggtgatatatgtgctaatcagttaagagaagtgggcaagggaagtgggacccatccacagggaaacgaggcgggtagacttccagggggaagtgggggcttcttgggggagagccacttggtgcccatgctctcagggccaggccatgtggatcagatgagttgagtcccagtgactccacattttcttttttgagatggagtctcactctgttgcccaggctggagtgcagtggtgcaatcttggctcactgcaacctccacccccagggttcaagtgattctccctgcctcagcctcccaagtagctgggattataggtgaccgccaccatggccggctcatgttttatatttttagtaaagatgggattttgctatgttggccaggctggtatcgaattcctggccgcaggtgatcaacctgcctcagcctcccaaagtgctgggattacaggcgtgagccagtgcgcctggccaactccagattttcagactcctggttgattctcctaggtctccaaccctagtaaaaggagcctttttacaggcttttcttttttgccatcttcctttttgtacaaggtgggtttagggggaagctgtagcactcaatgttataagtttattttttccccccaaatagaaaagttttagttgtcaggttcatttgaagacattcgaaccatcctgaactgtgtgaaacagagagcaactctgctttcatttccaaacctcaagtttatttttgaaattgttttcccagggagttctgaagggttgactgtatacaaagacacttcctttaaaatctgaagagtttggtcagtttcctacatttgcactacaaaacacgtagagagaaaacataaagctcagtttaggtaaggctgcctctttctgtcatgttagggaatacattgaaactaatatgtgttttgctaatcttggctttccacaccctgatctttcaatttcatctggttgaggttctagtgtgaatatccccatacaaaattctgtcttcccactagttccacagacacatcctttaggagtaaatgtgttaaccactgtttagcaagcttgtccaacctgcggcccgtgggctgcctgtggcccaggatggctttgaatgcgcccaaagcaaattcgtaaacattcttaaaacattttgagttttttttgtaattttttttttaaacctcatcagctatcattagtgttagtgcattttatgtgtggcccaagacaattggtcttcttccaatgtggcccagggaagccaaaagattggccaccccggatttagaggttttagctcatgtttatcatcagcctggtagtatcttctctttaaatgaggcagtcacaggatcccactcaggggaaattactttttggttggtgggtcaattcttatttcctagaattaagctcaagactgcactgagactcatcacctctctacccactgtattagatgctcttttaagtgatttgtatggtaaaatagaattacttgttcaaagcaaacatacctagagtctctgccccatgctaggtactatgccgattgcttgggccagcctggcttgactgatggggactcttgtccttggaggcaagggccagccacagcataaaggtgaaggtttcagattgcctggttgcatttcctccgtagccacagggcccctggaatggctggtgaatatgcatgcaggtcctggaggtgccactgagaattagagttgtggggcggggatgtgtggaccagcattacgtgactaatctccatgctcagctgataacatgtgatggcccagagagaggaaatgtttctatctggcatatgttcatagttcttccaagagctaagccctttgttcttacaaacacactcgctgatctcgctaactaaagcaattatcatcatttagcagtcttttcataaagtattatttccactccaaaacaccacttttatttgccaagtgccacaatgttgcatcctggcgattgatcagcgtttactgccaaattatgtaagcctttggttaggcttagtccccgacggcgcaagcgtgtctgtggtgtgcattaggattgtaaacgtggcccagtgcctggaagtggagaacagctgtccctaaattcattaattaattcagtgtttacactttgattgggaaggaaatccacatttgcttaagacaccagtgcccagctgagaaatgttgttccatgaaattattggattgaggtttgttgtcaaggaaatgtaaattgtggatgtttcatgaaatttaaatatgtggattaattgaccaacagggagctaagattgtaataagccaaggtggctttattcaaagattgaaatgtaattagtgttgactgtagtaggaatagctatttgaatggaccataaatcctgcacaagaattttactaataaaagaggaaatattttcattgaaaagtcagtgtcagcataagaactgatttttcttacaacacttattggtgagtagaataaccccatttagtaaataccacacacaaaaaatttcttctgtttaaaaagattattagaaactttaacaaatatgaagacttctagagatgcagaataaaatatgccaatgctgctcagaaaaaaggggttaagacacacctggttattttggtgtcagccctcacgcatcacttcattagtctaaggcaagctcgctgtacttgtccttagtattgagttgttttatgatattagtagccttgtcaaaccagataagtttagaagttcttctccttttcaaaattccactcaaatggtagtaaggggagaaaaaatgtttaaacctgcaagaggcaaaaaatggcagtggaggctttggtggcaactcctgcaatgatgcaggggtgatccccgggctggctgagggttagacccctccacccaaagtgcccacattgctgaaatgaggtgctttgcctgcagaaccacagagaggctcagaagtgggaaggcattgttaccatagtaggccagagagattggccaaatatagggagttattaaaaccagcataattagaccctacaccctgtccctgtctcccttccccaccccagcagcagcctggaggtctgttctctggagaaatggaactggaatggtgttggggtgttggtgggggtgactaaaaagagagactgatgacagctgggagcttggtcactcttctgctctgtccatgatggcagcagccaggcgtgtgcagccccagcaatgaagtggaagactttccttgagaaattgaacaactccagaaaaaaatgcccccagataactgaaatgtatgggttcttcagtggaatacttttttctttcacattaattgacactcaccaactaatagtcttctccacacttgcagagccaccaatctgctttggtccttcattcttaaataggatcaggcagtcagggttcatcaggtgtattaccaaagccttcaatatgaaaagtaggggccaaaacaggaaaagaacaaccttgcagaagatggtgttgttgcagaaagcagagaaaacgtgtttttagaagaaagttacagttttccttgcagagagaagttatttcatatccaaaataataataacatttatgaaagaggagcaattagagaacaagaaagagctattgagtattacaaattaaatactggaatttaaaaaatgttgaagttgtatctctgaaaagtagagtaaaaaagatggagttaaaaagcaggagagaaaagaaatatgaaaaattaaaatgtgatctaaaaaattcaacattgctattatagtagatgcagaaaccaagaacaaaataaaatagtaatctgaacattatcacagaaagaatgcaaaaatattttatagaactaaagacatgaatttccaaattgaaagaatatatatattatgtgctcatgttttataaaagagtccactttccccaattttataaaacccacccctgggtatgccattatgaaatttcagaataccagtgataaaaggtcctaaaagctttaaggggaacgtaaacaggtcacacacaaaggaaagggtacaatgagcttcagaattcttaaaaacatccttggaagctagaagataatgaagtttgcaaagctttaaaaaatacgatggaaattatttctaacctggcttctatgtccagctagaccaccaatcaaaagtaagcatagaataaagacatttttcaaaatacaaggagtcaaattttttttccataggactttttcttagaaaactactggaagtgtcttctatcagaccaattgggtaaactaacaaagaggaagacatgaaacccagaaaataatataacacaaaaggaagagagcaatgagaccctaatatagggtaggaggagggaagactgtaaaaaagaggtcaccaaattacctgatattttgatcatttggaaattaataccgataagcatctcacagatgtaatgtagttgagggaaagatttaaggataggtgtatagaaaagacaagtaaaacagtaatcgatcattaacgctagaaaagtaaaaattttataagaaaagttctgtaagaccatagtatataattttttagtgaatatttatattgtcataataatgtaaatagttgactcttgattttattattggtaggttagccaagtgagagacttgtatgtatggtgtggtatccaccctatgtagaaccaataagttaaggaatcacagtcaggaatattgtttagcaaaagggaggtaagtattagaagaaatagctgaaatttgcaggtttttttgtttttttttttttcctcctgggcagtgtgttcaggatcagggaagggaagctgaagaatgtaggttttcacttattttactttgattaaaaaataaattatttaaaaatactagtataactgaaaatgaaagttgacaatgaaatatttggaattggtgagataatgataaatattacagatgaatgtacctctctgagttgttcctatctttaaagtggtaaatgatagtagctaaaatgtttgagatttaaaagaattatcaccaagcaaaactgacaacactatgctactggtaggaaactgaatatattcagaaagccccaagacagaacagagagacaaaacaagtaaagatgtgctagagccaaacaacataattattaaggttgtacagatggatagattttgaatgttatcccttaaaatggagactacacctagtacctgtgaagcattgacaaacattatccgtatatttgctcacagagggaagctcaatatatttaaaaaggaagaaatggtagagacttcattttctgaccacaatacaggtagagattagcaacatttacaaataaagaccctccaaacaaaaacagcacagcaacaaaatactacatatgcaacaactttctcagaatcaaatcttgggtcaaagcagaaatcaaaaccccaaagagaaactatctagaaaatagtaatagaaacattactgtggtggaaactgtttactgcctttctaaagtccattctcctctctctttttactaacagaacattgattttgttgcatgttgatgaccagcttaagtaccctattttccagtctcccttgcggctgggggtggccatatgattaagttctcactaataagatataagggattattgttaggtggggattccaggaaagctatttaaaaagaaggttgagtcacttggcctaagcttttgggctatgtgatgctggatcagctatcttgtaatcataatcataagctatctttaatcacatgttaaagacagatgagtggaaagatagaaggggtgctccttatcccagggtctctttcagtcctagacttcctatctctggggaaaagttcctgtcttaagctgctatgtggggagtctattagtaggaactgacataatttttaagtgacatagttacaaaccacaatttatgtgattaaagaatgaaaataaacaagtaaagcgtccaagtcaaggagtcagaaatagaacaacaaaataaaacaaaggaaagtggaaggaaataataaaaatcaaactagaactcagtaaagttgaaaattaaagaaaaaaatgcttgataaatccaggagctagttctttagggaaacaatttaaaaaaatacatacacatatatattctaccagtgtaatcaagaaatagaagaaaacacaacattagataataaatgatttatcctacccaaattctgcaaataaatttgaaaattggatggaatagatgattttcttggaaaatgtgctagtagattgactctagaatagaaagaaaactcaaaaagtctctcaaaagtggaaaaaaaaaaagacaactgttatttgtgaccagttgctactgttcttcctggagtccctttgccattgctgttttgcaaagtgttagaagtgaatttctggtgaggaacctcggagtgtgaggcagggtgagcatcctgcttggtgagctctctgcagtcatctggcaaggttggccacacaccagaaaggcaacggcaactattcttggcatcaggacccatcacaaaacacagagccctgagtgttcttcattttttaaataatattttccagatcaatatgctattgaacttttttgctaagaagaaaagattgaaaatgatttataatcatttaatttcactgtcagtctcacaaacaactgattccttatggtaaaagtgttggaaacattatattcaaatagtagtgttaaagattttgcagcaagattgtgggtaaaaaaggctgaaagtgttttgagaggaaaatgaactgcagagtaacaaagaaaaatggtgagcgtcagaattccttagctcttaattattttcatggaaaagtacctagttctcaaatgctggtaactggaacatcctattggttaaaaataaacagcataaagtttcaggaaaccaactaaacagcaaaaaaaaaaaaaaaaaaaaaaaaaaaaaaggcaaccagaacagcccaaaacagaataacaaagtcagaataatgaagctacgccaaaagtgtcaggtcattacacgggttgtctgccctcaggccagggttcaaacccagtggtgacaaactcagtggccacgtgggctgaagggcatccagaaagtcctgctgggtcaccagagggctgcccttcagcacttggttctgaggtgtctttgctgtttaaaatgtcttgttttctttgaactttgaagtttccccttcctaattatttcagtcttcatttaaacagatgtaattctaacctaatgtcctctttttaccccatctctccctggtagctggaacagtgaaccatggagctgtatttcggtgaatatcaacatgtgcagcaggaatatggggtccatctgagactcgcaagtgatgatacccaaaaatcaaggagttcccagaactccaaggcaggctcctacggtgtcagtattcgggtccagggaattgatggtcacccctatattgtcctgaataacacagaacggtgcctagcaggcacatcgttttctgaaaatgggccaccctttccacctccagtgataaataacctgcctctacattccagcaatggttctgtgccaaaggagaacagtgaagaacttcagcttccagaaaacccatacgcccagcctagcccaataagaaacctgaaacagcccctgctccatgagggcaagaatggagttctagatcgcaaagacgggtctgtgaagccatctcacctgctgaactttcagaggcatccagagcttttgcaaccctatgaccctgaaaagaatgagttgaatttacaaaatcaccagccttctgagagtaattggctaaaaacgttgacagaagaaggcatcaacaataagaagccttggacttgctttcccaaacctagcaattcccagcctaccagtccctccttggaagacccggccaaatctggtgtgacagctattcgtttatgcagctccgtggtcatagaggaccccaaaaagcagacctcagtgtgtgtaaacgttcagagctgcaccaaggagagggtgggagaggaggcccttttcactagcgggaggcccctgactgcccacagcccacatgcccaccctgaaaccaagaaaaccaggccagatgttcttcccttccggcgacaggattcagcgggacccgtcctggatggagctcggtcccggaggtcctcctcgtcatccacaactcccacgtcagccaactctttgtacaggtttttactggatgatcaggaatgtgccatccatgccgacaacgtcaatcgtcatgaaaacagaaggtatattcccttcctgccaggaactggacgggatattgatacaggatcaattcctggtgtggatcagttaattgaaaaatttgatcaaaaacctgggcttcagagaagaggaaggtctgggaagcgaaacagaattaatacagatgacaggaaaagatccagaagcgtggatagcgcctttccttttggcctccaagggaactcggagtacctgattgaattcagtaggaacttgggcaagtcaagcgaacacctcctccggccttcccaggtgtgcccgcagcggccactgtctcaggagcgccgtgggaaacagagcgtgggccgcacctttgcaaagctgcagggagcagcgcacggggcttcatgtgcccactccaggcctccccagccgaacatagatgggaaagttctggaaaccgaaggtagtcaggaaagtacagtgatccgtgcgccctcccttggtgcacagagtaaaaaggaggaggaggtgaaaacagccaccgctacgctgatgttacagaaccgggcaacagcaacttcgcctgattctggtgccaagaaaatttccgtgaagacatttccttcggcctcaaatactcaggtaacactagtgcgattcctgtttggttttttttctcttccttctaaataatgtaatgatgtacttatgctgcaggaggccataggaattacacatcctcaatcttgtatcaggaatcacacagctgatctgtttcaggatccagttgtgtcctactgacgatgtcctactgccaattgtatagttttctgggttctttgaagttcagctggattcccattgtgatctctctgtaaagtaacttggcagacgctacagagaggctcaattgttctgtttgtgtatgcatgaaatctgaaagtatgcagaatttgtttctacacagaggctgaatagttaggtttgtgtaggtatattaattttcctcataaaattgagtgactgggttaatttctagcctgaaaaattaggttaattttcatttaggttaattgtcaagtgagaatctaagtggcacatttagtgttttgatagtaacaataaaaaataatgatattgataaaatggtaaaaaaaaaaaaaaagtagctaagtgctaggcactgtttgttatatattacaggattgcaccaaccctgtgcaggtagtacctattaacctcaatttacaggtgagaaaattgaggcgaggagaagttaagtaacttccccaagattatgaagctggtaaatgttgtaactggctctaagaaggatgctcactggaggaattgtttggtgtttggaagcctctgggaacttcatcctcatggtctaacaacaggccttatgttccaggccacaccggatctcttaaagggccagcaagagctcactcagcaaaccaatgaggagacagctaagcagattctctacaattacctcaaagaagggttagtgattttccctctgaaagagcaaagtattgttgtttctggtgggactcttaatttccttttccgaggctttaatggttaccttcctttcttgccctgtgccagccgttggagggttaaaactcaatggctggggttttcgtgacggcatttgtcttgtgtggtatggggtgggggctttgggaggggtgtgtaggaaaggacaccatactttaaaaattaaaatgaatacatttttaaagtgaccctttactatttcaaaagcaaattcaaagataggaggagtttctactcttcaggtttgaatggagtccgccatcaccttgagttcttccgtgcaatgtggtagtcctttagaagttacaaataaaaacacctcccctccccagagttaacattggccaagagcccctgcttccattatttttaaagcatgtgtgagtcatttaaaagcagtgctttccatgcttatcttggtggttgaggtggaataatcagggtttcagcccttacttagatactaactgtgctggaacttgagcaaggaatttgaggtttctgtttcagttctctcaacagatgtgattaagaggaaggacaaaaaaaaaaaaaaaagctttacagcctacatgactgaaaaccagccacttggcaaatcctcattggtatcaaaatactgtatatttttgtattgtgccttacaattatttgtcagttttagagctaacaacatagtaaggctcaaaatataaaacaggggatcttttgaaagggggaaaaaaaaagtaacctgaaagattaatctagctaagaactggttattagtatctccctgtggaagactttaccatgttaagattaaggtagaagaaatcttgacttttaaaattcattattttttttttattttttgggacagagtctcactctgtcatccaggctggaatgcggtggcatgatcttggctcactgcaacccccacctcccaggttcaagagattctcctgcctcagccacctgagtagctgggattataggtgtgcgccaccatgtctggctaatttttgtatttttagtagagacacagtttcatcatattggcaaggataatctcaaactcctgacctcaagtgatccaccagcatctgcctcccaaagtgctgagatgacagacgtgagccaccgcacctggccaaaattcattaaattcttttatgtatgtattttttggcacatgatttattgagacattggtaagacagactttagtgggaggtgcctgttgaaggaagtttattttaaatctttttcttctaattgctgacggtgtggtagaagttaataaaacttagtatctccgtgttacctgtgaaagcccagacaaagggctgccatgctgataatcttggcttaggggttttatttttttaaacataggttaaacaaattaagatcattgtagatcattcttagtgtaagattcagatgtacagcatgtttgtgtgtgtgagagagatatacacatacgcacttcaaagaaaaggagaattctttttggaatggacatgagcatttgaatcaaacaacaaattactaaatgttcactgggtgtcttctccaagcttactgaggatgtgtttatgtgcctctcacatatttgcaagtgggaaccctgtcccaaattgagtggtaacacatcatttatttgaaaaaaaaaaaaaaaaaaaaagacaccatccatcctactctcacactgattttgtctgaggctttaattaattcacagctcctgcaaattatctccttaaaggacctgttgggtgtgtgtcatgacatataaattgttctgagaccagtggttgtgtccctcattgttttctctgctgtccctttttcagaagcactgataatgacgatgctactaaaaggaaagtcaacttggtctttgagaaaatccagaccttaaagtctcgagcagctgggagcgcccaaggaaataaccaagtaaatggaagttttgtattttgtagagtgcatttagcatggaatgtggtaaacaacttgctgtttcttcagtctgtatgtttgtttatagcagtaagtgggaagttgcctgagtagtgaggagtactcttcatgttttacatgttgcagcaacattttattgagacagagtctctgtcaccctggctggagtgtagtggtatgatcttggctcactgcaacctctgcctcctgagctcaagccatcctcctacctcagcctcccaagcagctggaactacaggcatgtgccaccacacccggctaatttttgtgtttttagtagggtgagggtttcaccatgttgctcaggctggtctcgaacgtctgggctcaagcaatccactcacgttggcctcccaaagtgctaggattacaggcgtaagccaccatgcttggcctttcccagccttttttccagaaaagtttaaagatattttatttaaaaatacatagactataacaggatgatacaaacagatggcgagatttagaagaggaaaataagaataggaagactagcattgtcataggcaaacatggaaggtaagtgtgaacaggcttggacccaagctctggagcttcaggtgtgaaagagaatgggactagagactggtgacactgatcagctgtggtgcaggggacaggaaagagcccagtggtgccaagttagtttttaaataactgcctgtctgattgattgtgctgaatttgagtggggacatagagatttttttggttaaggaaggagccctctcacatttgataaacaactactctatgtcagacacacctggtgccctggaaggaagccactcgtaagagagtacggctaaacactcgttcctcaatcttccaccgccttgtgtggaactcatttcttgcttgtccatcttcctttcccctcccaggggagttctgcatgggaaggaaagaggaagacacctggaggcaggtaacaggaaacttgtctgtagcttctttctaacttgggaagcgtacatacaggggataattttaggcgtcaacctaccatctttactacttgttattcccccagcactcagctaacccatgactgctgctgtggcctcaaatagaacaatgccgtacacacacatacgcaattcccactggggaatctttacaccatagtccttgcgtattacaccatagtccttgcatatacatagccttgaggagctctacatagttcttaaagtcagtccagtatttgtttgctaaaactctgaagtccaaattatcaacacgattcttgtttttttgtatacctgcatacaggctatgcagggagtgcgggttggaatctcaccggctgttacagagcaatataaagggtcttgaacacaggggctttgggtataacttagctaacagatgagtcttcaacaaatatcctttttatattgttttattggggtataacttatataaagtaaattacacaaattgtatctgtacagttcattgaatttttaacatagttttgcatccatgcaaatctcaaccagatcaagatgcagaacactcccatcacccaggtttcctgggtttcttcccccatcagttacaccccattcttctggaggtaatcatatcctgacttctatcacctagagtcgttttgcctttcttgacttttatataaattttcacaatatgtattcttgtgtgtgtagctgcatttcctcaacattatatcatcaagattcattagtgttgcatgtactcgtagttttttttggtatcgaaatgtaattttccattgtatctgtataacatagtgtgtattcttggtgtacatttctggtttggggctattaggaataaagctactgtgaacattattgtacttgtttggggaggggagtaaacacattcactcatttctcttgagaatatacctagaagtaaaattgctgagttgtgagttaggcatgtgtttaactcgtaaattatacctgtttgttcttagagtgagcgcagtctttggccttgatgttgagattgtccttgtgggtcacagactaggggtgaacagcctgaactgggtaagtcagggtagcccttctagggacagtgacactaatggtgccccaagagatcatagaattatttgtgagaagaagggaagctggggtgttctaagttaagtgactagcacagacaaatataaagaggcatgggttgccatgttagagggaatttagtgtagtgggaacacagagccaggatgggctgaggaagagcctggtagcaaggacattggaagttggaagttatgtaagaagtttccatttcgggctgggaaggggatgggttaccattgttggattttaaacagatgtgaataccattgtgtttgtgaaagtttattccttttgtggcttttggaaagaggtaagattagaggaagagagaccaatgaaaagctaatgcctgtctaggtgtggtccctcacacctgtaaccccggcactttgggaggctgtggagggagggtttcttgaggccaagagtttgagaccagcctgggcaatgtagtgagaccctgtctctagaaaaattaaaaaattagccaggcgaggtggcacatgcctgtagccccagctactcaggaagctgaggcagaagtcacttgagaccaggaggtggaggctgcagtgagctatgattgtgccactgtactccagcctgggtgacagaatgagtcattgtctcttaaaaacaacaacaaaagaagctgccaaatcaagagatgatgagaaaatgaaccaagacttttagacttcaggttcctattacagctccatgactgtttaattgccacgttttcctactcctcttccctccctcttaggtttggaatctgattacttgctggcaaaggttttagagttttatctttgcggtgtcacttaagtgattaggagagaatgtaagaaccctctcccttagggacggagaccatactggaaaacagcaaagcaggtagagattttgtatgggaaagaacaatgtataatttccctcactgggttggatttctgtttctaaaatggattgttattttgcctaagaaaattggaagttgtgtgtttgtgtttctaatcatcttcacaggagtaggtagggaagtacctcattccaagtttatcacacacaacttgcacctggattcagggatgtgtgagccaagatgccgccgtttctagctttgattcctacttttatttcttcccctcagctatttgtagttttctaaccactttactgtaggattttagccaaatccttttgagagaatcatcatgttattttcatggaagaagaagaagaaaaaaagatccattaatattcatactcagatcagagagataatattttgtaatagactctcttcaatcagatccctcttcattatggaaatgtaacatctaaaaggagaaagccaatttagctaacatacacttatttactacttgcatacaggctatgcagagagggatggaatctcactggcggtgactcagcaataatctctagtgtaatgtagattacactgtaacaaatatatgtataaagggtcttgggaacacagaggcaggggctttgggtataacttagcaaacagataagtcttcaacaaatatctgtttttatattgttttattggggtataacttatataaagtaaattacacaaattccatctatacagttcattgaatttttaacataggtttgcttccatgcaaataccatctagatcaagatatagaacactcccatcacccaggtttcctgggtttcctgtgttccttccccataaattgtcccccttccttctgggggtgatcatatcgtgacttctatcacctagagtagttttgcctttcttgaattttacatacataaaattttacaatatgtattataataagtattctcgtgtgtccggcttcatttcctcaacattatatcagcaggattcattaatgttgcatatactggtagctattttgtattgaaatgtagttttctgttgtaatcagtcaacatagtgtatactcttagtggtcatttctggtatttagctgctaggtgtaatgccaaactgaacattactttttttttttttttttttgtaaacacactcactcatttctcttgagaatatatctgagagtataatttgtgggttgtaaattaggtgtacttttaactgttaaatgttcccaaatgattttacacagtgattgaaacaatttacactcctggtagtgcagcatgccagttccagtggctatatatcctctgtaatacttagactcttttccattactttggtctacttgtctctccttacactactatcgtacggtttaaatactgccactttagtaagccttcagatctggtagctttattcttctccgagattatcttagctattctaggtcttttgcctttccatataaacttttatcagcttgtcagcttccaccaagaaaagcctctaggaattttgattgggattataccaaatgcatagataaatttggtggaactgacgtcttaatattattggtgttcttatttgtgaacatgaactttgtccccacttatttatgtcttagcatctctcagcagcgttccgtcatttttgttagagaggtctcgcacatctttcatttagatgtagtccctttccagtgctgttcattcctttctgtacttctgtgtttccatctcggactggtttccttcagcctggagaactattttttgaatatcctctagtacttttcgtgggcattgtttgagaatagctgtcattcactctcagttttcaggaactctagtgtggcaagtattgttttgcttcatgaatttaaagacgttattcgtcttttgacctcagttggctccattggaaagccagccatcattcttagtgttattctcttgaaagtgatgtgtcttttccctctgggtgcttttaataatttatctttattgtcaattgttagattttgactatgacgtgcctaagagtggtttttcttttatttatttttcttggggttcaatgagctctcgacttgataggttcatcagatttgaaaaattcttggctattatttatttgaatattgcttctttcacattcggtctctcccagctcttctcagactccaattacatgtatcttagaaattttgatggtgttcctcatatctcttgtgctctattctctctcttttcgtgtgtgtgtgtgtgtgtgtgtgtgtgtgtgtgtgtgtgtatgttgtatgtttggggcatcagatattctggatattttctattgacctttcaaattcattagtcttgttttctggctacgtcaatcttactttaagactttctcttttaagatgtctttaaaagaatgtttttcttcatccttcatttaaaggatggttcttttaagaacttttctttggccaggtgcagtggttcatgcctgtaatcctgggagtttgggaggccgaggtgggaggattgtttgaggccaggagtttgagaccagcctgagcaacatagtgagatcccatctctacaaaaaccatatttaaaaattgccaggcatggtggctcatgcttgtagtcataactgctcaggaggctgaggtaggaggatcacttgagcttagaagtttgagattacagtgagctgtgatccagtgagttcttaactttcagatattgtgtactgctgttttagagtgtctacttggttatatttttatagaatctatctctggaacttgattaaaaaaaaagggccaggcatggtggttcatgcctgtaatcccagaactttgggaggccaaggtgggtggatcacctgagatcgggagttccagatcatcctggtcaacatggtgaaaccctgtctctactaaaaatacaaaattaaccaggtgtgatggtgcgcacctgtaaccccagctatttgggaggctgaggcaggagaattgtttgaacccagaagatagaggttgcagtgagccaagatctggccaatgcactccagcctggatgacagagcaagactctgtctcaaaagaaaaaaaaaacaaaaaccctttgtccataattgtttctattttaaaaatattagttatagttaatttgtagtccttatctgttaactttaacatctgggtcatctctatgtctgttgtttattttatttagttactggttagttcttcctacttctttgcatgtctaaggatttttttttttaattgtatgctagaccgagtgggtgatgagttatagatgttctggaatgtgttatctccccctgaagaatgttaagttttgttttgacagacagttaaattacttacagattaccttgattctatatggttggttgttctaggcattattagggagtgtctatttaagtttttgcccttactcttaagacatgacccatgttcctttcttggatttcaaatgaatgccagaatgtccaccaaggtttctctattttggttgagttggaaccctagtgtctccctagcattgggcaacctgtgaagtttctgttgggttctttgcctcctaataggtcttctctgcagtcctcttgaactcttgctctgctcatatacagcttaggatatcatccaagaatccagggagtatttattgtaggttcttggaacttcttctgtggacctctctcctctctcataccctgaccttgaaatccctgttgcttactatctctaaactctaatctctatttctttcatcagtgagttgccactctggacacttttctcacttaaattaacaaaccttatttttcagaatagttttaggttctcagtgaaattgagtggaaagtgcagacagttcccgtttactgtcctgtccccacatacgccctccaccactgttagcatcctatagcatggagcgcacctctcacaatcaggggacctacactggcacatcattatcactcaaagacgtccatagtttacgttagtgttcactcttggtgttgcacattctacaggcttctgacaaatgaacaatgacatgtatctatcatttagtatcataaagaatagtttcactgccctaaaaatcctgtgtgttctgcctgtttgttcctttctctcccctaacctctggcaacccgtaatctttttatggtttccaaggttttattttttctggagtgttctgtagttggaatcacacagtatatcaccttttcagtttggctcatttcccttagtagtgtgcattttttcccatgcgttttgatggattggtagttcatttcattttagtattgagtattaatattccattgtctgatataccacaatttatacattcaccttttaagggcatcttgattgcttccaagttttgttagttatgaataaggctgctttaaacgttcacgtacaggtttttgtgtggacatgagacttcaactaatttgggtaaacacccagagggcagcttctgggttgtatggtaagagcatgtttagttttgtaggaaacaaccataccattttctaaattatctgtatcatgttgcattcccacaagcaaagaatgagtttctgttactccacatccttgccaccatttggtgttgccagtgttttgaattttggccatcctaattcgtatatattggtatctcgttggtttgtctgtttgttttttgagatggagtcttgccctgtcacccagtctggagtgcagtagcatgatcttggctcactgcaacctccacttcgtgggttcaagcgattcttctgcctcagcctcctgagtagctgggactacagacgtgtgccactacgcccggctaatttttgtatttttagcagagatggggtttcaccacgttggccaggctggtctcagactcctgacctcaggtgatcgttctgcctcggcctcccaaagtactgggattactgcatgagccgccccacccagcctcattgttgttttaatttgcaatttcctaatgacattgtctgtgcttataaaattttattgtgctgtggtttggaaatggagtcatggagaacccagggtgaatgtggggctacctcctgtcttttcctttgtaaggatcataactctgtgttgcttgcttttcagtgcctgtcaacaattgttttatatatttttgtctagctttcatagtttttgctgggagggtaaatctgatatttgctactctatcatggcaaaaccagaattctaacaatcatttactgagatttgattaaatttatgagatacattgggttctgtagatacagaggtgcataaaacctggtccctgccccataaaagttcataatctcctgatgtagtaattctcaaaccactcttaagaaacactaaagctaaactgtattctgccattaaaatagaaaaaatgactgtctttacttacaaaaagattttgttgctgattttttgctaaccattgatttccatgctctggaatatagaatttattatggagaggctttttaagttttattatcctaaatttaatgcattgctattttataatattctacagaatacattacggacttctaacaaatatgccatgtatgcaagttttagtcatattggactagtgttgatatacctgatgaaacaatacctgtgattggtaaatgctgtagaataaagttcactggagtcccaaggcaggcagtaacattaactctgcccaccaagtcagggaaggttccctgaaggggttgatgtttgaattgggtcttaaaatgtttagtgttatgcctcatctgttactgcactgattatatttggagggggaagataattaaaataaagcaccctgaacatttaaattagtatatctttgcaattaattataggcttgtaattccacatctgaagtcaaagatctattggaacagaaaagcaagttgaccatagaagtggctgaacttcagagacagcttcaactggaagtcaaggtatctggtttttcctttatgttattttttccatttctgtcttggttgataaagaatattttacatgcattgggataaccagagtgaaagccaattttttttcccccaaaagaaacattcctctaatcactgaataaattcctgtgtatttggctgctgctgtccaaagaatttttttttttaatgtaaccaaagcctatagagactgtttgcttagacagagtaaaagaaaccctgttggatttaggcaggccaatgggaaactaaatgtatataaaacatctgaactaaatcatagaaatagcagaatgaggtttggctgtgtttgtgttttcttttacaagtattacagttcattaaatataaatgtttgatgttctttctagttaagaactcctgtgccttaattatatagtttgattaagttgtttaataatgtaagtgcaaagatatggagtctgcttgttgagaagtaggcttctgtggggttacgttaatgtacagtggaggctctttaaaatcacactgattcctgttagaatcaacagaacattaaagaagagagagagaggatgagagcaaacctagaagagctccgaagccaacacaacgaaaaggtggaggagaactccacattgcagcaacgactggaagaaagtgaaggggagctccggaagaatctggaggagtaagttctgggctgagagcctgttgcccttcccaggttctctatgacatgtagctagaaactttctgtccatttaatactacccagccttccaaatatttataaaggcagctggcttttccttttcttcctcttatctttgtaaaattatgaagctggcgacacatgtagactgataaacaaaaaggttagtaattcttaacattctttgtgcaccttgaagtatacgttacaaagtttcagtccttaaagtggacctcctagcaggtaagtgggaagcagggagcactgagcgctgatactgaaagacagagttcaaggagcctgggcccagcttctaaaaagcatgtgttacgtggcccccgtgagctctcagcctgtgcattttatcctcgatggtgctggtgtttgtgatgggtgcttatacctcctctgagtctacagagaaggaaagttaggtccaagatgcccctgccattgtgttgtattaaaagctgtggcaaaggaatcgaaaaccaaggtctaagaataaacagtgctatgacgttctgtggacacgacagaagccttaagtggaaagtcaagtgggaatgaaatctagggggaagttcaagaaaaagaggacattatataataaaagcatttgattgtccttgcagttttgatggtggtgttttgcgtttaaaacaatcatagatgctaattgcagaaaagagtttagtaagaaaaaaatcagaaaatatagggtatagtaaaagttttacaaaataaaaaggtatagtagttgtgagtttggttcaggacagagttttgtaaacttttttttcatcaggtggtgattattttagggtttgtgggtcatatagtctgttgcacatactcagctctgccattgtgtcgtgaaatgaaatggctgctcataaatgaatgagcatgaccatgttccagtaaaactttacactaacaggcagtgggctgaactggcccacagaccataatttgccaactctcctggtctagaacactgggatagtagacagtggaaggatggggtggctttagtgggaaatttttctgtttcatttctttatcttctgcatccaaattctagtaccctaccatctccttttggggagaaaatgtctccgtataaccatacccactttgttggtttgagttctcatttatcctcttgtaagcaattagaccatagcctaagttcttctcagccaccttttcaggttggtgatcccttgctcagtgcagaacagagaatggggaggctccttggggctttagagacttgtgtaaccctctgaagatcagaaatcagactggatggaaataagcagagcccagaagagcctgtctaatgggcttccttccctgccaggctattccaggtgaagatggaacgggagcagcatcagactgagatcagggatctccaggaccagctctcagaaatgcacgatgaactggacagtgcaaagcgatcggaggacagggagaagggagctctgattgaggtaagcagggctgtggggtcaggtgataagacaggccccacctgcctggaaagatggagtggctagggtttgtggactgcaagccactttctgatgtgcacacctgctccacctgtgctcttatgatctgtgagtcagtggatgcgcttgattctctcctctcagcttggcatttgctaattattatgggtttttattatgtattctctcttctctagattattatcttgttgaggtattagattcacatgtatgaaattattagcaagaatgttggttttcaatatgtacatttttgggagagggaataagtataattgagggtcagaaaaagacaggacttttatctctgcacccatttaggtgtttgatgtttgctgtaacattatcatcacctgtattctagcatagttttggaacctacttctttataagtgtggtttgtaggaatagcccaacaaagagatgataaacaatttagaacaaagccaaaaaaattaaaagtcaaaacataaaggtactgtgttaatatttaattttctacttcctccctctttgggcttaggtgttttctctctcccttacttggggctagaagcttctggctctgaagtccctggaacactctttaagtctcagttgtctactgttctgtcactcctttcctcctccagttttgaaataattcctcaggagagattttaggtcctactttttagaacttagcctttcttcacccgatgacctggcaggagctcagagatgagtgactctggtcacccagcccaggagttctcatgaatccatttttcacattggcagaggagggtgattgcctcttctccatatatgaccatctctctttccctattcagaccttttctcctgagaagccctcagcattgttccttaccaactgggattcctctttttatcaaatgattccttaaaaaccaccacattcttggtataatactgcttctcatggtgctgttttctctcagggctcagagttacaaagacaagaagatatatgtatttatcactgaaataatattaaaacaacataaaacgaaaattgaaaaaagggggagggggggacgtacacatactttcctaatacctgagcagccatttttatttctataatctctgtttgcctccctatctattgatagctttcatctacccatgtatatataatataaggacaatcataatgtccctacagttttgatacctgcttttaaaagttaagatatcaaaaatgttctttcttattatactttatgctctttgtatttaatttttaagaagataaaccacaatatatttaaccattctcctacattttttttcccttttttgtaattttgaaacaaagattgtggggaacattttttacatttatacttttactactttaaaaattgtttctaagaataagtttccagaaatgatgtcaatgaacaatttatggctttcaataaaagtgtagcttcatgaacaaatttaaatagaagataaaacattgtcatattcttgattccttgtgtgaacattttattggttctaaaagggaaagatgttatcttagctcttgggaagtctctgaagttgctgattttccgcagtaactgacagctgtcactgtgagttgccccctgatatcccctgtccttttagtttctctattttaactcacttgacgttgcacatattttgtatctttcttctgctagccagctaattcaagagcaatcacttttgcttctttccgcatttcacatctagcacagtgccaagcaacagagcaaatgaataaataatttttcgtatttaaattacttttaaaatgtcaccattttttaaaaaagggaataattctgaaatgaactgcatacttcttttcctctttaaacatgccatactgcatatctattaactgaacatcattagtttattgatttatttatactgatgatgggataacgatatgagactgttttggtgatgtgttcaggcagaggctgataatgcgagatacaggagtgggcaatagcacatattttcttaaacctgttcgtgatgttgctggcttacaggtagtttgtctctttcccacaacaggaactgtatcatttactgctgcctttctgcaagatgagttagagtgtaattagtctccctaggccaaagtgggtttctcttgctccagaaaatcaccctctgtttttatcagtttcctttgacttgtcagcaacacttaaactatgatctacggtttctacgtcactagtaaaatagaccctgtctccttgtcactttcaatttattcttcatatcttaataaaaagtggcctgggggaatttgataacagagtatagttgtggccaagtttcccatggcagttagcttggaacaaactcttaacacaatgagcattaaacacttatgcttttgaatgtttgaaaaaggttgaaggcccaagttttgcaagtcctgcataatggaccagattttgcatgaaatatcttttaatatgtcactttttgttaaataacatcagacccctgtatgcagtcagtaaagtaacattaagaaggaataggctgctctgtctatggagcagccattcttttgtttcttctctaataaactggctttcacttaaaaaaaaaaataaataaaacagtttaaaaaaaaaaagaagggagaaatagtagaaaacactttcttagagtaaaccataaaattgaccaacaaagggttgactttgttattcttagttaaatagatgattctgaaattttttttttttcagctcaagttacaaaaatgattatagaacaggtttccaccacttctctgtcaggaatgcattaccttccattccaagggtgacaggtcaacgtgagacagctcgctaagtgccacgatggtggggttttctaattatcaaatgtctgctttgatgggagcctgcggtgctgagagatgggcctcactccagcagagtcttgtggtgttttatccctggcatttgccaagatacaggtacttcagtctcattaaaatagtctggttataaaattgtagtggtttgaggagagattgtgttcagaaattatgtctctaaaacttcttttgtaatgatattattgaacattctacaaatttttataaaaaaggcagccaaaaataccatgattctcaccagccgtgtgatgcttccttggccatcctggaacaaaaaaatgacagaattctttgtcagctaccgttgctataaaaccttttatttatgctttcagtgagcatgggccagagatagggaccctgtggaacttctgggaagcacttatgcaaaagagggtctagactggtgtcttcctcattttgatgtggcacgctcatgcacaggtggtgtgtgaagtagagctttttgtgagcaaatacattgccgttctcgacatcctggtgcctgtttctcagtgcgcatggtcgtggggtggccacttgctgctgctgcagaacagctggtctcatagtgtgttcctttttctctcagatctccttctacctgtctcttcaggctctggttgcttttctttgctttagtttaagaaggtggacctccttaaagggccttccagccaaacacagtgctctgttttgttggcatctgtactaggctgttttcatgctgctgataaagacatacctgagactgggcaacttacacaagaaagggatttaatgtactcacagttccatgtggccagggaggcctcataatcgtggcagagggtgaaaggcacctctcacatggtggcaaacaagaggcgtgagagccaagtgacaggggtttccgcttataaaatcatcagatctcctgagacttactcactaccacaagaacagtatgggggaagccacccccatggttccattatctcccactgggctcctccctcaacatgagggaattatgggagctacatacaattcaagatgagatttgggtggggacgcagccaaaccataatagcatctagtggatgaactccagtgtgactgcttgcttctcagccttcttgagtatgtggttttgtggtcaggtctgtactgaccatagtgaagggaaagggcattaggacccatctgggtcccattcttgactctactgcttataaggctgtgtggtcttaggcatgttagaatctcagagcttcgttcgtttatgaagaatagtaatcttcatctccttgagtatccatctctctggattgttagaaatgctcagcacagttcttatgatgtataaggaccagacacagtcaacttttctagctctcgccactcccagacagccagttttctcttgttttctttaactggattccatagagaggcaagttgacctctaatggatgtatacttacattttgaagtttatgtatttttctctcccttctttgattgaaataattaagccccgaggtgatggagtgaagtttatgaaacatcgtgtaccttttagtctctactctggaaaacttcaagtgctactaagtgatatggcgaggtgtaatctgattggatttgtgctgcacagtccacttaagcaacagataacagcatgtcgttgcagaatggaccataaaaacctcagtcttgacatgcattggcggcagcacacaaaaggcaacacaaaacatagagatatgctggaaaacataagtgtggggagaggaactgtcttatcatccaaacaattgagaaacgtgtgagagtaaaagcaggaaacaggggtcagaatcacagggcctgcactaaagatgctggcaggaggttccaggaagccctggggggtagccggaagcaacagtaattcaggagagactctgatcttccttaagaaggggctgggcagcggcagcagggcgtcctctttgataaatacgaggacagggtataatttcataagatctctgtgtttggtgctttgaaagagccagagccggcctcgttacctgcatgggtctcttgacatttcttctgagcttgtcaatgcctgctagttagattcttgatgggcaaaatcttagtctgtgcaatgcagccccaccctgggattgtagcggttcccctggttcaatggaggtgcatgtcctagagaaaatgaaagagatctcgttgtcggttatacttaaatcaataaaatgtttcttccctcatcagagacacaattctggaatggaaagtagcttatcatctctgaagccttgggtcccccggtggcaaccatgcctctgattacccaggggttccaagaaaacaggtcgtgttcttatgcagaagccacaagtgaaataactgatgagttcagaattctgacatctccagacacctgctgtactgcacttgtttatttatatctgaacagataagtgctcccaatattaatctatgcatcaaaaatataataaatcagatctgtatccttctttcaacaaggataagtaggcgagtcaaatgcagatgagaaaaatgattaaaatatatagaatgtaaaataaaaagtgttaagtactgtgagaagaacagctagagtgagatgggtattcaagagggatattcaaggaagacctcttggaggaggtcttaccgtatctgggtcttcaaagattttctgaaaggcagggagagatgggcctgagaagggagaagggcactccggactgaagatgctgcgtggattgccatagaggctgtaggtgagagcctggatgcggggagcagctgagtggttatcgtaaaccacctgcacaggaggtgaggagggctttacccagggaggtgacagaaaggattgaagatgttgcagaactaactttttggttatgagagactaggacgagagaaagtcaaagtcctgccaagtttctgagcttgagtgctgagggggcaggtggtgcttttcacaagagcaaagaacaaaggaagaaggaaggaaggagcatgatgaattctcttgaaattgtaatcttactgaatctgaggtgccacaggacatccagatgggttcatctagcaggtctttgaatgtgttagtgcaggtttgaactcagagaagggtaagaggtaaaggtttaggagtcatttacatagaattaatagttggaaaaacaaaaatgagcttgctaaaagagaataaagaatgcaaagttgcaatcttggagatcatcatagattttgggaagagggagtgaaaagccagaaaagattatcaaagaagaaacagcctgagggaagaaaacaggagtctgtgttatcttggcactacaagaaagaagggcatcttagagagacaggaagggaggatgaaagaggggtaaagaaaattgacaactgggaaaaggccatcggatatgagtaaaggtcacaatgaccttgcaggggactgtcttggtagagcagggacaaaaatcatatagcaagagattaaggagtgaatgggcagttgtgaagtagaggcagtgaacagaaattatgctttcagacattttggtggtgaagtttggcaggtagccaagattcaagagtatgggtaggaacaaaatggcagaaagaaaagacaactgtattagtccattctcacactgatgtaaagatactacctgagactgggtaatttataaacaaaggaggtttaattgactcacagttccgcatggctggggaggcctcaggaaacttcatggcagaaggggaagcaggcaccttcttcacaaggcaacaggagagagagtgagcaaagtggggaaagccccttataaaaccatcatatctcatgagaactcactatcacaagagcaacatggggaaaactatccacgtgatccaatcatctcccacagtgtcccccccttgacaagtgggaattatgggaattataactcaagatgagatttgggtgaggacatagagccaaaccatgtcaataactgatggagtgaagactgggagcaggctggcaggggacagtgcgttctctgtggagggactctgggtggaagaaggcctggagtgcagagaggggttgaggtggagagggagccaagatgcccacatctctctggctgagggaagagcaaaggtgtctgtgagggcgagtcctgagctggaaaactgagaaggtctgggacaaaaatgctggagggaaaggaatgccgagcctttggcaggacacactgggctcaggtaatgtgatttatagtggagcctgttgccccagctttgtgaccttcctcattaatacctggcagttaagaaggggaaaatatgaatattgtgctctgctcagatgggcaaatgagatagaagaaaaacaggcaaagttgtcctgagtacgaggaatgtggatgaagggtttgaccacactcagggtcccaggggatatgaagcaaggtaggcaagctggcgtgcccccgtgaagcaacagcacacacagggcaagagcaagggcaacagatcactgcacagaagtgaaatgagatggaagatacagacgtgttccccaaagcagtgaaatttacattagtttcccctttctccctcaaattcaatcaaatctccaagaagcagaggcagaggaatccaagggaatgatggcctctgagaaatgcagggggagaggaagaaatggtctaaacaggtgtgcgggatgtggaaggagagagtggcaaggccaggtgagatggctgtgcacatggggactgaactggaggggagatacagggcctctcaacaagatgtttcattgtcaccttctcccttcgtgtttcctctctctaggagctcttacaggcaaaacaggatcttcaagatctgctgattgccaaagaggagcaagaagacctcttgagaaagcgagagcgtgaactcaccgccctgaagggagccctgaaagaagaggtttccagccatgatcaggagatggacaagctgaaggagcaatatgatgctgagttgcaggccctgagggagagtgtggaagaagcaaccaaggtgagggatggggcaggagaatctggcttgtgaacagatgaaagggtaagaccctctctcccacaccactgcaaatccccttcattccttttaattagagagtgaatctcaattcatcagatcatggacacagagcttattaacaaagaataagctcaatggtcctgctattgaccttttaaagtctataaactgaaacgttggtagggacattggttaaatcctgttgcagagggggagatgaagaagctgcatatgaacacttgaggttctgcagccccttgcagagtggagggatgtactctcccaggcgttcctaacggtcagaggccgagggcattgtgtgaccaagttaatgggcagaagtgcagacgggacccagattcctggaatccttcatcccccaccctagtctgttccttttgattttgtgtagccttttgttggacaattcaggttcttttctcagcacagttacaagagggttaattggctgaattgccgaaacccttccaagataatttttctcttaattgaattcttggctcctacaaatagattcaaaattatgctgaagtcttttggggcagacgtcatactggctgttgaagaagagaaaaacagtattttgaaggggaaaatggtttgaaatgtcatgccatctttagggaaagaggggaattacagattataaaattttcagagactctgcaatatataggttaaaaatgatgaagaaagaattcttgatattgtttattctgtgatgattacagtgacagctcagagttagtaggccctctctcccctaagccctatggtgattcactgattttcaattatggcacagtaattgcaaatgacaagaaatgaaagatgggtttgtttgttataacaataaaaagtctgggaaatagactgtttggggttattacaacttggagaccgtttttaaaagcctcttgttgatttccctgtcttatttttttttagatttgactgaatttgagggagaaaagcgaaaccgatttaatttttattgctttgaggggacatgcctgttatttgcatctcatttcatttctgtgcaccagcctggtatccttgtgatctatctttatgtgctattgcttcatcaggtacatgccaataggctactgagttaaaatttttctcctttggacccatatctttatcacccttaaatcttgcctcaaaacttgacttaatgtggtgtattctgggtggctcctttaagggcagttgagaatagtgttgggggatatgtttgtagtgatttaagtataaggaaaatcaaacttgtgcctcacatggggtgggggctatttattggaagcttccaggttctctactgtcagagatatgtaagtgaggaaaggatacatggtaggtgaaaggatatctttgttgtatggaattgagatcatcagtagagacttatgttactgcattttgtcctgttcaaatgtctgcattatatattaactcatagtattttcattatgccatttcaagagcgacaactacattgacccatatcagtctgtaaaaacgaaacaggcgaagtagtcaagacgtgtatcactggcagagaatggacagtttccaggcaccgggaagctaacacaaaggggttcgccttagtacccactggggtgtgggccagcaagggctgtttgttccaggttgttttctatactgctgccagcaactttccttacaaaaccaaatctgatcgtgtcagcctttgcttaagtaacttgcttgactccccattgccccagatttaagctgaaaattgttagcatggtagggaagaagtcccttctctgcctaacccatctccagaaaactctgtgtctttcagacctctcacctcttcatacgtgtagagtgacttgctcctgctttgccatctgaacaggctgttgtcctcctgcaagaattcccccaaatgtcctctcttttatgaacatgccctagatacctatactccctttggtggagttagttgcaccttccttcaccttccttagggtttctgcggaaccctggccattcttctactgtagtttgtatcataccctattataatttctcatcttgtctgcttcctccattagactctgcacttcttaggcatagggggcacttttgtcctttttttttttcctgagagggagtgacaaactctagtacctctggggccagacagggagcataaatgagtaaagcactgagtctgttattgggatgataggagggtatggtggggactgtgacaagctggctggagggcatgtcctttgctggagcggtcagtggcttctctgctccagcttagagttgccagtgagagaatgctgggcccatgttgctagatctttcatttttttcaagaagccagatatctggatgtttctgtgagatctcccaacttttaagcatatcttcaaattacaaaataaataaagaaataaataaaataacatagaccaatacaccccatatgcaagtcaagagcctgtgctcttagcctcttgagctcagcatggtgcctgggacatagtcacatccgtgcggtgtctggcaagtgaaagttagtttaggacaaatttcctttctgactgggttttcagtccctgccatgtagttcctgttgaattttttcagtggtgatgtgggaggtctttttgggaactctagtattattctttgaatttctgtgccttgcttttgaatttctctgcggtttcttttcctttcctttcctttcctttcctttcctttcctttcctttcctttcctttcctttccttctttctttctttctctttccttcttttttttttttgagatggagtcttgctctgtcaccctggttggagtacaatggcacagtcttggctcactgcagcctacacctcccaggttcaagcagttctcctgcctcagcctcccaagtagctgggattacaggcatgtgccaccacgcctggctagtttttttgtatttttagtagagatgggctttcgtcgtgttgaccaggctggtctcgaacacctggcctcaagtgatctgcccacctcggcctcccaaagtgctgggattacagatgtgagccactgtgcgcggcttccttgcagtttcttaaagaggatcctgattgtgttttttcaccatattagcttttgcttctgaaggtggctgcttaacaaatgtgatagagtcatattttatgggggacaaatgtgtcaatttagtagatggatgctgtttttggttatattatttatgtcttggtattatagaatagaacattaagattattaaatatttggaggagagtgaattaaatataatttttaaatctggtaaataatgtttcttaaatatgtgctcttacacttagatttttcctgccccagggggagaacccacccaccaaccactatggctaaaaactgactttttttttttttttttttttttttaagatggagtctcactctgttgcccaggctggagtgaagtaaaatgatctcgtctcattgcaacctccacctcctgggttcaagtgattctcctgccccagcttcctgagtagctgggattacaggcatgcgccaccacacctgactaatttttgtatttttagtagagaccgggtttcaccatgttggccaagctggtctcaaacccctgacctcaggggatccgtcagcttcaacctccccaaaaaaaaaggacatttctttaagaaattttattgcattaaaaagtttattacttcaataggtcttatgaagcagcccaaccttctgtcatcagtttttcttattcttaccactgccccagtgtcaaaaccccctaaagtgctattttatcgttgtaaaataaccagcactttatcctagcttgagcactaaaggttttacgttactagaacatttggtgaaaaatgtcaaattatatttcgaatgttgtacaggtattccaaacagataactctgtaatagtgtattttgtaaacccatcagccatatcttttaaagaacagtttgattgctcagtggatggaattcatgaatgcctatgttatgtggggtttcctcacccagcagaatgaattgcatctcactggcagagcggtggaggtttgggttataatgtgcactatttaagttctcttcttatagagaaatggatcttcgtagtctgttaggagagtatatctaccaaacattcttttaaaggactaagcccttaagcaacttatttcataacatgcttttttctctgtttctggtcattttacactttttttagttttaaaaaggaaatgtcttcttcttccttgggttcgtggccatggctggaaccctttagaggaaatgggcgctcaatagggatgtgaatgactgccatctgggagtaaaattaaccttgttcacagccgttggcttattttttccaaacctaacccttcctatctgcaactcttgtgcaaaatagaagtacagacagtatagtttcttgaagtttctcagaaagtaggttcagctcaaattccagctcttccaggaacttccctcgctgccttttggaccttacagtttctagagacctggtattgttggcaattttgctccgggttttatcttccctgccgtactaggtactgtcatcatcttctacttggtaacaccattgtgcttggtacttaatagatgtttagtaaatgtttgtgggttagatgaatgaatagacaaaaagggagatgtctttagagtcctcaacaatctgaagaccaaccattagactgttttggcttttaatttataaattcaaattacttctcatgaaaatgaacaaatcttgtttgttaggagcagtatcatgatgttaatgttaatcttcgaaggagtaattttgcatctaagagttgcaagtattttgatgctgataaaacagccacttttatttttgtgccagataatatgacttttgggccattaggcactttcagagtgtccaacatacagcagttatgcaacaaatatctcccaagggaatggatgagggagaagaggagggaggttgaagacatgtgagatactcttgccatccttcatttctccgtttgcattatttttaaatacagcaccttacaaactgatttactgagcaactgccaagtacagggcatcgtgctaagttcgtgaggactatacatataaatcaggtggaatttacccttccaggagattgaaggggagatatgtaactctcaagctgattatagacaagagtaaatgacccaggtgaagtggagataaaatcatataggaatccctataggagaccccatggctgtgcttaggaggaggactgctggcaatcacgaaagattttagggaggggacagtatttgagttggattttgagtgatgtttgggcatgcgggctgaggacattttgggtactgagtacagcatgagcaataccttgtaggtgggaaagtgagatgtctgggctgggctttgtggagaaaatgaagttaaggtggctacagattcagagacttaaggggcgggtgcagagatccaatgagtggaccgtgctcggatcccaactgaaacaaactgactgtaaaaaacaaaaatagctaaaatcattgggaacgttttaacactctatattaatgatattaagaaactaaacaatttttaaggggtgataatagtgctattgtttttaagagtctctgtcttttttttttttttttttttgagatggagtctgactcttgttgcccaggctggagtgcaatggtgtgatcttgactcactgcaacctctgcctcctgggttcaaatgattcttgtgcctcatcctcctgagtagctgggattacaggcgcctgccaccacaccccgctgatttttacgtttttagtagagatggggtttcaccatgttggccaggctagtctagaactcctgacctcagataattcacccgccttggcctggcgaagtactgggattacaggcatgagccaccatggccggctaagtctctgagttttaaagaaacatactgaggtttttataggctgtctgaaatttgcttcaaaataatccactttgttgggggaagtcagtggggtatggatgaaacaagatcagccatgcattggtgtgtgttaaagctgggtaatgggtaggtgagagttaattacctatcctctctacttgttgcaaatgtgtgaagttttttcttcctttttttctttctttttcttttcttttctttttcttttttttttttttttttttttttgagacagagtctggctctgtcacctaggctggagtgcagtggcacgatctcagctcacttcaacctccgcctcctgggttcaagccatcctcccacctcagcctcccaaggaactaggactacagctgcacgccaccacacctggctagtttttgtaaagacagggttttaccacgttgctcaggctggtcttgaactcctgagctcaggccatctgctcacgtcagcctcccaaaatgttggggttataggtgtgacccactgcacccagcattgaagttttctttggtaaaaagtttgcgtgtgtgtgtgtgtgtgtgtgtgtgtgtgtgttaaagaataaacaaaaagagttaaaataggaaaggtggggtggggtgagattatggagactatttttagttggtagtcagtgagggagcaatgatgtttcttttattagggactgatatgatttggctatgtccccacctaaatctcgtcttgaattgtactctcataattcccacatgttgtgggagggactggtgggagataactgaatcatgggggtggtttcccccatactgttctcatggtagtgaataagtcccacgaaatctgatggttttatcagggatttccgcttttgcgccttcctcattctctctttgcctgctgccatccaagacgggacttttcctcctcgccttccaccatgattgtgaggcttccctagccacgtggaactgtaagtccaattaaacccctttcttttgtaaattgcccagtcttgggtatgtctttatcagcagtgtgaaaatggactaatacagagacctaatgtggggacattacttggtggtggtgtgacctgaggctgcagctggaatggttagaagtagagagtggggaggaatgagcaggtagtaggggctgactgaggagaccccgcagggagcatgaattggggtgaggaggaagaagagagacagctgacctgagcaggcatcgtctctgggtgcctggaagggggctgtactgggaatggaaaggctaatgagttcatcttgaggtcctgggagccctctgtgtgaacaatgagtgaggagcagggctgccctatccatctgggagtcgttggacggagtgtgagcgagtgacagagagagaaagaagcgaagggggccgagggcctgaggaggaagagaagacacagacacagagacctgaagagaagcagccacatccagtgacaggaaagccaggggaagggcagttcatttgacttagttaacagtctattgggggagtttctaaaagaaggctatttttgcattagacatgtccatactgagtttctgtacttttgtcttgtctgttcctcatactgtaaattctttctgcccatattttatattgtctaacccttataagaattttattcaaattcaataatgttgaaacttttctcccccttcaccaccaccctccaattttggctgtgtgtgtgtattttacccagcaatttggaaatgtcactgagtcttacagaaatgaatatatgttttggtaccgtgttcccacgtcatttctagttttgtcccttccctctttcctgccaatgtctgaagaggttcttccaaagcataaggtcagcagagggtcaaatggtaaaaccagtgctaatctcaggatcagtggaatcgcttcccttaagacatggctaattcagtgtaaaatctcatttctgtcttctccaagggagccaggttagctagggaaacagcaaaaattcctcatttcctctgcattttaacttcaaataatcaacttaccctgaatgacggctactgagagctggagaagtggtggggtttgcaatcaggtgcccaggaaaaggaaaatatctcttttccacagactcaagcctgcctagagtgacatggaactttccataggcaaaagtgaaatgggaagattcaaggctaaaaaaagatctctttttttttgtctctctttttttttttttttgcctgccccagaaatggctcttttaatagttgtataactcttctgcatcttgtattgattaaaaagtatataaataagaggtctagagtggtgtcctgggatgttccttttgaacccatcacaggcccagtgccccattctgtggctgtgatcccaggtgcctcccatgtcctgagagtcagtggctgtcatgaaaaaactctggggggctgggtaatggacagatctcttagcgggcctccatgagggataaacagagcatctctgcaagtcactcctggtgttttacctgagctgcctagagtcacttgctgtgggttaggctgtagaagacaaagatatgctggtttatctttagatatgcggattcatttgccatcaaatgcctgagtgtgttttctgtgccagcgcggtgctagtcaccaagaatataaaggcaagcaagctgtggtctctagctttgaggatcttatgtggtcttgtgggcagaaagatgtgcaagtaaaatgacaaagttatggttgctgtggttgaggtatgtgcagagtaggagattaggagaggtttattgctttaggtggcaaaattcaggtgagaaatagcatgtcagttctgtgagttgacaccctaagtgctttttatgtaccaaatacttaagaattagaaagaaagaaacgttcctcttcgaagaacctctctaggagctttgggacgttggtgtacctcgaacttgctgactttgtacccaacttcttttagtgaaactcaagagttaacaattagaattgctaggaagacaaagaaaaaatattgatttggctggtgagttaaaatacatttcacttattcagtaaatcagcttccagttacagttcagatttccagagcgtaggagctcataaactatttctgaggagagcctctacctttcctggctaggatgacagaataaagggcttctctttccaggtctaccattagggcttttggcgagtagatttagcagctgctattctgtagagaggattttggctttagcctcacagtgcaggaagaactgatggagaattccattaggaggatccctcacatggagaggtaggacactgggtaatttttaatgaccctaccttggtgcttcatgaacatgtttaagcaggctggcattttctagcagttccaataaggagcagaaggtagggctgatacccagggcacctcgatgactcaaaatcacagcaaattcacaggcagcgtgcggagaaagtgacaagacttagttgggtagagaaggaggtaatgcgctggaagcacagctgaggagcttggtcgcgtggtcaggctgcctatgcctagccttctgggggggcctcctgctcaccgatggagtgaggagggcccttgcctgtttcccacctgcgatgaacagtgatgaggaaaataggctcaaaccactcagatttcgtgttcaatagtcagtgtcaatgtctaactgttgggaatggattgttgatacagtttttggaatatccatccaataaatagttcatttatggtcattaattaagcaaatatctaaggagcattttatttatgtcaggcactgcgctgggttgtaggaataacatggagaaaaggggtgagaaggacgttattcagataatcacatggataaatgtgtgattttctgggtgtggttgtgcaccctgtagtcctagctaccagggtgtgtgaggcaggaagatcacttgcgcccaggagtttgagtccagttgggtaagagagcaagacccccatctcagaaaaaagaaaaaaatatatacatgtgtaattcagatgtgataaatgctttgaagttcagggagggagaaaaagtttccttgaggaaaacgatgatggaaatctgaaggatgaatgggaattaactagatttttaaaaatccagagactggtccaagcagaggaaatagcatgtgcaagggggcttgcagcagaaaggagtgtggtttgttcaagctgttaaaccatggcaagtgaggctgggctgtgaagggtggttgaaagtctggtatgagaggaagtagaagcagatagggaacagctcatgcagcctgtatggagcatccgaaggacagatttttagagagagagacagacagacaagcaggtgtgtgtgtagtgtttttgtgggggagtgtgaatgtttgacacagacagattacttccatggaaaagtgcctgctctgggcttgaccagtgaggtgggaggccctgggatgattcgttcatgctgacacttaggatggaggcacgggatctttgaggtctcttccacaatttcattctatttttaaagggattattacctgtccctgtctctcctgactcctgtggagaaagggatgggaataggattatgtagggccccattttccttatgagtttttgctccttgctaagtgccagtctgctgaatttataacatgtgtctttgggcaggtggatgagagatgatagggcttatagctgaaggcagaagtttggtatgctgacggagaaggtttgtaggaggaaagtttttatttgtttcttgcctaataaggcttttataatgggtcagcggtgggaatacatttaaacacttacagaagcagagaaagtaacgtagtggggtgcttgcctatctccccatgtggagtggatgttctgaaatctctgagccatccatggacactgcccagagtctggaagtgtgagtaacaaaggagctatggctactcactgatggccctacaccagatgcatttccagatgtggatatggtcaagccacaagaattgggtggtgcagtgagtggggctattataaatagcctgggacagtcacagccaccataatattgcaaacagttgaatccttaacatctaaaggaaaaaagctttattattggaaatcctattcaatctatgttatactctctctgaccctctaaattctgcctgatggatatttttctaaagacttgccaagatcattaagtagatttttacttggtggaaaaatttggcgttatgatttgatcactttaagcagaaaatggaatatgtcataaactctaaattcattagacaagaaccagtatggaaacaggaatacctacagtggcaaagttaatcagagtgcataaggcatttacagtagcccgttggcccccagtgacctgagccttctgggcctcttgctccattatagtcccttcccatgtcgaaaaggtctgatttgtgtaactaataggatattatggaaatgatggagtgtgacttccgttgcttgatcataaaggacatgtggcttcctccttgctttctcatggatctcttgctgtggaggaagccagctgccatgttgtaagtgcacttaagcagcctgcgaaaaaccccatgtggcaaaggactgaagccacctgtcaacagccatgtgagtgtgccatcttggaagtagatcctctggccccagtcaagccttcagatgactataaccttgactaacatcttgactgcagcctcatcagaaaccctgagccagaactgcctgattgagtcacttcttcttcttcttcttcttcttcttttttttttttttttttttttttttctgagacagagtctcactctgttgcccaggctggagtgcagtggtgtgatcttggctcagttgcaacctctccctcccgggttcaagcgattctcctgcctcagcctcctgcgtagctgggactacaggtgtgtgccaccacgcctggctaatttttgtatttttggtagagacggggtttcaccatattggccaggctggtctcgaactcttaacctcaggtgattcacccaccttggtctcccaaagttctgggattacaggtgtaagccaccgtgcccagcctttgagtcactgcttgattccttaccctcagaaactttgtgaggtaatgtttgtcactttaggctgctaagttttgggacaatttgttatgcgggaataaacaactgatagaacattttgacaaaccatctctttgaagctgcattttctgatagccactggctctagcagaacccacagcatcctgccatgcccttggtttagtccttgttatgctggactatatctcttaggtgatatgtcatgctcctcatcttgaaggaggggtgtcttgtccttcatatcgtcagtactttgcagaatgccctgtatttgctgtatgagtgaatcagaatgtgtagaggtaaataaaggacacccgcatagtttaaggacaggtcagggttttaaacccagctttgtcattgacttcatagaattctcctagtctttctctgtttttatttcctctcttgtaaagggatactatttgtgttataaaaaacatacataatatattgctatacatgcatatgtgcttgtgcacatatggattatttcaagagggagataactagtcaatagtggttacttctggggatatgtagggggatggagtaagaggaaaactttcaaaaaacagtgtgtaaacctttcatatcttttgaatttattccatgtacagtgaaataagagtattgatctgcacctctcctaaggcaggtcaagaagaagtcctaagtttagtgaagtatttttaattttttgtcactgggggcccctgcctctgccttgaccttgaccttcaccttctgtctgctacccaggtctgtggcttccacatccacagcagctcagttccatcctctgacctcctttctcacagttgctgccctggttcaggcctcagcagccatctccctatttccccaactgtgttgcccccttctgaccacaccacctgccgcaggttggccaccctcacaagtccctggtggcttcccttcagttacagagtcctgcctggtctccaaggcctgcactccaccacctggctcccacctgcctttgcaaccctggccctcactgttgtccctggtgagcttggtgccagccacactaaaggattccctgtcacctccacagaagagtgtgccctgttactccgtattagccacctctgggactttgctttgcaatcctgacctgcaagaaaggacagtccccacaacagagacatatctgacccaaaatgtcaatcatgtcactctgagaaactgggatctatgtatatacaagtgtggtgtgtgtgtgtgtgtgtgtgtgtgtgtgtgtgtgtgtgtgtgttttcttttcttctctttttacataaatgcctgctgtgcaaccccaagcctagttaatgagcaatagatggagtgactgaatacttttgacacaccacatctctgatcccaaagaatcttcttcttgcagtggggaaaataatcctcccagggctgtacgtattccagcctcagactgtcttttctgacctgctgtcctgtgctctctcactggattctctgcgtgtgccctagtggtctccctgcttgctttcttctttcccccggctcatattagcctgtctgtccccaacatccttcaccagcccccgagctatggtctccgccatttaaaatcgtgccatccttcatggctcaggtcagatgacatctccttcttgggtccacccagcagctgctgttctttctctttgaaatccccagggtcttttgtccctcgggtggcatttattgtgttttgctttgcctgtagtttttgtttgtttactcaacacatcaagcatcatgcgaaatctggggtgcagagatggacaaggtggcctctgctctcaactcttccccagcctagtagagacagacaagaaagctgacagccagttcggtgtggggcatgagaagctggcatatggcacggaaagcagaagttcggaaaagggtgactttgctccgtgtaggcaggccagggcgggttcctaagagggagtgaggcttgggtgagtcttgggggcagtgggaattagcaaggtgacttatgggtgggcaaggacattctagacgcagggaacttcttgaaccaaagtatgtcttgttctcctctgagacttgaacacctctttaggggtaaccattttccttattcatttttatgccttttatagttttaccttagacagctaatagttttgtttgcattcatgtatttattcattcaacaaatattcttgagtgcttatttacttgaggtactggatagatgtaaatggatttaggcaaatagttggtgacagaagaattcagtagaaaccatcagagtagtaggcggcctctgaagtgattagatgtggtttagtgagttttagctacagagtaagtcatgtgttcacggtgaccacacgttagaattctggaaatgtgggccagaacaagtccaagttagatgcaatggaaaaatccctctgtccgagtcatctctagggaacagaacttgtttgaaccagcattattagtttagtttcatgaaagacaaaataaagggcaaggtgtttgctccacagggtgactgcagcagttttcacagtaatgaataaagtaatgctgttttgtcagcagtgagtaggagttggggactgggagaagcttgttccattcctcaggaaattccaaagtcatgcacgggccttatccttggggaacttacagatgaaggagagaatatggccaagcacacatatttctccttttaacacttcccttctttttctttctttttgttttatttgttaaatttctgcacatgtttctcaagtgtgtggtctagtgggaaggaatactggcagtctctgggtttagggaaacattgagtccccttacagttagaaataaaaggctggacgtgcttcaaagactttttgaaataaggctggggacaaagaagtcaagcaaataaatgatagagtccagagaaggtggcattagagatagatctgaaagcattcagggagacgtggtgcaggaggatgggaaaatcttgttttttccatccctgaattgtccaagagcccaaagacatctactctgcaaagtgtttgctggatgacagtgcaacgaagacttagatgctagcaaacttcgttggaaaacactgggttcttcatgtatttggagcaagaaccaaggcattagtaaactttggaaaataggcagtgaggttgtccgatagagtccatctggggaagtattttgagccagttgggtttataactatgaccctaaacttgagtccagcatatgccaagtccaaaggaaaggtatgttctttggacccctcatgctctctgatttacagggacctctttctgcctggtcaaggcatttcatgactctaagcctatgactttttgtgagaagaagccttccatggctcctttgctgcttggttttggggttttggaggcaccaggatgccaggctcctaccctgtgtgcagtgcttccttctccccgtcccattgtgaactgtttcccttgcaggttcaactcattgccacttcctgtagctgtcttagtgacccttcaggccagaagcagatgcctgtgctgtgtaccatgcccctcctgctgctgaactggagagaaaacgtggctggcaggtggtgaactctctggctgattcaggcccagtggagaaggagggttaataatttactttgcccctgtgtagccactggtgttgaccttgtcaaaacactagtagaaattaattagagtctggcctgtcatttaactaacaggatagtaaggccccaaaataacttcttgttttgaggttaatcctgtctctgagtttacggctgacattcctgtacatccggccctgtttgcatccagcagccaggaccgtgggctcatggtgttcatggggctcacaaagagggcacacaaggtcaggggcctgtctctccatgggagccgctcattgtggtaggaggacaaaggccacagtgatcaagatgctctgtaggagaggcggcagaacaacatgtgggcctggtagatattgcaggtgaagagcctccccatcccccaagcttctttcattttaaattcacagcttttgtttcttgagaagttccgaatcttttgcatctggtgctgcgagaaggttcacctggttaaacatcctcaagtcaacagcacagctccttctggaaggcactttaactggatgggatcctctcactgtagacattgctacctccctttcctgaaataaagcctgctccagagcagtgattgtcttgtggtgtgttgtggaaagctgttaatagcttaaaaggtctcattagctgctagataggcctagactgtgaaaggatacatggtgacccaagggtagattctttttttgagagtctcgcactgtcacccaggctgtagtgcagtggcataatcatggctcgctgctgcctcgacctcccaggctcaagtcatccttccagctcagcctacagagtagctgggactacaagtgagtgtcactacctctggctactttttgtattttttttagagatggggttttgccgtgttgctcatgttggtatcgaactcctgggctcaagtggttctcccacctctgcctcccaaagtgctgggatagcaggtgtgagctacagctcctggcccagattcttaccttattagggagtatctaaattaatctgtttattgatctcttaagtagaatctgattaattgtccatcaatagctagctgcaaagcactgcagaagcccacttgccactctccttcccccagctctccaggaaggtgcaaggagttgtttgagatggttctgacatccagcttttgggtccctggtttattgccttttccagtacattggctggcacctttatccagccaacaaatacacgctctgtaaacatgcatgtacttttggagaaggcagttggaccaaggtgagggtgtggaggatgggagtgaaaaacagagtaagccagaaaaaggggtcatgggaaaggaagggcaggagctagagggaagaggcctggggactgactagtgcccagcaatagaaacaatcagcattagaaatgggcaaaggggctgggcatggtggctcatgcctataatcctagcactttgggaggccaaggcgggcagatctcctgaggtcaggggctcaagaccagcctggccaacactgtgaaaccctgtctctactaaaaatacaaaaattagctgggcatggtggtgcatgcttgtaatcctagctagttgggaggctgaggcaggagaatcgcttaaacgcagtaggtggaggttgcagtgagccgagattgtgccactgcacttcagcctgggtgatggaatgagactccttctcaagaaacaaaaaacaaaacaaaatgaaacaggcagagcagtttgaagaaacttctcaagaaacaaaaaacaaaacaaaacaggcagagcagtttgaagtatgatgggaatgaggtacaggggaggcaggaaggagaaaagtgcaaagggatagtgagaagatgggaggtggtgtggagaggaagcagggaagctggtagcaccaagaagtgaaagaggagtttgagctaaatatctagaggataaagggggaaaagatgagtctgaaaggtatgagagggtgacagcaaaggacagaggagaagccgtgagctacatattatgccaggtgagatttctgctccaggaattttggctcacggttatcccaaagagctgtggcagcaagtgttggttttattgcagtattagcagtatgtggttactaaataagtgacttttgaaataaagtgtgaactgtgagactctagaagaggataaatgaaacttttatcacctgagatgggtaatttttatacctcttatttctagggtctctctatccacagcattgagcatgggtatgaaaatatgcattgaggccaggagctcacgcctgtaatcttagcactttgggaggtcgaggtgggtggatcacctgaggtcaggagtttgagacccgcctggccaacatagtaaaaccctgtctctacttaaaatacaaagaaatttgttgggtgtggtggtgtacatttgtaatcccagctacttgggatggtgaggcaggagaattgcttgaactcaggaggcggaggttgcagtgagctgagatcctgccattgcactccagcctggacaacagagtgagactctgtctcaaaaaaagaaaaaaagaaagaaaatatgcattgaatgtaatactttaaaaagttacaaccatcatttgtctgtgggggaaaataccatagtccagttagttgtacctgtctctagtggtctttgggcaggagtttgaagagatcattggaaagacatcagaagaatttaaatgacccatatcccgtctttcagaatgaaactaatattcattaaaaaaaattgtatgctctggctgagaatttatacagccttctaaagaggagacaggtatgcttttggtttccagtgatcagtctgtgaacttggggcattactcagtggatctggaaccttcttactctcaccagttggtttaggccatcccccttcctcttgaaaccaactttgtttgatatgtcattgtagattttctattatttcccccaaatcattccttaatgaacagtacaccttaaatgccttctctttgtatccagaaattatcagctcaaccaataaatagtatgtttgttagtcaagccagtgatccaggaaagacctggggttttttttttttttttttttttaaagatgggcaaagtttaaaaaagaatttttaaaaaatcaaacgttttgagatagttataaatttatatgcaattgtaaaaaaaaatacagctagatgccatataccctttatcctgtttcccccaaatgtaatgtattgcaaactatagtacaatagcatgaccaggatactgacattgatacagctgagatatagaacatttacatcactccccgcattcttcatgttgtccttttatagccatgccatctcgctttccctcccatccctccttgacccaactagtgtacttctctctggtttttaaattttatcatttccaggatggtatatagatggaatcatacagaatgtaaccttttggaattggcttttttctctcagcattgttctctggagattcctccaagctgctgcatgtatcaacaggttctttcctttttattgctcagtggtattctatagtatagatgcaccacagtttgttcaaccattcactcattgaaggacttatgggatgtttcttgttttgtactattataataaagcttctatgaacacagctttttgtgtgaatatgttttaatttttttctgggataaataggagtgtgaatatgttttaatttttttcttggataaatatctaggagtgtgaatgtgatttaatttttttctgagataaatatctaggagtgcaattgctaggatgaatggtaattacatgtttagcttttaaagaacctgcaaaactactctccagaatggctgcaccattttgcattcccaacagcaatgtatgagtgacccagtttctctgaattgttcccagcatttggcattgtcaatatgttgtattttagccattctgataggtatatgtgatattatattgtggttttacgcagttttctaatggccaatcatgttgaatgtcatttcatgtgctcttttgccacgtatatcctctttggtgaaatatctattcatgtcttttgcccatttcctaattggattgtttggggtttgttttttttttaaactgttgagttttcaaaattttttatgtattctagatatgagcactttgtcaaatatgtggtttgtaaagacattcttccaatctctagtaaaacaaaacaaaacaaaacaaaacaaaaaacctttttaacaaggtctttgaaaggtacaagtctttagttttgatgaagtccaatttagtttttccttctatggattgtgcttttggtgtcaagtctaagaattattttcctaccttagatcccagagattttcttctgtgtttttgttttctaaaggtttcttagttttgcattttacatttaagctcacagtccattttgagttaaattttgtgtaaggtggaagtttagtttgaggtttatttattttgcctgtgaatatccagttgctccagcgccatttgttgagagggttattcttcctgcaataattgcttttgaacctctgtaaaagtgggttgggcatttttgtgttaatttctgggctctctattctgtttcattgacctgtgtgtctatccctctaccagtatcacatagttttgatgactgtggctatattatgtcttaaaatctggtagactgaatcttccactttattcttttttaaaattgttttagctattctagttactttaccttttcttttcttttctctcttttttttttttgagatggagtttcactcttgttgcccagactggagtgcaatggcatgatctctgctcactgcaacctctgccttccggattcaagcaattcttctgcctcaacctcccaagtagctgggattacaggcagccgccacctcgcctggctaatttttttgtatttttaatagagacagggcttcaccacattgcccaggctgatcttgaactcctgacctcaggtggtccgcccaccgcggcctcctaaagtgctgggattataggagtgagccactgcgcctggcctaccttttcatataaatgttagaattaccttgtctgtatctatacaaattttgctgaagttttgataggttgagtatgactatgttgagtattccagtccatgaacatggtctaagtaaatctccatttatttagatgttcactgctttcatcatttgattttgtattttcaagcatacaagtcctgtatgtgttgtgctaaacttatacctaagggtttaatgtttttgagtgattataaatggtatatttttacattttagtatccttctgttcattgctagtatacagaaatgcagttgtatgtttttatttatgtttattttatatcaggacctttatttctttaccttgctgaaatcacatattctacaaagttttctttttttttttttttttgtgacagggaggtggtagattccttgggattttttatatagacaatcatgtcatctgcaaacagggacagttttatttcttgctttctgatgctttctgatctatataccttttgctacttatttcctgccttattacgcaggctagaagctccaatactatgttgaatcagagtggtgggagcaggtatcccagccttagtctcagtcttagggggaggtattcagtttcttactattaaatataatgttaattatagatcttttgtgaattggatgctctttagttgagaatgttcctctctattcataatttgtttggagcttaaagaaagtttaaatcatgaatggattttgagttttgttaaatgctttctctgcatttattgatatgatcatgtgatttttccctcctgattttaaactatcaaaccagcctagcattcctggaataaacttcacttgatcctactgtataattcttttaaaaattgctgacttttatttgcttgtattttgttaaggattcttgtgtctatattaatgaaatatattggcttatagtccttttttcatgttttcctttcttttaggatactatttggattttgatattgaataatactgacatcattaaatgagctgagaaggatttcttcctcttctattttctggaagagattgtgtagaattgatgtttattcttttttgaacactaggtagaattctccactgaaaccagttagacctggacatttcttttgggggagttttaaaatatgaattcagtttccttaatagttatgaggctattcaaattattatatttaatatcgcataagttgtggtagtttgtactttttaaggaattggtctatttcatctaagttgtcagatgtgtgttgagttgtttatagatgtctgcagggtctgtggtaatatatcttgtttaatttctgatattggtaatttgtattttatcctttttttctttgtcagtcttaccagaagtttgtcaatcttactgattttttttgttaacatttgattagtggtttttagattttttattttttattttactttaagttctgggatacatgtgctgaatgtgcaggtttgttacataggtatacatgtgccatggtggtttgctgcacctatcaaaccatcatctaggttttaagccccgcatgcattaggtatttcttctaatgagcttcctccccttaccccccaatccactgacaggccccggtgtgtgatgttcccctccctgtgttctcattgttcaactcccacttatgagtgagaacatgcagtgtttggttttctgttcctgtgttagtttgctgaggatgatagtttccagcttcatccatgtccctgcaaaggatatgaactcattcttttaaaagaatcagtttctcgtttcattgggtttttttttttctattttttttatgttttcagtttcattgatttctgttctttattatttctttccttctgcttgctttgggtttatattgctcttccttttccagattcttgaggtaggagcttcgattattgaattcagacttccttttttctagtatcaacatttaatgccatatattttattttaatttccattcaggtcagtgtgtgtttaaaacaaaattttcttgaggcttgctctttgacccatggattacttagaagtgtgttgtttaatttctaagtgcttgggtgtttgcctgttgtctagttcgagtccattttggttagaaaaccagtctgtatgatttcagtccttttacatttgttgaggtttgttttatggctcaggatatggtttatcttggtatatattcttgaaaagattgtatattttgctagaaagagatttcaaaaatagtaaatatgaatcaacctgaaggataaaaataaatgatttttctttcctttggcaatagaaatattgttactagttggacaagttatctttattcacagcctgagttatacaaaaaataggaatacatcctttttggtggtttacaaatctaattatattttcatgttaaaagtaagtggtggaggatatgtgaagtgtcatagtatttgccacagaggctttttcccattcaaattgtaattgtgtggaattttttattttgtagttgctttagtaaaaacaaatgatagaaaaagcttgctttaaattaaattgaacaatgcataagagtatagagtagaagaaaatatattttggatcatacttttgacaccacctttttcctctctcacaatacatttggaggatcttttcagatagacgtacatagaatgtcctgtatgccattctttgatggcagcagcacagctctccagatgctgatttaaaaggagtttagccacgtgccatttctttcttctggtgcccagtctcactaacctctcctaatagtctagcattggcccctagagaaattcaaaggtctgccaaggtaagtcagcaaaccagtcaagggccaggaagtcaggaatgtgtgagtagctgagtcaggggtctggaatcagaagtgagggtgagtcaggagcagggcccgggctgactcaggcaggctgaggtggtgacctgtggaatcagctgccttactggtgctccagggcaggggcaggctcaccatgctgaggcctgaaacttcacttctttcagggatcagctaatagatgtggtcaaggaatttggtcccagtcaaccttccctgcttcttctgtgttaggtcatctgtcagaaaatgttaaccaaactttagggccacatgactttgtttctctttgtggaaatgggaatgatatcactgcaaagagtcagggaagaggtcgtggggggaaaggaagagggggtcaaataaatcagcgagaaagagagaaacagttggaaagccagacagatactgggcgcttctgcaagagttataaactgttcttatcaccaaatctggtccattctgtcactcacatgagtccgtccagtcttcctctctcttattcccaaaattttagccttttaactgaagtccctcctcacagctgtggattgattggagagaatgagtgagaacagcttgtcaagggtgaccttcagcttttacgttaggtgactggtgaatattggaggcattgagaaggaacagaggaggtccatgtcttggagtggtaagtgggatgaggacttccattttgtgcatgttgaatctgaccgtgttgagtttgaggcatctgtgggacacccaaagaggggtatctggcacaagagaaaggctaggctgaagctactgattttggttgggcccaacagctgcttgcaatagttgcatgctcctgagggggaggctgtttgcattctgtccttgttttacatttccattgggagtggtgttttagaacttcttacagatgtcacaataattgtagacctggccctaccagccatgcttgaggtattatgtagattatctacttctttgctgctagttttcccagcccagttcaactatttcctgatgcaaatgaagcttctaagtgtacaaacttaaaatacctttattaccagtgcaaccacactaaactctaattgcccagcaactagaaagactaggagtagacagtttattgtatgtgtgcattttgatggagggaagagatgaatatttgcaaattcatattatgaagaacaagagtacttctccttgggagatgggtttttccaagatggtaaatgagttgcaaagaacaactttttctttcttttcttgagcttattcaactttttttttaaagcttattttgacttcagccaacattacttattttcaggtatacagagtcaaaaaaaggtaaaagaggaggattggtttattgctgtttttctgggcaaaagtgatacttagtgggaccatttggccagtactgacatactgggttaggatacatatttttctcaaaagcattttgaggaattcttaagggttggcattctctgatattggtaataatataagtgtcattggttgttaccaaatgaatctatatactcagattttccttttgttcaggttattttatattttaaaaagatccatgttgaggcagatatttatacagaaccaagtgattagaattgtgatgagttgctagctttgtagattgtgctgttattgagaactttgcctttactggttttttacttctcttaatgtacagatctgagaaacagagttgctgtaaaagttcaaatgctgccagataggctaagtggggagaaaaaaacctttagattacctctctcaaagagagtcaccaatattctacagtctctggatatagttttcgagtatacagagggtacaaggttttgcatggacggacgttttcatttctttggcgtgtatacctgggagtagagttgctgggtcataaaataactgaggaattcccaaaatgttttccaaagtgacagaaccatttctcattcccctagtaatgcctgagggtcttcatttctccacatcctctcccacacttgttattatctgccttttttatgatagccatcttcgtgggtgtgaaatggtatttcatcgtggctttgatttgcatttctctgataactaatgatatcaagtatcttttcatgtgcttattggccgtttgtatgtcttctttggagagctatctgttcagattctctgcctattttaaaattgggttgtctttttattactgagttgtaatggttctttatatattctggatatcagtctcttagtacatatttaatttgcaaaattttctccccttcttcagattgtcttttcactttttaaatgctatcctttgaagcgcaaagatttttaattttcatgatgtccagtttactcttttttctgttggtacttgtgttgtatctaagaaaccatttcctcatccaaggtcatgaagaccttctcttcttctgcagtcgagtgagaagtgagcagaactggtgtagggactgcttctactgaagggggtgcaagagagaagacttagccatgtcatccttgatcataaaggtgatcaacactgagaaagcccaagggtacactggtcccttcagtcaagctgcattagttgacgggatcctttacatttcaggagagctaggcatgaacctttcgagtgcacagcttgtgccaagagtgggtaacagaagaagctaaacaggcccttaagaacatgggtgatattttgaaagctgcaggctgtgacttcactaatgtggcaaaaacaactgtttggctagctgacacaaatgacttccgggctgtcaatgtaatctacaaacagtattttaagagtggtttttctactagagctgcttaccatgttgctgctttacccaaaggaggccaggttgaaattgaagcagtagctgttcaaggacctctcacaacagcctgtctataagtgggcccagtgctgtctagtccggaatttttaacgtcttcattgtcacagttgatataacatcttaattaacatcttgatttttataattgatgaaaagtgtaagtttgactaaagtatccaaagttatggaaatactatataatagaattaaacatgaattgaaggttagatggtgaatccagttactgatgttacaaattacacttatgcacacccatatcactgaatgtaggaaagagatactcattacatagttactcaaataacagggaaataacatgtaggaaagatgagttgttgttcctgagaaataatcaagagcatacctaattccaataaattgagtgatgtcatatatttagttatcatgtcaggtatgtgattctggtaattctgcttttactagtttaaaattaaaatatttaaatttgaatggtaggggtaaagaaatagaaaatggaccaaaactttatatagataatatttttctaatggatagaaaatagacatgcagatttaagctttactctttttctaagaatttaatagttttagctcttacatttaagtctatgactcattttgaattaaattttgaacatagtatgaggtaggagtctattttattcttttgcatgtagatattagttgtcccatcactgttggttgaagagacgattcttgcctcattgaattgtcttagcactattctgttcctcttaagttttattttccaggctccctaccattcaagtggtttcccagacattagttttggtgctgaagcttggatattaaagcatctgctcaaaagagactgtttagaccagaagtgactgagatactactaactattaagttcaagttaggattactgccattgtaggtagatgagaggttgtgagagaaattagagagattgtgaggaaaattaagctgttactagaaaaataaaaacagtagcgttttctctggatgtctggaggttggggaagcatattttcaaccctgctttgtgtgcagccttactgatggtaacttggtcacctggagagatttcgtga

SEQ ID NO: 904 - DNA, 143223 bp, Homo sapiens
gatggactgaatagcactttttcaaaaattggctttatgtagactagattctaacatgcaaagaaaatattttgggcggtgggggtggggggacctctagaatttatagctctaaatgtattaggttctcaggccagggagaaaaattcactgttttagagcaatattacttggcaggcaatgttctactggcatcactgcatacgggtacctcaacttctcctacaataaaaccttattaatttgatatcaaagaacaaaaagaaaaattctccaacccccgctggtctttgcatttaccaggtccggcttatctcggcactttcattaaacagtaataaggtgcctcgttggttggggactagcggtagctttgaaatagttgctatttttggccaggcacagtggcttacgcctgtaatcccagcactctgggaggccaaggcgcgcagatcacctgagttcaggagtttgagaccagcttggccaacatggagaaaccctgtctctactgaaaatccaaaaattagccaggcatggtggcaggcacctgtaatctcagctattctggaggctgaggcaggagaatcgcttgaacccgggaggtggaggttgcagtgagccgagattgcaccattgcactccagcctgggcgacaagagcaaaactccgtctcaaaaagaaaaaaaagaaatagttgctactttactttaaattaaccaacattgaaataatgaggttctagtgtaatttgctatgatttaattaactccaactttgtgttgggccttaaacctcttcaccccaatcaagaaatcctaggctgcctgcttgcttcctgagacagtggggcctttctgaaaacccaccttgttttgcttctttgggcagctgtggtgacctcacttttgctcagagctcagcagtgtatggggtagccttttttagaaaacattatttttatttttatttattttttgagacagggtctcactctgttgcccaggctggagtacagtggcccgatcatagctcactacagccttgaactcctgggtacaagtgatcctcctgtctcagcctcccaagtagctgcgactacaggcttgtgccaccatgcccagttaattaaaaaaaaaaaaatttagtagagacaaagtctcactatgttgcccagaccagtcttgaactcccaaactcaagcaatcctcctgcctcgggcttcaaaagtgctgagattaccaccgagaccagtttatttttattttttgagaaaaggtctcgctctgtcacccagactggattgcggcagcatgatcccggctcactgtagcctcaacctcctgggttcaagtgatcctccctccccggcctcccaaaatgctgagattgcaggtgtgagccactgcggccagctggtaaccttttcgtttttttggttttttgcttgccattaccatcaactcaccctgtctaaaaagcagctgtcactctcctcccctactgcgtcccctgcctgacatccagactccagacccccaggctcagaactgctctgttatcttggcttctccttttctcctcaaactgcccaaatgctgcttcctcttccttctcaaggtggctccatatctgtggtccaggctctcacgcttgtgtctgtctccctgccccattactctcctgcagaaaacccttccctagctccccatcgcccaccagcagttgtcactgttccacagggctaggagctggggaaagccattgcaggaagctgtggggtgacgaagaggagatgagggttcctgggccagtgactttgtcctcacctctgctgtgaccagcactgtcctgcttttctcggattcatccaggaagcttctgggtaatatttgatgtggaaacaaaaggtctctgtagctaaaaataccttagaaaacgacagaacttctatagggccagtgctatccagcttaacaatcaagacccggatcaacaagacaaaggccacctctgccttcctctgcttctccttcactccaaaccctctcacctgtggggccctgaaacaccttgtcatgtcccacccttgtgcttggagtagaaagcgctcttctctttctgattccctgtggttgaaggcctggctcagaccccaccacctctgatgtggctgtgttcaccctgactgttcatgctggaaggttctccttccttttttttttcttttggagatggagtctcgctctgtcacccaggctggagtgcagtagcgagatctcagctcactgcaacctctgcctctcgggttcaagcaattctcctgcctcagcctcctgagtagctgggactacaggcgcctgccgccacatccggctaatttttttgtattttttggtagagttggggtttctctgtgttgcccaggctcgttttgaactcctgagctcaggcaatccgcccgcctcagccttccaaagtgctaggattacaggcgtgagccaccacgtccggctggttctccctccttctacaggctcctactcttctccctggccacagctaaccgaaccaagggaccccgatcaagcagaacccctcaaaggtcttttggggcctggtgcggaaacccgtgcttactgcagaatctggaattgagacatggaggctgcaccattggctgagggcggctggtgctggggggcaagggccaggccaagtcacagtcacttgtcagtcagaatctggggtggggggcaggggctgggggaaaactgaggaagctaggcagcagaggaaagagagtgagggggacaaacaaggtagagagagaccctgctcctgaggacggcctggtttccatcaggtcctcacttgtgagaccccctgggcgacttcacagcaaaccttcccttgtacctgagctgctggagaggcctctgttcctgccagcggaaactccaggccatgtctcctggactgacctcgagctcctcaagggcagggattgtgccttactcagctttgattccctgcagcaccaacagggtagggaccgtgcttgtatgagtgtgtttgtgtgtgtgtgtgtgtgagtgtgaaagtgtgtgtgagaggtgacagtgtgtgtgtaagttttccctctctagtagcaggtggaggccagagctacctgccttgaaaatactgtgtatttgagctatactcttgtgcgtgcgcagcttgagcttgggtaggcaatgattcaaaaaccatgggtaccaccaggaggactgtaatcaaaatgacaacaataacaagtgttggcacagatgtggagaaatcgggacccacttacagtgctggtaggaatagaaaatggggcagccgctgtggaatgcagcctgacacttcctcaaaacattaagcatagagctgccatatgaaccagaagttccacgccaggggctgtgcccgagagaaatgatgacacacatccacacaagcacttgtacacaaaagttcatagcagtgttattcacagtagccagaagcagaaacaacccaaatgaccattgctgatggatggataaaccaactgtggtcaatccacacaattgactattatttggcaataaaaacagatgaggtactgattcatgctaccacatcagtgaatcttgaagacactatactaaatgaaaggagccagccacgaaagaccacaaatgattccttttatatgaaaatttcagaataggaaaatctatagagacagaaagtagattagtggttgccagggcctgggaagaggggaggttaaggcatgatgccaacagagtttcttttgagggtgatgaaaatgttctggagttagatggtaatgatggttgtacaaccttgtgaatatactttgaaaaccactgaactgtatactttacaatggtgaattttatagtgtatgcattacattttacctttaaacacaaaaaaccaagggcagctcctatgagttaaggatctaggcagtaagcagcaaccaccactaacatggtaaacagagacacgggaacatgctgtgactcttgttgaggaacagacccacctagggagactggcctaaaaagtgaacctgactgtagtcaggcccctagctccagtacaaatgtacaggaaggacagaggcacagcaatgggctaaatgacaccatggggatgcagtccaaactgcagggaattccattctacaaaccacccagttactttaacagattccaaagtaaaagaaaaccaaaaaaaccaaggggaaaacctatggattcaaagagacttcagagatacaccaaccaattgctgtatgtggaccttctttgatctggagtccaataatccgttaaaaaaataattttggcttttgacaaatttggagatttgaacactagctggatatttgataatactgaaacattattgttaatttatttttattgtgttttctttaaaaaaaccacagtccttatcttttagaattactgaaataaagaaaaaaatgatctgatgcttggaattgatttccaaataatcatgatgaagggaaatgggtggagaaatagaaaaaaatgacatttgctgtaagtagacaattgaagctgggtcacaggtatatggattttttgtatgttctatctacttttgtatatgtttgaaattttccatagctccatatttacttcttattggaaaataaacaagaagagaagaattggaagagagaaatcatgggcaaagtagtagtctgagatggggtgtcaggcctaatgtccatcagctattgccccacaggcctgcattgctaatctgccatctgcctcacggcaccctccccagccatcctgttggcccctcccatgagggagtgctctccatggctgtgccctcttgggcctgacctcacaactgtttctggaggcacaaatttgtctcctgtggctcaagacacgaagaatggatgatcacatatggtcaccaaactttgtggaacagtgattccaaactatggtccttccgacagcagagcaacacaagaagcaaacagctgaggtgtttgagaaaggtcagggaaaaaaagccttcttttttttttttttttttttttttttgagacagagtctcgctctattggcaggctggagtgcagtggcgcgatcttggctcactataacctctgcctgctggattcaagcaattcttctgcctcagcctccctagtagctgggactacaggtgcacaccaccacgcccagctaatttttgtatttttagtagagatagggtttcaccatgttggccaggatggtctcgatctcctgaccttgtgatctgcccgcctcggcctcccaaagtgctgggattacaagggtgagccactgcgcctggccgaaaaagccttcttgactgagagcatgctgcgggttagggaagggagaggttacctctggatcagaggttggagaagaatataattaaaggagtttaaactgaactggagtgacacataaatcatgcgaaatatatgtgaatgtgtttcttaagtaaaattaaaaagtcctccagggggatgtgcttctcccatgctcaaagctgacaaatcttggagatgcctggtgccccaaccaaaggtcatttcccagcctttctctgagaacagagaacacatttctcacggaagcaacattataagtggtggttgggttcccaagatccccatcaaaagtttatttgcccagtttaaaggctgcgcatttgcacctgaagtaggtagggcccttgcaaaggctagcagttggataacattaagttacatgtcaagccagtcaagatatgtgccctgcaatcctcaggagttgcttgtggaattcagaggaggaagggagcatcttccagttaggtggctagggaagcagtgggatttgagctgggcttggagtggtggatacatttcagtgacagtaacaacccctctgtccttcttactcaactttgctaagaaaaattctgaactttacaaattatccttgaatcaggcccagtgagttatgcggaaatgttagagcaagcccaaaccagctgggacagacgtaaatgtgttctggatgtgctgacttgatcataaggtcctcaggtcttcaggatcctgtaagatgaccatcaccacaccacacttcagattccagggccttgcctccctagcctgacatctcacctccacctctgtcaaaatttcagaatcaggttgggtcttatctttgttcttatttttgatgtcccatataaacccttcttcaactgatcttttccaccaggcccataacttctttctttgtttttttttttttttttttagacggagtctcgctctatcaccaggatggagtgcagtggcacgatcttggctcactgcaacctccaccttccgggttcaagcaattctcctgcctcagcctcctgagtagctgggactacaggaaccagccaccacacccagccaattttttgtattttagtagatacagggtttcaccatgttggccaggatggtctcaatatcttgacctcatgatccacccaccttggcctcccaaagtgctgggattacaggcgtgagccaccgtgcccagcctctttctaagccagcatccagaacacagatacaagactcattaggtaggttcaaaaaacaggtctccaatggcttccttatttcaggaagcactgaattaattatttccactcaggaaaagactatgttggagtccattgctgcttctcgatcccaagtgaactccaggaagaagcaaatgaaaagcaatcataggccgggtgcggtggctcgtacctgtaatcacagcactttgggaggccaaggcagatggatcacctgatgtcaggagttcaagaccagcctggccaacatggagaaatcccatctctactaaaaatacaaaaattagccgggtatggtggcaagtgcctgtaattccagctacttgggagactgaggcgagagaatcacttgaacccgggaggcggatgttatagtgagctgagatcgtgccactgcactccagcctgggagacaagagtgaaactctgtctcaataaaaaaaaaagaaagaaaagaaagaaaataaaagcatcgatagtgtatatagatcaaaggaggaagggacattttccttagaataaaactttaataacgaaaacaataaactccctcctttccactcgtagaatagtcaagcactcatttctcatttgcttctcagccatcagctgtcctaatctgttatctattacgctgtgtaacgaaactcgtcccaatctagtagctgaaagcaacaaccatttattatggcacatgtctacatggtggctgggtggttttggtgatttgggcccaggctggctgaatccaggtgggcttgttcagtggtccctggcagttgggttgggggctggcctgtctagcatggcctcaggtaggaagagttggctctgctccacagactgacccgtgcctgttctcttcctctggcaggttagtccaggcttgttctctcagtggagacaggggtcctacgagaagagcagaagcagtaaaggcctcatgaggcctggacttaaaggacacattgccagttccgctatattctgttggccaaagcaggccagccaagatacaagcggggggagaaaatatgctctaccttttaatgaggcattgcaaactcacattgccaagggtgtggatacagaaggtcactagttgtggccatgaatgccatccatctatcagacctgccaacgtagtttttcttttaggggcggacttagtccgatttcagacattagtaaaactgattcggattccatttccaaattcctaattccaagagaactggaaaagcagagcgtgccaacctcttataatccttcttaatgtgacaaatgtttctacagcgtccactgagccaggctcagtaggtccctgggacatatatgaaacaacagttctcctgccctccaggtgctcagcacagcaggagaatcccggctgggaacagagagcaaagcgaccacatagctctagtgggaatcctggggaagtggtatgtggtcttgaatagtgacttagagttttccagaaagagaaggaaggggagttcattctagaggcctggaggatgtaaagatggttgtgttttcatgaaaccgagctgtggacacaaagggcaaggccaaggttgcaaggggccttgcccgactctctgtggagagaggattttattgtgaagggtccacgaagtcaccgcagggcttcagctggatgagtgtgctctgcttggcctgttggaaagattgctggggcagcagggaggtgaagaggaagctaaagatagggtgaccagttgggagactatttccagtccaaatacatcctcttgggtttgagtttctgtgaccgtcctcctgctggctggaactgggaggtcctctggggtctctaaacgctctcagttgcttgcctagagttatgcaagcgggcgtggggtcggggcaggaccaggaagctttgcgctttctgctcttggctgatttcataacaggttagcttttaaacttctggctcattccagacactatgcctctggccctgggagagaacttggtctcccagaccgcgcataacatttccactttccggcaaacacagtctgtgcgtgatcaggtgaggctggcgcacacaaatccttgatgtctagaccgcctttctccagctgctgtgtttactgcagaaaggttccatcctgggatgatcgcctggggggagttttcttcttgcgacacctagttcagctctgctgagcttttggattcccagcctttctcccaccacaacccggtggtcatgaagtctcacaggaagtgtggtaggcacaataatggtccccaaggatgtctaggcccccatccctgcaacctgtaagtgtgttgttacacggccaaggggattgaattaacagatggaatgaaggttgctaatcagctgactttaatacagggaaatgagcctggattatccaggtggggccaatatcatcatcaaggtccttaatagtggaagaggaggcagcagaggagcgcagagtgttgctttgtgagaaggacccgcccagcgttgctggcctttaagatggaggaagggggccgtgtggtaggagtgtgggggcctcaggagggaaggaaattggctctcccaggagcttccagaaaggaatgcacccctgctgacactttgattttggccccagtgagcctcgtgttggactcctggactacggagctgtaagataataaatgtgtgctgttttaagccagtagctttgtggtaattggttacagcaggcatgggaaagcagtgcagggtgtgtgagctgaacccttgaagacggggttctccactacgtccccagtgtggagcacaagctggctctatgcccggtgctcggaagcattttcagaatgaacaggactgactgagatgaagccgcagacatctgctctctccaggcccctatctggctgtgtgaccataggtgggtcccttcactttcagtgactatgttcccatgtctcttaaggcagttgatgacctcaagggtgggtgacttttgaagtgactctcagatgtgttaccactggagccaccgccagatctcctgactctcctctctctgactggtctcattcttagtctaataccatcattctccaatgctaaggtcattaattagcaccccaggccctcactgactctgctctcaccctgtctctggggctccctgcctacaggttcactgcggaggtcatggtagacgttgctgcccagaacctccaaccgtaggaaacctctcctccttattctcagccatgaagtgtgggagcaaaactgctacacagttttgctcagggtcagacgctgggacatccccagggcctgtaatgctggtctcaccagagctttgactgtgaatgctgcttttcctcatagcagtgtgtggcccctaaggtcccctattcaatgaccagggacaatcatcaaatcaatgcaaagagaaaatgaagccttgtgtttctatctaacgggtgagctacactggaagtataagaagtacttatggggaaatctgctttcctgactcttacttctgtttccagagggtgatataatgtgtgtaaatgcagattcagcttcgaggaaactttcgtctaataatgaactgaaccacattatggcatgctatctccaaggtatgatagtatctgttatactcatggggtccaaattttctttagcttagaggttattctactttagagcaggagttctctattttggccacccactaagaatcactcgaggggagtatttaaaaatccaagccaggctgcactctagagccacagaatcactgggctgaaacagttccccaggtgacgctgatgtgcagcgcgggttgagaaccactccactgccttagctaacactggctactcttgcctttgcctttgctatttacaaaaacaattattttttagtatctaaaggccaacatcaataaacccttacttgttatactagaagatgctctgtcctcattgacctgagtcccatcttagtggggcttattataatgacccaggcacgtgagtctcatgcaaaccagtggggcaggctcttgggagcagtggcttctgcattatgcctggaatgcaggaatacatggggatcagtccgactgacaaatgcaactcacccaaagtgactatgaatgactgcaagggcatctgggtacagcagtgggactgtagttcaggtcagggatctggtctctggtgttggccctgggcagggagggagctctaacaggaaccgaggcacccagtgtggtacctgcagtttccctgacccccactgcaatccttcacccccgggctccccttggtttccctgcctcacccacagtcattggcctcagctggtaaagggcagcttgagccagtgcgtcctcggagcgttagtcccagccagtttttgctgactcctctcccttcccagctgccatggcaagtgggtgcccagtcccacagcagcctctctttcctaagtaaaatcccacgccccgtggctaactgttcacaacctgaaggaagaaatgttctactttcaaaggaaaaacagccctccttccatgtagctcgccagctgcccaccgctagccaggtgtcgcttgcaatccatggacaccgttcccgtagcaaccccaggtgactgtcacagctgcccctgacacaaactgctttagcaaaggggtgtcaaaaaatattttaaaaacaagttttaaacacaatttttagggagaaatcaagagggttctcaactgaggtaattgaccgacttggtgggggttcagtccatgaatgtagcttcactcttgtggctattaatggcagggaggtggggggacagttggtataaaggcaatgagactacatatcaagatggaagggggcatcctaggcttggcatggtatttggaaaccttgactagccttttatgcccaatgctgtttggaaatcttgctgggaatcacagaagctatagatgcttaatggtgtcagcactgatatgcgccaccatcagcttgaattacatattaaccacccatctgcatttaatccctatacctggccatcttctgatgagacgagctatttcctctctctcctctcttgtactctccagtggataagtgagtttctctccatgccttctctggagtgggctgtttcgcccactggagggggattctcaaggtctccaccactccttggaaaaatggggtgaggactccagggctgggaaagggaaagtgtaagatgatcctgaaccagcttatggtgcctggaagtaaggaaatgctagaaaaatggtgagaacatgtcagaagatcacaggagccagcttgaaagggctcaaaacagccaaacctagggaatctgagcaataagagaaataataacagtggattgtgacctgtagagtacaatggatgtattctgctaagtgagagaagccagaccccaaagtctacatactcaaatccacttatatgacattctggaaaaggcaaaactataaggacaaaaaccagatcagtggttgccaaaaataggaggtgtgggggggttgattaagctgtatgagggattttgggggctgatgcagctgttctgttgcatgactgtggtgtagatacatgactctacattgtcaaaactcatagaactgcaaactacagagagtgaattttactgaatgtaaattttaaaaaattaagatgtttgggagccccaaatggaacccaattacaaataaacccaaccaggctgggcatggtggctcacacaggtaatcctagcactttgggaggccgaggtgggcagattgcctgagcccaggagtttgagaccagcctggggaacatagcaaaatcccgtctctacaaaaaatacaaaattagccaggcatggtggcgcatgcctgcagtcctagctactcagggactgaggcgagaggatcacttaagcctaggagattgaggctgcaatgagctgagatcatgccactacattccatacattccagcctcaatgacagagtgagtccctgtctcttagaaataaaaaaaaacaaaagaacccaaccataatacagatgaataacataaccacactgaagggggtagggaagaaaagaaccaacctgagtacccagggaaaatagggttttgacttgatacacaaatactgtatggttaatacacttctcatgggcggggggtggaggttaggaattctgcaactactttctgtgtatactaaagctgaaaaaataggtacagctgacccttcaacaacacaagcttaaacttcaagggtgcacttatccaaggattgtctttcacttctgccaccctcgaggtagcaagaccaacccctcttctttctcctcctcagcctactcagtgtaaagacgatgaggatgaagacctttaggatgaccaccttctacttaatgaacagtaaatatattttctcttttttatgattttcttaagaacatttcattttctctaactgtattttaagaatatgtaataaatacatgcaaatcaacttatcagtaaggcttctagtcaacagtatgctattagtattaatagttaagtttatggggagtcaaaagttatatgtagatttttagccaggtgtggtggtgcgtgcctatagtcctatctactgggaggctgaagcaggaggattgcttaagctgaggagtttgaggctgccatgagctatgattgtgccactgcactccagcctggacaacagtgcaagactctattaaaaatttttttttaaattatctgtggttttttgattccacataggagtggcatcccaaccctcacattattcaagggtcatctgtaaatgcattaaagatgttgagagccaggtttctcaccgccaaagaagttacaaataagaggaaggggggctacaatgaaccctgtcatgttggattggaatctgagctatcacagtatgaatttgttttttaacattttatgtatatacagttacagaaatatagatgtgcatggcttagtatacatatgtattatttcaagctctgttctctatgaggccctagaagcaatgacatccagtgacaataaacacactcagtgcccagatttttgtttctaaataaaaggaaccaggcctccctggagcagtgattgattccaggctcctaggcagggaaaacacaagaagagcctggaacatcttgaaatgcaagaaagtaaggaagtgctcatgaaaggatggggcaggtcacaagtgtgcaggagccaacctgaaagagctccccgtggccaagctgggacaatttgagcaataaaataatgatggtattataatccataaaataaatatccatgagtccatactcatataaacaagcaaacaaatagatgagaaaggacagtaattctccagatagaatttcaattacttataataataaatgaggaaatcatgataattaatgagggaaataaaaaatcaccattaggcaaacactacagtaataattattacaggcacaatctactaatagatgttaagatgactgggcaaaaatttgaggtgaatcaggatatttgcatagccttaaactatctctcccaagatatttattaattacaaaggtaaaaatagtaactttacagtgaagaaacccagcagacacaactttaaccaggcgaccaaggttaacatcaccagtggcaggacatagcagcatcctatcccactaacaatatgcattgagggtttattaccttggtgatattcttcgaaggatggataacctacatttaatcttgagaaaacatcagataaactccaaatgagggagattctacaaagtaactgaccagtactcctcaaaaatgtcaagatcatgaaagacaaggaaagatagaggaactatcacagatgggagaagaccacagacctgaccactaagtgcagtgtgggatcctgagtggctcctgaagaagaaagcagaagttagataactagatagacaattagtgacaatttaataagctctgtcagttatatagtagtattgcctttatgttaatttcctgatttttttttttttttgagacggagtctggctgttacccaagctggatgtggtggcaccatcttggcttactgcaacctccacctcctgaattcaagcgattctcctgcctcagcctcccgagtagctgggattacaggtgcgtgccaccatgcccagctaatttctgtatttttagtagagatggggtttcaccctgttggccaggctggtctcaaactcctgatctcaagtgatctggctgtcttggcctcccaaagtgctgggattacaggcgtgagccactgcgcccgaccagtttcctgattttgatctttgtactttgggtgatgtaagatgtcaacacttgggagatttgggtgaaggattatgggaattctttatactacttttccaaatttttttcaagtctgaaatcatttcaagatgaaaagttgaaaaaaatcgagggtcagaaagtacatagtatgcttcttttccataagaatattagagaaataagtatttatattttattttaatttgcttgtatttgcttacaaaagcactggaaagataaatgagaaattaataaaaactgttacttatgggcgaccagatgaggaatgggtggatggggcagagtgagagtgaggcttctctgtgtacacctttttaaattatgtaaatgtactatctatcctctgtctcaaaaaccaaaaccccaaaaaactaaatcaccttatagttcataaaggcaaagatattttatttcatagtttctcacaatgaaataaatagtaattatcctatgaggtagttactattattatatcattaccattttagacatgagtaaatgagggcatatatgtataaataacttattcaaagtcattagctaatgaggccgggcacagtggctcaggcctgtaatcctagcactttgggaggccgaggtgggcagatcacttgaggacagaagtttgagaccagcctgggcaatatgatgaaacctagtctctactaaaaatacaaaattagctgggcatgatggcaggtgcctgtaatcccagctacttggaaggctgaggcaggagaatcgcttgaacctgggagatggaagatggaggttgcactgagccgagattgtgcattgcactctaacctgggcagcagagcaaaacttcctctcagaaaacaaaaacaaaaaaacagtcattagctaatgagaccccagaacctgcacagggagattaccaacagggaaagcagatttcagaaaatgcagcctggccaacatggtgaaacctcatctctactaaaaatacaaaaattagctgggtgtggtggtgtgtgtgcctgtagtcccagctacttgggaggctgaggcaggagcatcgcttgaacctgggaggcagaggttgcagtgggctgagatggcgccactgcactctagcctgggtgacagaacttttgggaggccaaagtgggcagatcacttgaggtcaggagttagagaccagcctgggcaacatggtgaaaccccatctctactaaaatacaaaaattagccgggtgtggtggcactggcatgcaatcccagctactcgggaagctgaagcaggataattgcttgaacttgggaggtggaggttgcagtgagccaagattgcatcattgcactccagcctgggaggcagagcgagactctgtctccaaaaaaaaaaaaaaaaaaaaaaaaaattcagaaaatggtatggaaaagaaaggcatggtcctatggccagagacttgaaagggagttccagaagaaagaaaacttcccactgtcttagtcagcttaagactttgtggcttaaacaacagacatttatttctcatgcttctggaacctgggaagtccaagaccagggtgctggaagactcaatccttgataaggtcccactttttggcttttagtcagctgcgttcttgctgtatcctcatgtgactcagacactggtttcctcttcttataaggacactaatcccatcatgagggccctaccctcatgacctcatcgaaacctaaggacctcccaaaggccctgcctcttaatcctatctcattgaaggttaggccttcaacagatgaatttttggaggacacattcagtccataacacttcccaccccccaacacacaaacttttaaaaatctgtgttaagtatgtactttgtgctgtaaagtgctatgggttttttgtttttgtttcatttctgttatccaggctgaaggcagtggcactatctcacctcactgcaacctctgcctcctaggttcaagcaattttcccacctcagcctcctgagtagctgggactacaggcacgcaccaccatgcctggctaattttttgtatttttagtagagacagggtttcgccatgttggtcaggctggtctcaaattcctgacctcaggtgattggcccgcctcggcctcccaaagtgctgggattacaggtgtgatccctcatgccaggccaaaccatgaatcttttatctttctctatagttttgtcttttctagaatgacacattattgaagccatacgatttgtagtcttttcaggctggcttctttcacttagcgacatgcatctaaggttcctttatgtcttttccatagtttgatggctcatttatttttaatgctgaataatattacattgtatggacatgccataccatagttcatttgtgttttattttatttatatatatatattttttgagacagaggctcactctgtcacccaggctggagtgcagtggcgcgatcttttttttttttgagacagagggcacgatctcgactcactgcaacctctgcctcctgggttcaagtgattctcctgtctcaattccccaagtagctgggattacaggagcatgccaccatgcccggctaatttttatatttttaatagagatggggttttgccatgttgcccaggctggtcttgaactcctggcctcaagtaatccacctgccttggcctcccaaagtgttgggattacaggcatgagccactgcacccggccttagattacttttataataaaaaaataaatgcattatatgcacaagaatcgtgcttgaacctgggaggcagaggttgcagtgagctgagatcacgccactgcactccagcgtgtgtgacagaccaagactctgtctcaaaaacaaaaacaaacaaacagaaaaccaactatgaaaaagagagttagccctataggcatgtgtgatatatcgcaatgcataagcatacaggctctggaattggacaaacctagatttgaatagtagccctgtcacttattagccgtgggcaaattctataatctcgatgtgccactctcctccttgcaccatgggtttaaccacattgcctgggctactgtgcggattggatgagatgatgcatgtggagtcagcaagatgcctgtcactccccctccctcccaggtcttcactgatgaaagcaggtatcaaagtcaagcagatggaaatgaaactggcaattttattattggtggagttattggagaacaataggaatatttcaaaaaaaatgatgcctgcgtcaacataaaagcattttcaacaaattgtgttataatatccaggtctgcataagaagttttttttaacctacatgtatcttaatacttctttgttggtgcctctccattagttcatttgaataagagaaaaatgtcaaaatattttggtaatttttatagatttcataaggggagtttgtcattagtttgtgtggattttttttttttttttctggctgtggatgctttgaatggtagaagactgaagggaagggaagtgtggtgaggtggggcttgaacaagatactacatgttataagtgattttctgaatttctttttttaaaataagctaatttgtaatattttataactagatggttttattagatgctcataaggtctcaaacgtgcactaatgctcagattttacatttccatcagccagaaacctgttttttatttttttatttttggacagagtcttgctctgtggcccaggctggagtatagtggcgtgatctcagcttactgcaacctccacctcctgggttcaagcgattcttctgcctcagcctcccaagtagctggaattataggcacgtgccaccacgcctggctaatttttgtatttttagtagagacgagatttcaccatcttggccaggctggacttgaactcctgacctcgtgatctgcctgcctcggcctcccaaagtgttgggattacaggcgtgagctactgcgcccggcctagaaaactttttttaataaaaataaataatctcctttcttccttttgtcatatgtatgtgtacacacataaaatcaaaatcataaccacaatgtttttcttttcattttttgtttttctctacaacctgggcccaggagctccttcatctttttttttttttttaattgtggtaaaatctgcataacataaaatgtaccagctaatctattattaagcatacagttcagtgcattgagtacatttacagcgttgtgtaaccaccatcaccatccatctccagaaagatttcatcaacacaccatgtttcaaacttctcgattttataaagtgcctctcattcaaatagtaacagctgaagaaaaaaatgcaggtaccatgcaacatctgacttctcagctgccacactcagaagtaacaaagaacccccttttgaaaatctcttcccattttatctttctttacaactccatagcaatgttgttttatgcaaacaaaatgtaaaacagagaacaaatagtttgtcccctgctgctatataaaaaccaaagtttgtaacaaggtaactattttatagccctccaagctcaataaaagtacattcttcctgttgtgttctatcttttgggcaggtatgtaattaagatagatggtgtgtgatcctaagaactcccttaccggagcatgttctggccaaattcagtgtgttacattatactgttcctttatatgtcccttagtattatacttcttagctgtccacatcatatccaatataggtcactttccttcctaaaatgttttctaccatttttatatctactgagggcgttataattctgagatatctgaattttattgctgaatggttaaatctttttctggtgtgaattcattaaggtgctgaaacataaattgtactatgtttgtgggagttatctttcactttttctttgttttctgcaaattttttaatcctctgaaaataggccaggccaccttatcagtgcgaggtatccagagctccactctcttctgagcttaagaatgttctagaatattgtaaggggggaatggagtactcaggagcaggagagagggaatgtgcaaaatctctgggcacaagtgggtgttcccctcccagctggtaaccaggtgatgggctgactgcagggaagggaaggcctcgtccaggaagggacagctggtgcagcctgcggcagtctagtagaggccacgggctcctacttgcgccttcgtgctgggaaaccggatttttttccttcttcatgttttaagggcttcttcagcacagctttgccccaccacctccacagtcttctctccccctagtctggaataagatgttctagtccctcaaatcaaatcccacatgtaagcctcacatttccccaacttttacctaggactgcagacctccaagcccagaggctttggaaacaatcttcaactgctttctctctgctttccaccctgtgtccccctgcaggcagcttgcaaagagcagaggcttggaaaggagaagtggggcaggaagcgcagaaagtgcaggattctgcggttagcatttcaaaaacattgcccttctctgatataaagaagtggattttctctgatagaaagaaaacacagtcaagtcctatgcttggaatattgatctgtagaacagtggcccatctccagcctcaaaggctagtcttaaaagaaaaaggagaaaaaaaaagcaataggagagtttgctgctgcgaagcttaaggtcctatgaggaaaatactattagagccaggagcacaattctggctgcaattagagtcacctgggagaactttaaaaaaatgccaaaaatagaatgcctgggcctcgcccctggagactttgatttaattggtcttgagtgggcccccaagcaaagctttttttttttttttttttttgagacggagtctcactctgtcgcccaggctggagtgcgttggcgcgatctcggctcactgcaagctccgccttccgggttcacgccattctcctgcctcagcctcccgagtagctgggactacaggctcccaccaccacgcccggctaattttttgtatttttagtagagacggggtttcactgtgttagccaggatggtctgatctcctgaccttgtgatccgcccgcctcggcctccaaaagtgctgggattacaggcgtaagccaccgcgcccagcccagcaaagctatttttaaacgttccccaggtactgagtgtagggcagaaacccacgttatgttagcagggcccactcatcctataggcatagcaggcacagcacttgggcccaccatacttccaggacccacagaaaagttcaatttcttttagaatcagaagaaaaagaataaacttttaggtggaagaaaatgacttcatatataatattaacatgtatttctttatatcaatgaattcataaaatacaattttgggggctaggtttggtggctcatccctgtaatcccaggattttaggaggccaaggaaggaggattgcttgaggccagaagtttgagacccacctgggtaacatagcgacaccccgtctctaaaaaataaatttaaaaataaaataaaattacaattttttttaaatggggaaagagatccacaagtcagaagtgcatacggcctacaaaagccataatgcagccctatataaaagagacacgtggaggccaggtgcatgtggctcatgcctgtaatcccagcactttgggaagccaaggtgagcagacacttgaggtcaggagttggagaccagcctggccaacatggtgaaaccctgtctctactaaaaatacaaaaattagtcgggcatggtggcgtgtgcctttaatcctagctatgtgggaggctaaggcaggagaattgcttgaacccagaaggcagagtttgtagtgagccgagatagtgtcactgcactccagcttgggcaatagagtgagactccatctcaaaaaaaaaaataaagaaagaaagaaaaaagcccggtcgcggtggctcatgcctgtaatcccagcactttgggaggctgaggtgggcggatcacctgaggtcaggagttcaagacccgcctgaccaatatggtgaaaccccgtttctactaaaatacaaaaattagctgggcacggtggcaggcgcctgtagtcccagctacttgggaggctgaggcaggagaattgctcgaacccgggaggtggaggttgcagtgagcctgggatcgtgccattgcactccagcctgggcaacagagcgagactcggtctcaaaagaaaaaaacaaaaacaaaaaacacatgtaagggtacatctttgaatattactaaaaataattattcagttcacattaacacagcattgaaatacaccaatgatgtgtacaccttgcgctggcaatgattcctaatttttcccttatcattcccctatccactgcaagtggttcaaggtaggctccatcctgcttcaataagctacttataaattttgctgtgttgccaactcagacgtttttgagcgtctagtctttcatccaaacacacagtgcctttcttttcatttttgttttgtttttgttttttagagatgggagggtcttgctttgtcacccaggcaggaatgcggtggtaccattttggctcactgcagccttgaattcctggctcaagggatcctcccacttcagcctcctgagtagctgggatgaaaggcacgcaccagcatgctcagttaattttaaaagtttttttttttttttttttttttttgtagagacagggtctcgctttgttccccaggctgatcttgaactcctgggctcaagtgaacctcctgcctcagcctcccaaagtgctgggattacaggcgtgagccgccatgcctagcctctggtggctttctaatgtttgattccgagatgctcacctcagttcctgagatttcagagacacagtggattggaggcctcagagaaaaggaagcattggccctaagaggtatggagcgaatccagagcctcctcaatgtgagccttttcccctgggctttgctggcctctgtcgccccagctcagttccctcctggctcctctggcaggcagagcttcctaaggttgagttacaaaaaccaccgtggtcactctcacttttccccttttccaaacagatacccatatttgaaaagtcatcttcttcatattggcacaaactccagagttctcctggcaagggaaaggcatgtggacgccaatctccatgtccttgaatttcatggaagggaactcatgttgagggagactgaggtatcaggcaggaaagaacaggtcaatactcattccaccggcaccgggtggggcttggaaaagccagtcacctgcacttgctggttgcaagactaaagcacacagatggagactcacaggaaaatcactcatctgaaaactctctgtggctgccagaggctctgatgtcccttggctccgggtaggagctgtcaaggagaaagccaactgtggtctgaaatgagggaagcaaggcttgggataatgatcccttagatgccttctggtttgaggtcttatgactcttcagcaaagctctggttctgacagacccaggtctcaatctctgcttctctatttatttatcaagaataaataaatttatacattttatttatccgtaaattggagataagaacatgtacctcatgggttgttctgaaatttatttttattttttaaattaatttatttttgagatggggtctcagttctgtctcctaggccggagtgcagcagtgtgatcatagcccactgcaacctccacctcctgggctcaagcaagcctcccacttcagcctcctgggtagctgggaccacaggtgtgtaccacaagcctggctaatttttgtattttttgtagagatggggtttcaccgtgttgctcaggcttgttctgaaatttaaatgttgagtgtggaattcttcaaattgcccaagaaatccaagttccctcttgtaatcactgtcaccttgactgtagggctaaaagcggaaggaatcgccagtttgttgacttcagcctgctcttgggcagaccagctcaaaaacccttacatgaaagttttatgaaaataaattgtactacttctgcaagactaaatttgagttttcattatttcagccctgccaccaaatagtcccagcttgctacttttgctttagacatatccaagaaaaatgtgttctgaaaggtgaaatcccttgctagaaggctttggcagtcagaaatgagcaaaaatgcagaatttttttttttttttttttttgagacggagtattgttctgtcacccaggctggagtgcagtggtgtgatctcggctcaccacaatctctgtttcccaggttcaagcaatcctcctccctcagcctcctgagtagctgggattacaggcgcgtgccaccacacccagctaatttttgtatttttagtaaagatggggtttcgccatgttggccaggctggtcttgaactcctgacttcaggtgatctgcccacctcggcctcccagagtgctgggattacaggcatgagccaccgtgcccggcctaaaaatgcagaattttaaaacatttgtactggtgttttttggtctcatttgttgcccaattggtctgaatataatctgacaatatgtcactcaagatcaactataaccaaataattcaagccaaagaatggttgattaatttgctacaaataaaatgtggtccacagagtcaaaactttttaaatgtttcaaggtttttttttttttttaaatttctttttttctgagacagggtctcgctctgtcgtccaggctggaatgcagtgacacaatcatagtttattgtagccccgaccttatgggctcaggtcatcttcccacctcagcctcctgagtagctgggactacaggcgcgagccatcatgcctgacaaatttttttgtattttctgtagagatgaggtttcactatcttgcccaagctggtcctaaactcctgagctcaagtgatctgccctcctcggcctcccaaagtgctgagattataggcgtgaaccactgtgcctggctaaggttttgtttttaatcttggaattggagctatcctgactttgcccaaagcatggttcgaaagggacttttcgatttggagttgtttcaacataatcaaggacacattcccaataacatttagtacatgcatgtttattgaattagtattagttggtgttttggggatggctgaggggatggtgagtgtaaacttgccttgtttctggaaaattcctccttccactggtcagcagagctttgacattcctacactaagttcttcagtctccaagacaggcagtccaagcttctagaaactcaagccatgcttggatccaaccagggtccaaccgaccacaaaatgtatctaaaatacttttgactatgctggatccctctaatgttgctattggttctctcttgatttttcatttaccttgcacgttgaagtaactgtgggaagaaatctgtgttccccttaggggaaatactggaggattagcatggagtcaaactcaagctattagatgtttttctcttactgagaaacttcactcctctatcaacatttccaccatataatggggtatactacctttagagcgaattaaaaaaagtaatagtttatcttcttgtctctcccatggaataaggatgtgcaatagcatactgggtttcattgccttcctccatactatacacatacacagtgacttttccaaaggctacttaggaccatttattttgttttgttttgttttttttattttgttttgttttgttttttttagatggagtttcactctgtcacccaggctggagtgcaatggtgcgatctcagctcactgcaacctctgtctcccgggttcaagtgattctcctgcctcagcctcctgagtagctgggattcaggcacatgccaccatgcccggctaattttgtatttgtagtagagatggggtttcaccatgttggccagactggtctcaaactcctgacctcaggtgatctgcccgcctcggcctcccaaagtgctgggattacaggcaggagccaccgtgccctgccgaaccatttactgttttttgttttgttttgttttgtttggtgagatggagatttactcttgttgcccaggctggagtgcaatggcgcgatctcggctcaccgcatgctccgcctcccaggttcaagcgattctgctgcctcagcctcccgagtagctgggattaaatcatgtgtcaccacgcccggctaattttgtatttttagtagagacggggtttcaccatgttgcccaggctgatctcaaactcctgacctcaggtggtctgcccgcctcggcctcccaaagtgctgggattacaggcgtgagccactgcgccctgtcatttattgttaattaggtctcacctcttctgctatgaggtcaataaatatcacctgtctttgcaggtccagggatccaggctacacgttactagtcaaaggccatggggcaagtctttattggagatcagatgggctgggtcagtctggcctggccacaagaagtgagcctcacctcaaaacctgttccacaatggcatttcctgactggctatgtgtgtgtgcactgactagcatgtgctcattcattcatcaaacatttactgaacacctgctatgtgctagtggctagagactcagggaggaatctgacccattcccttcagttaagaaactcagtgtgtgggagggctgaattataagtaagtaggtgctatgataaaacaccccacaaggcagaaagggaggatgaaggaggaggatttcttagaggaggagggacttaagctaaaccttgaaagagcaagacggaagggtgttttagatgaaggaaccttgacagcaggcccagagtgtggatggctggctaggggcatagccctctcattgacttatctgccagtcagggccagattttgagggcttgccacaccttgccaaggggtttgattctttttccgtaggcctagcaagtttgcctgcccaaggggctctagaagttcaaacggaaacttaatatgattgtttgatgtattaagtctcttccctcaacacttgtaggagtgaacactttgaaaagtgaacagtttaagactgagattcttcacttcatgtgggaagtgtgcaaagtccaaaaatgagattgagcacccaaggaattagtctcccctctgctcctgctcagagccagaccttgttggagaggacacagctgggtctcactggaggggaaagaagtttctatggcgtcatgcccatggaacctactggtaatctgacctctggggttctggggaaagctgtttatggggaagcagagttttggtagagttgctccaccacacaacagcttggagtagagggatagtgccaggagaggctgctggctgtggaatgatgtaggcaccaggtcctgaaggagtcctggcacagcaggggcagagcttgaaaccatgtgcactgcagcagccgggaggtgcagaagctataggtgctgggagagctccctggaagctcagatcaactttgtgctgacagctttccatcacaagtgagcacttttgttccaaggagccctctcagcatgggaggtgggtagcctagaagtaggggtaaggcatgtaggagcggtctttgctggagacttggaaaaatactccagctacctgagcttcaggttgtcaattctggggggcattcagcatcttcccaggaggtcccaggggaatcaggccccctgcatatagcaccagtctcattaacacaccctaatactggcctttcctccttgcctgtcgcactcttcctgcttcctctctccggcttctagggatcaccctaaatacaccaccagcaggcaagtcttgtcacaggctcctccttcagggcaacccgtattaaggcagcctgtttcccaatgactccaagcaaaagccctcttcccaggtgcccttcccaatcccatcttgcttcacaagcggaatagcttttccacttcaatcaaataaaccgtgtattattttttgttttgttcacttcctcctgtttccctgtctcgggtgtatgaccacaccttccagaaatgccctccgcactctttctgttatccatgtgcattacatcttcttctttttcttttttcttttctttttttttttttttttgagatgaagtctcactctgtcactcaggctggagtgcgatcacgtgatcttggctcactgcaacctccgcctcctgggttcaagtgattctcctgtctctgcctcccgagtagctgggattacaggcgtgcaccaccacgcccggctaatttttttgtatttttagtacagatagggttttaccatgttggccagggtaatctcaaactcctgacctcaagtgatccacccatcttggccttccaaagtgctgggattacatgtgtgatccaccacgcctggccttgcattacgtcttccaagtgcacgccataagacctattccatgctgcagcctcccttctgtcactcttcctatattctgtgtcactactcaaatgtcatttatactgtagcacttatgtgaatatttttgtatcatgtattttatgtacagaaaatttggaggagaaaagaggtgatttttctctactcatcctcctggaaacttctctttggcaagttgctgccactgaccccgctcttcctccccttaatcgttctactggctcaaaaaccataattaagggagccagacttacattaaataaaaaaaaagacaaaaatgtttttcagaagcattccctggaaatgtttgctttaagttgaggttggtggggcttgagcattcatcttgacaataagagcaacgaaagcagtatctctggtagctgatctctctcacctctgtctttacctccaatgactcctcttatttttgtcatcagcaaaatatctgtatgggaggggaaattgctgatgaaatgcttttttgacagttaacaaatatttcctgagtgcacactctctacagatccttggaagggcccatgtgagaagtggattcgtgacattcggcactgccctctccttcaggagtccctcacccttgggcttccgtcaaagactcctgggttcttcccaacagctctcagttaccctcctctttctcccttgggtgatgccctctgcttcctccaccctcagtgaaggcactgcactctcctttcctggctcctggtcctcactctcccctcaccctccacatggatgctgcccagagacactcctccacttcccagctgcctgctggggcatttccactgaaaagttccaccattacttcatgctccatggaaccttcaggagctctcctgaaaagcagcctctttccatattgttcctatttctgatgctccaaggcacccagcctggaagcctcagctttgcctttgccagttccactccctcattgcacacatctggtcaccaagacatctggtcttccaaacaagagcccttcccttcccttttcccttcccttcccttcccttttcccttcccttccccttttccttccctgtgcttcccttccccttctccttcccttccccttctcctgccttccctccctccctcctttctctttttcttcccttccctttttccttcccttccttttccctcccttccccgtttccttcccttcccttccctttttccttcccttcccctttttcttcccttccccttttccttaccttctgcttttccttcccttccccttctctctctccttccttccttcattagttccttccttccttccttccctccctcccttccttccttctctccctccctccctccctctctcctttctctctttcttttcttttctttctttttttgagacaatttcattctgttgcccaggctggagtccactggggcagtcacagctcactgcaacctcaacctcccaggatcagttgatcctcccacctcagcctcctgagtagctggaactacaggcacatgctaccatgcctggctaatttgtgtgtgtgtgtgtgtgtgtgtgtgtgtgtgtgtgtgtgtgtgtgtgtgtgtatgcgctttttttctttttctttttcttttttttttggtagagacagttttcgccatgttgcccaggctggtcttgaattcctgtgctcaggtgatccactgccttggcctcccaaagtgttgggattacaggcataagccactgcacccagttggaaaattctttcctgtccctccctgctgcaactccccatctaccccatgactctgctggttcctaggccatgggtctcccccatctggttcccagggccatttaggtgccctctattgcatgcaggttccattctagtcattttgaggtgtccaagtactgtttggttgccttgagccccctcactttggcatttgatgccttttccaccctctgaccccatccacctttctagtatgcctcatcccattttctagcatgtgtgtcctgccccaggcagcctctgctcaggaaagctggtccaccctctgggcactgttcacacaccccatcaccttggctgtcttccccaacctagacctgctaactctggaatagtgcaataccgcttcctccaaaaagactcccttgaccatgctgcccacttgggataagtagcatctttttttttttttctttctttcctggcaatgaatcactattattaggtcggagcaaaagtaactgtggcttttcccattgaaagtaatagcaaaactgcaattacttttgcaccaacctattactttttcaagtccttttatattgttttgaattgttaagttttcaagggtctatttcattcaatatgtcagcaaacatgtattaagtacaggttgggcagggcgcagtggctcacatctgtaatcccagcactttgggaggccgaggcgggtagattacttaaggtcaggagttcgagaccagcctgaccaacgtggtgaaaccccgtctctactaaaaacacaaaaattagccgcgcgtagtggtggccacctgtagtcccagctactcgggaggctgaggcacgagaatcgcttgaacccgggaggcagaggcaatgagccgagatcgcgctactgcactccagcctgggcaaaacagcaagactccatctccaaaaaaaaaaaaaaaaaaaaaaagtacaggttgttgttttctcagggaatcctcatagctggtgaagtatccagcttttcattttacggatgagtgaactggggtttagaactgataacattttgcccaagttctcacagctagcgagaggcgtgccgcagtttatcgtggggtgggtctaaacaaggacctaaaaactgtattcgaatcccagccctactaccgccagctgtgtgaccttacgaggcgcctcactttactgtttctccaacagagacagacatttcttgttaccgcgcaagtgggataacctccccaccagtgtctagacacagtaggtgctcaataaataggtgtgggtttgcggtggcagaagagcgctatcccttaagtttctgacagtgagggggaaaaaggctaagcagggaaaggaagggaaaggggtaaactgagctcggcgcagtcgagagcgcgaaatagggagggcttcctgcaggccaggaatttggagaggccgaggctgggagaagaaaaatgcccggtgacggcggaggggaggtggaaggacgaacggctccgggaaggggtgaggtctaagcgcagccccgggcccagcggagccgagggcgggtggtgcgggggttcctgggtaggttcgtcccgacgggccgcgggcggattgaagggagggttgggcccgccggcagccccggcgggtccaggcccccggccagcccctgcccctcctcccaggagggcgggcggcgactgcggggcggggcgcgggctcgctcggcctcccggcggcgccgcggcccttgcactccggccgggctctgctggctgcggcgggagctggacgcgggaggaggcggcggcggcggtgagtgagctccgggctggagcggggcggggtgtgcgccggcagccgggtttcggggtgctaggggccgcccagggcggcgggacccccaggggttcgggctcagccaggtgcactgtgctcagtccgcgcgtccactctcggtgacccgcgccgcgcgtgtcctggggctcgaagatgcgacccggactcccgcgccgcgccccgccgagggcaggcgcagaacagatgcgggcgatccctggggaacccgcttcggggcggggtgggagggaggaggccctgcagaacctccctttagtgaagagggactttctgccttcgcacccctgcctggaccctccggctctagtgacagctgggagagactcacacgaagcagtttctgacctatcctgtcgtacacaagtcctcggcgtgctcggccggaccatcccctggaaagaaaggggcgtgtgacctttctctccccgatcctccagaccactgcgccgcccagggaggtcatccccgagagagcccccgcctcactcggagcacacattctagctctccccgggacttttccaagttgcatcactgtttggcctctagacaggtacttggctgtcatgttggagttagttacacaggatttttgaaactttgtatatttgctttgtgtgttcttcaccctaaggccgctgccctcccgactctgcttatgccgctcaaaacgttgctcaaagctcgctgggaatgcttttgcgggcattggttctcaaacttggccccacatctggagagttttaaaaaatactggtgcctgtgtcccactcccagagatctggattcggcttgcctgggttgcagcctggacaatggaatttttaagacgccgcaggtgattctaatgtgcaggcaagtttgaaaacctctgctttgagagttgctcccaccagccactcttcggacggctcaagatcagtcctgatctagaactcatctcaggtcctcatagctcttccctaatccacctctccacctgaagaacctgttgattggtgctttccaactttagacagtagatggtgcctttactgaagatccctttgtttctacctctctgtttacagtcaatactgccagggcactttctgccaaggaggtgggagtgtaggcattagaaccgagcagtccttgtcagggtcaaggttataatacagggttgtcctattcagggaaaaccaagtgataatttgacttgtcatattcgggaatgatttcagattaaaaggagaaaaaatactttagggtttggtcagcttttggagaccctccggagactcccccacgtagataatggagttgcataaatgtggagaattttccttcaaaaagccaaagctaacaacatccttaaggttttgtggttgatatttgtgttaacataagtccatttttgtagattaaacttattctggaagtatgatgaagccctgcagacagaacacagtgtataacatggcacatctgagatgacacctgagacacctgtcacatggtcttaaaaatgatagagaagtaggactaaggaaaatgtaaccatgcttatattggctaaattaggtcatatattttatcaagaaaatgtgttttcactgccctttttagtaatgtgatagtctccggggatcttggttaatttacttttgtaccccaaatatgatgtttgcattaaaatttccaccctgatgttgctacctgaccacaaatcagtggttttaagtttttcttagggggtggccctctatgtgtttttttttttttttttttttttttttttttttttgagacagagttttgctcttgtcgcccaggctggagtgcaatggtgcaatctcagcttacggcagcctcggcctccctggttcaaatgattctcctgcctcagcctcccaagtagctgggattacaggcacccgctaccatgctcggctacttttttgtatttttagtagagacagggtttcgccatgttgtccaggctgttctcaaactcctgacctcaggtgatctgcccacctcggcctctcaaagtgctgggattacaggcatgagccaccgtgccccgcctgtatttttattaacagtgggatgacatccttccaagaatgccttgctgaagtgaaagaacatttacattcatttctagctgctaatgtaagtccaaagaacattcattttgaaaaatacaaaaatgacataattttgcccacttggttttctcgcttttccccaacttccacgaccatgctctgctgctactactgtattcacttgctggaggtgtgcaccctgtgggagccgtcttcattgtcttggctttggcttgaaatggaggttacatgcagcgcattgtcttacagggtgtcccctgacccgaatcatcaccctttggggagcaagactatatggaaagtgttttcctactgttttttttgtgtgtgtgtgtgtgagtgagtgagaccatgccaacaaaatgaagccatattattaaatggtttgttaacttccaaatcttgtctcaattgggaaaagaaaaatgcttattcgaggatgctgttgaattcatggtgtctgaaaagtcacccctgaacagcaatagttacactgtgaatataataatacactctacccccccaaaaagaaaagtttatgtaaatgtgggcctaagcacatttattgcaatttctcactttggagtagcagctctaatatcctaaagtgattagaagaaagtaagtgaagaaaaatatgaagaaagggttagtgagatactttttcatttagggaaaggggatacagcaactagaaaaggccttgggtttgtgttaagaatttattgccctggtggcttcctttttttctttgtttaatttgcttgtgctgatgggtgagggagagttaaagaaatttaatggcctcctaactctctttccccgtgaaacccatttatctaagagatgccattggccttttaaaaatatccaactgattttatgcttttcctttcttttcatcttctgatctcggcactaaagggcggtggcatggctgagaggttggcatcagagcaggaaaacaaagttcaaggggaaaccaaaaattgggtaattttctctgaatgaccaagtgcttacttttttcaggcatgtgacattgctgttatcaagaaaccagttatgacatgaaaatcctgaaaatggaaaaggaaaaaagaaaaaaaaagggaatggggtgggggatggaaatagcaccagggttgactgacctttaccgaggagggaaggcttagtgttttcagcctggtgtcccccgtgtcccgattgcagccccctgtacttctctcctcatgcaccctcctgcatccctcaagccaatatccttgggggagatagtgcttcatcttaaattcacactaaggtgtctttttgtttttgttatttgagactctgctctgtcacccaggctggagtgcagtgatgtgatctcagctcactgcaacctccgcctcccgggttaaagcaatcctccctgcctcagcctcctgagtagctggaattacaggcatgcgccaccataccccgcttatttttgtatttttagtagagatggggtttcaccatgttggccaggctggtctcgaactcctgacctcaggtgatccacctgcctcggcctcccaaagtgctccgattacaggcatgagccactgtgcccagctgttagtagcccctgttactagcaaaagctatgtattacccagagttgttggtaaacaggataaggttcctgccttaaggggcctgagtcaggtggggatgtaaaccctgggttgcaataagttaggaacttttctaatcaagaggaacacagtggcccgtggggtactgtggggcacctggctagcctcgcctgggtagatgcctcctcaattcattggcacaggaggcataagacatgctttacttgggtttacattaaagcttattctattaggcccgtaccccaaatgactgattttggaaatgtccgactccaggagcgagaagggtgcaggtatccatcatgcaaaggggaggtgggaggtggaggaagagaacagattctggcaggtgtcttttgcttctggagtctactgaacaggggtacttcctgggagtgggaagctcatggagaatgtggctggatccatttttggcacattagtaactggtaaagtaagcttagtagcggctacctccgcaacagagctgaaaggagaatgcaaagtgcagtgtgaaagccgcagctgcagcactttttggagcaagtggttgggtttgtatctatggctcctgccaatgggcagacattggttcctcatcataccatggttgctgtagctcaggcttccttgggcaggctgaaaactggacttcacactgtttttcccttgggtaggtggtttccaaatagctgacccatagggctaataacctcatggttataatagttactatttgtttattgactgcctttcaagtgccaggtagcatgctcagcacttttcgttcattactgtaaaccctttacattcctgagaggcaggtggcagtgacctcattttacatatgaggaaactgaggcccaaggaggtgctgaatcctgcaaaggtgcatagtagttgacagtggcaaagttctcatgcctgtaatcccagcactttgggaggccgaggcaggtggatcccttgagcccaggaggtcaataccagcctggacaacatgctgaaataccgcctctacaaaaaaatacagaaattagcctggtgtggtggtgcgtgcctgtggtcccagctactctggaggtcgagatgggaggatggcttgagcctaggaggttgaggctgcggtgaaccatgatcatgccactgcactccagcctgagtcacagagtgagaccctgtcttaaaaacaaacaacaaaaataaaatggcagagttgaagttcgagagtactctggtctgtctgaatacaaagctaagttctctctactgtttctcgctcctcttaagctgagctgattaagaaattgtgttctcagtgccttgtttattttttaacatcacagtctccttaggtctgaactgatttactattttcctctacctcgtgtaaataggaattttactattttcctctacgtgaggtagaggaaaatagtaaatcagttcagacctaaagagaaagtattccgctaaaggccactgcgaccttgtgatcccaagggaaatttatggactgctgcttttctaggtgtcttaaagaagagggtagattaggctgtgcagaaagtctctgaacgggtcccacatcctaggttagagagacgtgatttccacccttcttcaagttctgcaaacctctgagtttctgtagataattggttgttgggtaagagattaaaaacaaaattcagcgttgggcattctagaataaaacgaagctgtgcacatccaattcctgtttatgtggtactcgcgacaaaaacaaaactttgctgcatagtaattacctcaagctcttaaaattacaggtagtaagggcttagaggccatatggagttataattagagatgagtttaaaaaagggctagtgaatgaatgttcattactacaatgagcactagctgaatatttcaacccgagaaggatcagctccaaggaacatttccagggagttagcggagggtcgtcatggagttagagtgtttgggattagtgcacagagcatttgttatgaacgtgcaatatttctgccagcctggccagaagcctctttgtttacagggcagggtttcttccctgctgcccaatcacagggatttctgctttgctttggtagagtacgtaatcgttcaggtgattgctttgtagtgtgttaggtctgtaaagctcctcgactgttaataatcttttcctgttacttatctctttgctggaagattgaggtaagatgacctctagttttggcctcaagaattctcttgtttttgaccttttcccttagttttctatctttgtgtttcattgcattcaaaacaggccctctgttttcccttgcaaatttatagtccacatagggaagaggaacgactgtgaccaggactatccaggaatcctgtgatgggagtgttgttagtcccattttccaagtgaggaccccttcctctctaaggctgggagtttgggtattccaactaggactgttaaactttcaacaatggggctcttttgacttgattacaaaagaaaaggaaatggcccagttttcaaagtcatgaagaggttctagtatatcttatgaactaatatatatccttgaactcttttgtagctgacagtattaaaaaaggtttgattccccaccttttttgcctgtgtggtttttatcttcctttctataaacaatgacttactcagaattatacagcagcagctgaaaagttgattagcctccgtccttgccctaatcaagtatcaaaaacctggaatgttcacttagagtggtgattactgtgaaagctttaggtgctggagaggacctgataaagaatggagtgagagataagagagagagagaaaatagcttgcaaagggattgcagggtggagtttaacaaacttaagatttctttcttcctttttttttttttgtttttttgatacagagttgcccagccttgttgcccaggctggagtgcaatggcacaatctcagctcaccacaacctccgcctcctgcattcaagccattctcctgcctcagcctactgagtagctgggactacaggcacgtgccacgacgcccggctaattttttgtatttttagtagagatggggtttcaccatgttagccaggatggtctctatctcctgacctcgtgatccgcctgcctcagcctcccaaagtgctgggattacaggcgtgagccaccacatctgccttttcttttcttttcttttcttttcttttcttttctttttttttttgagataatctcactctgttggccaggctggagtgcagtggtgtgatcacagttcactgcagcctcaacctcccagactcaggctcaagtgattctcccacctcagcctcccgaggagctgggaccacagatgcaggctactatgcctggctaatttttatgtgtgtgtgtgtgttttgtagaaatggggttttgccatgttgcccaggcaggtctctaattcctgagctcaagccatccacccacctaggcctcccgaagtgctgagattacaggcgtgagccaccgtgcccagcccaaacttaagatttcttttacttgtgagtttcaggtttggggcttaaatgcatttggtctggttgtggccagactagctcagccctaacagtctgtgctgccttgggccacctataagctttggggagtggggtgggtgggttgggaggagaaggtagggtgaagggagaggggaaatagtgggtaggagataagacccaccagttagctgattctccaggcctggcttgctcatggcatgactgcttctccctgcaggcctgagtccaactttctgggtgtgaggcagctggatggggtacaaaagagggagagagttgccagacactttccaggagacctgcccaagatcagtaattctcataatagcaaatgctcccatagcatttgcctccagccccatcctagagcttttactatagcaattctatgggataggtgctatcataaacccattttacaggcgatagaaacaaggccacgggaaattgggtaacttgtcaaagtgctgaaatccagggttgaaacccttgctgtccggctctgagctatgctaacaactaccacctcattaggcatagaggcctggatgctgcacctgctcttcattcattccttgaactcacccacgtatttcttcaacaaattattgatagcctgtatatgcctttatcttggcaatgagaacaacataagtgctctttgtttatgtgtctgaattcccataaactttattttctttcttttttaaaaaaattgccataaactttcaaacaaacctttaaagagacgagacctctttactgaccttgtatacctggtgtctggtagaaaataggtgctcaataaagctttgtggaagaaggaagaaagacagtgttttgaaacttgacatccttgtatttcctctgtctctagcagccacagtgatatctaaacagaaaaacagacaagccttaagtaaagtgagagtgtgtggggagtgttttgcaaaaataacaggagagaatttttgataaaagcatgctgtcttgtatgcatttcaagttctcatggtgaatcattttttgcttgtttgcttaaagcatttcttatctgaagggcatcccgacacccagcttgcagactactgagtgaatcagggaggcccttcagacttccatgcattgttcggggctgctcttgtcatcagggtctgcagaatatattttctttgcagttgaggaccaaatacctggtaaggttcaagtccaccatccattttcctgtttaacatttaaatgcatgagctagtagaaagtagtttcaccttgggctgggtgaagtggctcacgcctataatgctagcagttttggagtctgaggcaggccgatcagttgggatcaggagttcaagaccagcctagccaacatggtgaaaccctgtccctgctaaaaatacaaaaaattagctgggcgtgggggcgcatgcctgcattcccagcttggcttgaacccaggaggcggagattgcagtgagctgagattgtgccactgcactccagcctgggtgacagagaaaaataaagtagtttcatctcctgtattttcattccttcttcacactgtggggcaaagaaaggtctcattcacttggattggaagctctatttgacgatcactaggagtgatggctctttggttcctcttccatttcaggtttgtttcctcctctgtaaaatagatgtaatgcctaccccatacagtcaagccatatctctttgacatagtacagtggttctcaaacagggtccccccaacctccccacccgggggtacatttgacaatatctgggggcattcttggtagttatgactggggtggtgatggctcctggcatctaatgggccaaggccaaggatgctgctaaatatcctttgattcaaaggacagtcccccacgggaattatctggcttaaaatgtcagtagagccaaggctaagaaaccctgacaaagtggaacctcaaacaacggtagctctttttaacatctctgatccaagggagctattggccagggacaaagatccctcctttcttaagtagggtggaaagaatggaatttaacgttttattgatgcctctgggtttccccacaggtgcccctgaggtgggaacacctccttttctctccattaaacatgacttaacttcatttgaaacttgcttgcatcgtttacatataaatagccatgctaaaaccagtgaaaccacttagcctgtggggtggttaaacccattccctgcagaggacattggtggagtggggcctgtgctgctacaggcttgtgagcctcgcttttctcccctgttaaagggcagataggtaattgtgtcaccctcccatctcgtcatgttgctctgactctgcacgtgtgaaactagctctacgtatgtgaatgtgctgtgtgattcctaaggtatgccttttgaaggcatttttcacgggatccgtttcagtcaaggacactaaaatggttggggctcaacaaagaatatctgtgttacgggcatagtaggaggccccccaaatagttcctgcagcagggtgtgtgattcgggaagcagtgtggcccagtggttgacagcatgaggtcagccactcacaggctgctctgtgtacaacctttggcttttcccgtgcttgttgtgtgaccctgggttagctacttcacctcgttgcacctcagtttcctcacctgtaaaatgaggataacgacagtgacgacgataacacccagctgaagatgggtgcgaggcttcagcgactggtccttgtgaggtgtgcggtgaagatgggagcttagctcaataaatgagttgctgttagtaaaatactatttgatgttggcttgtagcttgtgtatttttactcagatgaagagcttgctcctgatttaggagctgaaaaaggatctttctggttcttggtattttttttggtggcaaaatacagcataaaatctccattttaaccaatttaaagtgtacagtgcagtggcattaagtacactcacaatgttgtgcaaccatcaccactatctaattccaaaactttttcatccccctgaaaggaaaccctggacccgtagagcagtcactccacgttcctcccttcccccagccactccctccctgcgagcccgctcatctattttctgtttctgtggaactgcctagtctagatatttcatataaatgtatttcatgcaatagatggccttttgcatctggcttctttcacttagcataatgttttcaaggtgccatctgtgtattgtaacatgcaccagcacttcaccactttttacctggtgtcttttttgcagagcaccccaagcctcagtgtcatcaggcctgtggttctctgaagtcatgccctgttttcaagttttaaactgtctttcttcattgattttgatccttcttggccagccttattttttccacttttcccatccagtacttctaatgacccttgaaatgaatgtggaatgaagccctcatgccaggttcttggtgctggggaataggtcttattaggtatcttacttctgtgaaagaattagcagcaggagcacacataggggccctgagtggtgcttcatttccccatgactctgcgtgacaggttttaaaaacaagtgtctggaaaacaccaccaggccccttttattcatcagtttaaaagcttcccacaatgagaagtggccctcaattaagtcgtttaataaaaacctccccctgttttaaagcattcttgggaagtgtttacatttgacgccactgcaggcttctaaatgaggagctgtggagtgagtgatccttaacctgtgactttaataatatcctttgctttagatttccaggtggaggcctgggccagatttgtagcttgtcattgacccagactgggttcagagatgggggctgggcagggggtggaggacattcttggctatcctgcccccctcagctgccactagtagaagattcagaaaggctgaaagccacatagatatgtaaaaccagctccttggagagagactggactggaaggaggtgaagcatttccctacctgggaagggcagttaccctgccccacttctgaccttatctgcagtgtcggggggcttcagtgggcagagattaaagcatttaggagagcagtgccaggctcctgagattctggggccttagggtctgagagctggaggaggctctacttttttctctgattctggagaggtgagtaggccccgagaagaggaagcaggctgctttagcttcagggaaaactccggagttgtcattagaggagtcctgggaaaagctaaaataaagaaaattctagggtggtctttcctttgtgctggacgaagacaggagggtgaggggagcccggagctgctgacacgcactggtgatttgtagaggttgccaaggtgggcagttagcagtctggattctgggcctggactgcccggatctgaatcctccctccggggttctgttctatgaattcttgtgtgtccagtgctcagagcagtgtctgcagaggtagctgtagatatgtgtgctcgcacgactgtactgacacttcactttggtgagtttctggttagaatcatagaaatgcttcttgttatcagagctaatttgcctgcatacctggcagccttgtgcagtccatgggacagggtgatgttactggactctgaagaaaacatgactcgcagatggagaaattatgcttggcaaatctattaaagttctccgagggagagaataaatgtgggaagaaggacaaaccagtggatctagattttatttagacttccaaaagattgttggaaagacttcatggcaaaggctattagatgtgggagtctcccatgactttctgagtggaggtgaatggaagaaggagtctggctgaaatttgtctttttccattgtcctttagaggaggaatcttcacatttgcagatgaaataaaattctaaaggtaaaaatgaagacttcggagtcaaactatagagaggtgttttttttttctttttaaatttaaattttgggcacgaggggatgtcaactaccctttaaaataattcgtgatcagtggctgcacctgggcagctgggctttggaactaggaatgatgtgtgtgctgctttctagcaaagttaaaaatcatgtgcctggggcatcagagtgctcaggaaataaatgaagattagtggaaccaaggagttcattaaaaatgattcaagttccactccagcctgggcaaaaagaacaaaactccatctcaaaaaacaaaaaacaaaccaaaaaaacctgtagtttccaactgtcttttaagtgaatagtacatttgtagaaaaagtagattctgctatcaacaaatgtaagagttcacttaaatgcacagatgttgaatttcatgccttttgtgttttaacccaggatagtaaatgaatgaatgaaatgagcagacactttttcaacacagacccttccctctcgcccaataggatttaggaagcttggagttacgcttgaccaaaaagacacgtgcaggagttagttacctttgtgtttttctttttactcagtgtcctgtgggccttgcctggtgccttatgtataggagtgctctgtatgtgtttgaatgataaatggactcagatttccttaacataagcgtaaatattttatcatcgtgtgtcattatgtgccaggcaaacttagttatatttgctcttacaatggttgtattggatattgctgcttaatattgccgtgtaacaagcaatcccagatctcagttttttgtttttgtttttttttgagatggagtctcactctgttgcccaggctggagtacagtggtgccaccttggctcactgcaacctcccacctcctgggtccaagcgattcttctatctcagcctcccaaggagctgggattacaggcacgtgccaccacacccagctaattgttatatttttagtagagacagggttttgccatgttggccgggctggtctcgaactcctgaccttgggtgatccacctgccttggccttccaaagtgctgggattacaggtgtgagccaccgcacctggccccagatcccagttctttatgaccacaaaggttcattttcccctcgctcagctgttggttgggtgtggtttggttgagccaggctgtgcttcacttggccaagccagactccaggcttccatctgggttgaggtctattccacatgtgttttattcagcagcccaggctgcaggggcaacaaatatgcagggccagcttgccttgggcagattacagaggcataagaaggcaagcagaaatgctggaagcctcttaaagctttggtctataagcagcccactgtcagttctgccaagattcccttggccaacacaaattgcattgtcaagccccacatcagcagggtgaggaagtatacctggccagttctagtaggaggtaactcgaagtcatatggcaaagaaggtagatgtatatggaggagcaaagcactgagaacaataatttcattcacaatggtagagaatgaataagacggaagagagcagtttgggccaaactagccttttgggagcttgcgagacctaggctgactgggtgaaaaatcatatgcatttggtgcaggtaccagcccaggccttggcatttcctgtacattcgctggcatgcgctgcctctcggctggctggacattgatcatatcctttcactgcgatggggctcgtgggagtgctgcctatctgtgggaggagcagaaggatgggcctgattttcttcgggttagccatcatgacctgacaggctgccagctgtggtggcaggagtgtgacaagctgagagggcaaagaggacaaagaaggaccacagtgttgaaggaggccaggggcttgcctcagcctaagtcccacctgtaatagtcagtgacaggttagcatcagtgcctgtgtgtaccatgtcccaatcttcataaggatcctaggctgtagcttccagaccctgccttttacatccaaagaaacaggcttcaggaggtgaggtgacttgtcttcagccaaccagctcaaaaatggcagatgagagccaggccaccctgttcccagtctagggtctgtctttccacaccctgtggttgtcatagtctagcagagtccggactggtgttgtgtgttatagtatattctggccctgtgatgacagagtctgctttggaagaagccatgtgagcctcgtgcccataagggatgacataggcgaagcagaatgagtgaaatactggccaatgataagcagccttgctgttactgctttgcaatgggccatttctttagtgaagagctgctagactttgaggaagaaaaggctctagccacttgtgaaaatgaaccaggaatagatggggaccaaaaccttgtaaagccaagggtgtgaggagacagacactctcacatgtgctgagtgtgggattataaattcactgggcttctatctagagagcagtttggcaatggggctgcttttacttgcaagtaaacaaaactcagttgaaggtggtttacataagaataaaaacagcaaaaagtggttaaaaagtggtttaaataagacatttcaaaatgacatttgttacctcatgtaaacaagaagtccaaagtctgggctgttgggggagttagtttgaagacccaggcttatttcctctttcctcgcctcagtgtttgatgtttgccttcaagcttgtttcctcatgatctcagtgtggctgttgctgctccacccatcgtatccttattccatatccttattcagagtgatgtccacaggcaggaaaagaggaaagaacagaaaagatgcaaatcagcatgtattctgagatcccatttttttgttcgcaaaaataaacaccttcacatttttctttcccccccctcacctgacaccatcacaataaaagtcttaattttttcagcaccataagatggtgaaaaaaaagtcttaatttttgattgtgaatatcaatttctggaaccaagaattttggttatttctgggccatgggatggtgctgtggttttgttttccatttcatgcccttcttggctgtttgaattttataaatatcactgcatgtattacctttataatacaaaagaaagtgataggtgttttcttagtaggggtgggagatattaaagagaggaaaccaaggccctaacaggggcattatctgagacatgatgtgataggataggagtgcatttagctgtgtgtgatcagcctagagggaggttggggaaggggaaaagtccaggagtgaaataaggtcattttaaatctcttttggtacctggcacagtgtcttctacctagtagagacaaaaactcatttgaagtatgaatgaatgtttaggtcaagacctaacacaactttatgaggggctgaaacccaaccaagcagctcaagtcagcaagaaagtacattctgctggaaatttatcttgcaaagaagtatgactgtcatttcctaccttttccttgagctcccagaatctaattcattgctaaggaaacagtgtaagtatgagaccttctgttcatcatctgtctcctactgaaggctattgtcccaggatctggataataaagctgtataaggtttttacaactgagggtagagcaaaggcaagaaaccaccatctcatgttaactgtgttaatagtctgtggcttgaatggagtctagatgtttaaagtctactaagtgtagaatgaacagtcatttttttttaaaggaaaaataaagttctttgataccctggactaatacataaaaaattgttatcttaatgatgtgacacagataacagttgtgagatagggattttcaacctgattggccagtattagtagaagagtgtgaatatgcctgttggtgagatgaaagaattatatgtagtggtattttcaagtctaattctcttccatatacaaaaataaaatgggtattgaaggcctttttaatggcaagggtggaaggaggggaggtagagtactacccttacattgtgccatagtcttaattcccttgctccagggttctaagtttgatgctcataaatcaaaagaaagaatgttgtaactgacatttctattgagttacttttaacttttgtacccttgggttttagcattgaggccttctgcaatggccaccggatacccactttattcagacaatgataatatcgttgagctatggtaagatcatttcctttggaacaaaatgaaaagctttcagtgttcacaattggaggaaaatgtaaaagcttagtaggcctcctctgctgcagggtgaagagtttgtgtttgaacaccatccactttgctcctcaaatgtgcagtggaatgattccagtgtgcttttgaaatacagaaaacaagtgtaccttttcagtgtgtgtgtgtatttatgcatgtgtgtgtttaatgggttcttggaaatacttggaagaaaagtaatatttaacatctttttttgggatcattttgggatccaaagaatctgagatcattggtacgttatgttccagagtagccccgagttaaatttcttgagagagagagaaagtgcatgtgtttgtgtgtgtgcataagtattactctaaagaccaaatgtcatgcttacttgacatgatcttagtatatatccttatctgcttctcagtctatattatatctgcagattttgtgactaagtggtgtaattttacatgaattctgcatctgcatcagaaagtatgataacaattaatgatactaacacttctatgtcactaaacagtgcttgatactgttctaagtacttaacatgtattaactttttttttttttttttttaaagccaaagccttttgtcacccaggctggagtgccatggcacgatcatggttcactgcagcctcagcctcctaggctcaagccatcctcccatctcaacctcccgagtagctaggaccacaggcacgcaccaccaaaccagggtaatttctgtttgtttttttttttttttttgagatggagtttcgctcttcttgtccaggctggagtacaagctcatgttgcccaggctggagtacaatggcgtgatcttggctcacggcaacctccacctcccgggttcaagcgattctcctgcctgagtagctgggattataggcatgtgccatcaagcccagctaattttttgtatttttagtagagatggggtttctccatgttggtcaggctgctctcgaactcccgacttcaggtgatccacctgcctcagcctcccaaagtgctgggattacaggcgtgaaccaccatgcccggcttatttggtttttatagtaacgctattgattccatttttaccaaggaactgagatacagagagatttagtaacttgcccaaggtgacataactagtaaatggtgggggtaggttcaaaatcaggcagtttgctatttcttatttaaagccacaattcatgagaattgagccattctcaaatgtacaggttattcttgtaaattggagactattgtatcagtgttacaaatgacctattgtaatctcccatccaagaactaaccatttctgaccctgcttagtgtcaatagtcaggtgcattcagggtggtgtggctggagatgatcttatatgatctgagccccttgcttcatgaacaatattttcagttactttacacagtaagcacgtacttaaacaattatttggctgggcgcagtggctcatgcctgtaatcccagtactttgggaggctgagatgggaggctcacttgaggttaggagttcgagaccagcctggccaacatggtgaaaccctgtctctactaaaaatacaaaaattagctgtgcatggtggcatacgcctgtagtcccagctacctgggggttgaagcaggaaaactgcttgaacctgggaggcggaggttgcggtgagctgagatcatgccactgcactccagcctggatgacagagtgagactccgtctcaaataaacaaacaaacaaaaaccccaccaaaccaaaaaacccaattattttaattataaatctgaactgcattaaaagatagtaaatttagctagtcaacttgaataacttttaacagagagttagttgtctcttctgtttccttagggaagaaagatgagttccttcagttcccaaatgagtcctcaattcaacatgagtgatttcaccagaataaaatcttcttacttctgcaaaaagcagctaatgctttcggaagctaaataatcccaatgtgtgactcctgccagtttcttttctttgaaacctcagcagcagcataactagtgattcacccttcttgaaatgaatgctgtgattcgcgttatgcacagatggctactgaatgcccaggtcacagcctttgcgtctggccttgactcgttaataagaacaggaactgggcatggtgtattgcacagtgattaagggcttaaagctaagagcagtgcctggccccaagtaagacatgagtagaactttgctgctgctatttttgctgttgtatattgggctctaccttgtgctgggcactacgttaagcacgctatgtgcattgcctaattgaattctcatcacattcccatgaagtagttgatggttttgtttttatcttcattttcaaatgtagaaactgaagcttaaggttatgacatttgcccaagaccatgcagctggtaagtggttagcgccatggtacgaaccaagttaaaaaacattttttttaattcataaattataatgtacagaatcttctagaagctttcttgtgcctcctcctgattgttatttttcaacaaagttgcctactattctatcaccacagaaaagctttgactgttcttgaacttcataaaaacagaatcatattcatacagtatgtactctttgtatttggctttttttacttagtattatgtttgtgaaattcatccattgatgtgaaatacatggatttgcatgtagcgataatttgtttttcctcattgctaaatatattgctacatttcttattgtatagtttaatgtacaaatatgcctcactgttgatctcttctactgttgatggactttggttgtttttagttcttggttgttatttattgtgctacttactttctttctttgtttttttttttttttttggaaacagtctcctctgttgcccaggctggagtacagtgatgtgatctcagctcactgcaacctccacctctgggttcaggtgattcttctgcctcagcctcccaagtagctggggctacaggtgcatgccaccatgcctggctaatttttaatttttaaaagagacagggtttcgccatgttggccaggctggtcttgagctcctaacctcaagtgatcttcctgccttggcctcccaaagtgctgggattataggtgtgagccaccatgcctggcctaattgtgttcattcttgtacatgatttgtatacgtatacggctctttgagtacatttctaggtcagcactgctgggtcttaataggtgtggagctgtattctatactgtgaaactgttttctacactcccacctagcagagggttcagtggttctgtcctaacactgtaatgactatcatcattctggtgggtgtgtagtagaatccatatcaaacttgatatggattttgactccatagcctatggacttacctggtaagaacaattttaacaattatagcgctcttgctatacggaaggtgttgtgctgatatgtaataatgaatataacttgatttctgccctctaggagtttatagtccagtggaagagaaagactcagaaatcacataatcatagtccaacacagaatccatgcatagggcactgttggagcactgggagagtctacttcaatctgtgggttcaggacggggtcgctaaagtcttgcagaaagaagtcagtcttctgggatatggcttcttcgggaaggtgacatttaacctgaggctgggggggatgaaaatagagtcatgtgaagaggaatggatcagaagcctgtgtagccacagggaggaagtgaacaggtgatggtaggctgaggtcaaagagccctggagtccatggcatttgtaaaccattgcgggccttgaagtagagagccaatgttgctatgaagcagtcaaaacggttctccttcatcagcctgtgacccacaggggacccgcaggcctttgtggaggctgcctccatttggcggagtggtggtgttggagaaaatggccttactgactcctgaactaggaagctcctgatcctaactctcttagtatctcatcttgcgaattactaagacagggtctttaagatgtcttatttattttttgatgtacattttgtaaattaatttttataatgcttcaaaagctaatttttaaattataaaagtaatagaatcacattacagaagccagaaaatggagaaaaaacccccactatcattttattatatagtttttcccatcgttttaattgtagggtatagattattttatgttatccccgtgtcctttgacatgtgacgagccttttttcttgattatgtagtcttcattactattttattattgtagaatatgaagtggaacaccttgtaccacttaaatttcctctttttttttttttggagatggagtctctctctgtcgcccatgctggagtgcagtggtgtgatctcagctcactgcaatctccacctcctgggttcaagccattctcctgtctcagcctcccgagtagctgggattataggtgcgtgccaccacaccatgctaatttttgtattttcagtagagatggggtttcttcatgttggtcaggctggtcttgaactcctgacctcgagatgcgcctgcctcagcttcccaaagtgctgggattacaggcgtgagccaccatacccagcaccatttaaatttcaatctttctttcacttttaattgtaatgagaaaaaaccaatagatgcttattgtaaagcatttggaaaatacagaaaagtataagatgaaaattaaaaacttttcagttctaccatgaagataaacacatgttaatatttgggtatatttcttttttcccctctgcttttatttacatatatgtatgcttttctttccttttttgtttttttgaatacaaattggggttttttttcctgcaagcaagatactgttaatggggattttggatggccatataatgaaataggaaaacgattaatggaagcccaggaggaaagacttggtgttattataggtttgtatcatatcaccattttcctgttctatttggaggaagagggaaaggggaaaggaagccagcccttattgtgtgcctgccacgcacctggtcctgcagtgctgggaagcactgtgagctctgactcccagaaaagtagacgctggcactgtgggaaagtgggaccctcatggcagcgtgttgtttgaaaaaccagtctttcaaacataataactgagcatgttggaaaaccaggctggcgtcatggtgtaaattgagtttactcaaaccggcaggttgttgggaaggtacacatacctctattgttttaacccacttgaagattaaaatgtgggaagagcattttgaatagagaacaccgtactttatcatttggtgcagaggccttgtatttttaacaaaaattgccccaaagtttcctccaaatgcattaaatccatgtttttgttgtttaaccatgaatattttgaaaaaatttattattttgaaaatccaggccctttaaattttatttttgctctcacaaatccttctttccttttgagttggcacataattgtacatacttatgagaaaacaaagtgatattttgatacatgtatacaatgtgtgatgaacattaatagaggattggctaaattatgatatatataaagtgctcagagaggtggaggaggtaataagatagaaggtggactttttagggaagtcctttagagtaattagtatattcatcacctcaaacatttgtcagtcctttgcattgtgaacatttgaaatcctatcttctagctatctgaaaatgtacaataaattaacttatttctcctatctagctgtaactttgacctgttcaccaacttctttctatcctaccctcttctctacctttcctagcctctaataaccatgattccactctctacttcttcaatatttaatttaatccccaaattctaattgtagtccatatttgaatacttcatattattggtcacaattttgggctttgtattattggtcacaattttggttgattattttttgaaaagtagaatcttgttttttgaagccaggcttaatcacctgaagacccaggacatctatagttgttttttttttttttcctaacaaaattctgtatgcggaaaataggaaaaataatacaagaaagacacaagaaatggacagtgctacatttctgattttacatcttcatgacaatgagtaaagatctctgagttttgtcttcggatcggagtatggaatctgtccattgaggattgcaggtcgagtgcaggggctcatgcctgtaatcctagcactctgggcggggagcctccagcactgaggctggaggattgcttcagcccaggagtttgagaccagcctgggcaacatggtgagaccccatctccatgaaaacttagacactaaataaaactcactattttcattcttattaatcttatttattacttggagatatccttagaggctctaggtgtgtaagtctccttgttcctaccctaaatagctatagaaattgctgtatttctaatacctttttttttttttttaatggggtctcactgtgtcaccaaagtggtggtgcagtggcataatcaaagctcactgcagcttcaaactcctgggctcaagtgatcttcctacctaagcctctcgagtagttgggagtagagatgtgcaccatcatgcctagccaagttttaaatttttttgtttgtagagatgggggtcttgctatgttggccaggctggtcttgaactcctgacctcaggcccgcctcggcctcccaaagtgctgggattataggcgtgagccattgcacccagcctcttctcattcttaggtctgccttttgtggttcttctgtcactttctgtaactgatactgttagcagcttatgcttttgttgcttctacttggctttgggctaaggattgtaacttccatctgtgtcaagttgtgtgtgaaggaggctgagtttgaattgtgttttatgctgggtgctgtgcttgaggcagcttgttgcctaaaaagaaaatggtgggcttcacagcacacacagctttggatgctcaaagcccatttgagcttccattcacttattttctttcttattgtaaaaacaatacatgtttgtgcgggcatggtggctcatgcctgtaatctcagcattttgggaggccaaggcgggcggatcatctgaggtcgggagttggagaccagcctggctaacctggtgaaaccctgtctctactaaaaatacaaaatttagctaggcttggtggcgcctgcctgtaatcccagttacttgggaggctgaggcaggagaatcgcctgaacctaggaggtagagtttgcagtgagccaggattgcaccgttgcactccagcctaggcgacagaatgagaccctgtctcaaattaaaaaaaaaaaaaaaaaaaaaaaaggcatgtttgcaatgaaaattgaagcattacaaaaatgtgttatttaaatgaaaggtaccctgttttatcatctctagtcataactacgctttaaggatttgataatttttttttagatttttctgtaactttatattttttacagagatggggttactctatgttattttggtactgatttttgtatttttaaaaatatatttgtatactttctatggctgtgtatataaatttttgttggttgtttttaatagcttcctggtgttccttggtatagatatatcgtaatttagccaatcttctattaatggatatttggactattataaatacctcatatataagtatttgtactctctgaagtgtttgtataattcttctgttcagagttaattactggaaatagggttggacggtgtatacattgagccagtgcgcccagctgcttttttcttttttaaatgcagaattttaagcctcaactccaaaccgtccgtcagaatttccaagaatgggtctcagggatttgaatttttaaaaagttcccaagtgattctgctggtgcccgagttctagcatgcctaagacatttccttaccagctcgagtgtttcataaaatatgttcaattcaaaggtggatggttgtggaaaattattcaaaacagcttcaacctgatgaagtgtttagttgtccttgaagaatcatttcatttgagccttcatgctttaatacctatccttttttctactaccaattcttctgaacttagtagcactccaaattggctcattctcaaatttccttatgacgcattctgtggtaaagactgctaattttatatccagcagtctttatattctcctcttcttcagtaaccaaaaacttgatttttttggagggtgtacagtgtgccatgccaaaagacagtatttcccagcctccccttctcctgttgatgggctagtgagttaagctctagtaagtgaaatgtgaaggcttgtggaaaggttctagggactgacttctatggacaatgtaccctttttctttttctctgtccttctacatactgcttggaacatggacacaatggctgaagtccagcagccatcttggattgtgaggtaacgatgaagatggaagccatgtgatatggcttggatgttttgtcccctgtaaatctcatgttgaattgtaatcccccatgttagaggtggggcctggtgggaggtgtttgggtcatgggagtagatccctcatgaatggcttggtgctctccccatagtgagtgagtgagttcttgttctatttcatgtgagagctggttgcttaaaagggtctggcacctctgttgctcctgctcttgccatgtggcatgcctactccatctttaccttctgccatgagtaaaagcttcctgaggcctcactagaagctgagcagatgctggtgccatgcttgcacagcctgcagaaccgtgagccaagtaaacctcttttctttataaattacacagcctcaggtattcctttacaccaatgccaaatggactagcacaccatgctctaagtagggcataaagaaaggagcctggatccctaatgactgcagagccatgatcccagccctggactgcttgcctccacacttctgtcttattggttaagccaaaattattttgggttttccgttacatgctgcagaacctaacctaatgaatacccctgctctctgttggtttcacagtgtgtctccaacaccatcttgaaggtgcagtgacttgcatatagtaggtgcttggtaagtgtttgacaagttaagtacccaatggcattgaggtaaagagttcaaaggcttcagctgctctgacctgtccccttttctgctttagattaagttattcatggggaccttttgttttttgccatctcaccccccaggaaggtatttcccagccctcagtgcagggctttagggctacaggcttgaatcattttgacaagacagcaggcagaagacattggagattctaactgcacatatgcgtaattccaaatgaaaatataaggggtgggcacttttctgaatctcctagagaaactggaggtggtggttcaaatgatgtcagaaaaggccaccattgaatcctttgctatcatttggaggctgtactttccacaatgcttgccaggacttgatgtcagggaagactttcaaggagccttgattgccagctattgacgaaggggtctgtctgctcagtggcaacctccatggtggtcttggccagaccagcctgcccctgactcatgctgagctttgtcagccaggttgaaacgcccctctttggggcccaggacaacatgctggtttcccggaagcatctgggccaagactctgctgctaagaaaatgatattgtttttgcaagcatgggagtgtgtttaaaatgcttcccctttccccccaacaacattaaacctccatgcaaagaaacacgaggttaaaaaccatctcccaaacccagaaaacagaatgcaaaacctgggaggtgaattaactctttactgatgccaaggagtttatttcaaaacaggattcatcgactacagggatttgcagtctgccctcctgtgtgcccactgagagcaatgggcagaggctgacccgcagccctttgtggggaaaagtaaattccatggcagacctcagtggctgaagattatttgcttctcctggaaataattagaaaaatacttactctttgaaaggcaacatctggctggctagaggcaggctggaaaatactcaatctaaatagatggaggtgacgttgtgcagaaggaaagaaacatcccgagggagtgtccagtgggttttaatggccgtgtctagagaggcactcctgctctgtacaagggctggcttcttccctggatctaggggttgcccctgccttttagaagacagatgcacagccccagagcctagttgcctcccctgaccccctccaagccttccatagaggaaaggggcctcccatagcactggctgatgctcagagccaagagtttgctgcccagggagtaccttgagctagtgctgggtgtcagacttgactttccaactacttccagtgcaattcaaggtgttgattttgactgctggaactgtctcttccttctcagccctttctcaaggctgcctgtgtgcttgttcttattaaccaagcccagaagccagggatctggaagcctggcagtatttccaggaaagtagcttatttctctcacttgcttctccctgctgagcttagaacggcccagctttggacctcttgaaacatcagggcaaatttttccccctctttcaatttgcatctacctgctggtgaaaaaagcagaacagcatcttcatggatttatgaacgctcagagtttttaaaatgttttatagcttgtaagatattttcaagtgaagaatgcagttctaataaatccaatgaacctgtcacagattttctgaaaccaagtgtctatgaaaaactatggtgatgacatgttgaaggtgcttattgaaaaatatggatccttgtagcgaacatttttgcaaagggtgcattttcacataaaaatgcttttagtagtggcttcgtttagttattctgcagctacttggctgtgggttcccagagagccctgaggcaacctttataaaaggcctaggtttgacttctctttggtcacttcagctttagagcaccctaagaaggctcagagaaccccaaatttcttcccagtaaagaggtcatggaataaatctggaggaactcaagaggggcgcctgcttttgaacagtcattagccaaacatgggtagattcctattaatcatgtcaagagggtacttgggaatcaagttcatgtggaattgggagattaaaagggttaggagtccttggagccgtaagacccctgaagttccaactatgctacttgctttctgtgtaatcttggataagaaatcacttgacctttctgagccttgatttccttacctgtaaaatgggaatgctaatcattgtactgcccaccatactgtctttttatgtgaatcaacaaagccacatttgtattggtgctttctttcctttcttttttttgaaatatgagatgcttcatgaatttgcatatcatctttgtgcaagggacatgctaatctctattgttttaattttagtatatgtgctgctgaagtgagcccatattggcactttctaaagtgtaaggtgctgcgtccacattaggcattaagatgatggctgcctttttcacttcacccaccccattgcctccattgtcaatgatgacgttaacatatcattgtttccctactcttgagcggggctgctttctatctcacactctgactcgggtgtctgatttctcccatcactctggcattgactctgggctacccttaggtgctgctcccgatttgggagctgtgtgtgacctttgcttttcctgccttcaggtaagattttctctttccaaacctttgtgctgtgatactgtctaggttcctgaatttctgtgacatcctttgatctgtcatttgcaatctccagctctttcctacctttcaagggtgtgtggtaagcttggtgagtggggagcagagtggagctggggatcctgagaaggcagttcattcatagggctctttctgtgccttcttatgtcctcctccctcagcccagactctgagcctttccccagggctctaagaagatagaaaaactcgcagaaggtgtggaccttttctttcttttcctttttctttttctttctttctttctctttctttctttctttctttctttctttctttctttccttctttctttctttctttttctttcttttctttttctttcttttctttttctttctgtctgtccgtctgtctgtctctctctgtttctttttttcctagtggggctacaacttatgcttaatacaaataaatgccttttattcatttaatacagatatttaccaagtaccccctgtgggtcaggccctactctcaccctaaggatacagcaggaagcaaagcagaggtggagaagatcccactaaacacacaggcaaggcacatcagtgggtgatgagcgctaagaggaagtatggccagatgaggtagagggtgaggatggggcggagagaatcctacctgttggcaaagccttttctaccagatggtccaggaagatttatctgataagcaacaggagggtgagacctgaaggagcctccagatcagggctgcctgggggaagggcactgtgaagaggggacagggacgctgaaggccctaaggcatgaagcataagagcaggaggctgctgggtgtgttctgggaacagcaaggaggccacagtagctagagggagggagtgagggtgggggttctaagagaaggagggcagagcattctgaactttacaggctggcataagggttttcatctgatgggagttagaagccagttaagggttctgagaagggtggaggcgagtggctcagctaggagcctagtgaagtagcctagaactttctgtggaatttgttctgcaatcatgcgaagtggcagtggcatggtaacatgggtaagtggtagtgactagatcctgagatgggaactgaaagcctggagtgaatgtctcaggaaacccgacacccgtctggcccagagggtccttatttcaaaactgtgtttaaaatggcaaacacatgagatcatggtaatcaaacttacataagtactgtgcaaatccagaaaatttgtagtgagtgtactgaattatttgccaatgatcaatagtgctgggctctgaatgcaatctgaaataaaaattgttttcctgaatgtatttatcaaaatactgagtgcttaccaaatactggtgcttactgtactagttgacccgtacaatcagtttaagtaagctaacttaaatttatgacttttgacttattcctgatctattcacaggccgcttggaatgttgggccatctgtccttttgacatgaattttccctgtaatgggggtagagctggtaactgttggatcatctgattattggagacagaagtcctgtcacttgcccctgctgttaggaggtgggcttcctgaatggctttctgtatacatgaagaatttcaagaccttccgttaaggtggtcagagctaagtttcagcgtttacaagaggtctcttggctgacttgctataacttacagcaacctgatgtttggacaccttttcctttttttgtttttagtaaatatgatgagaaaaaagactcctcatctgttttgttttattttgtgaattacttctattcttaccactcaaaaaaatgtttaaataagtaattgcgaaaaaatagggggttttgccaggcacagtggctcatgcctgtaattccagcactttggaaggattccctcaatttttagagggaaggactgcttgagaccaggagtttgagaccagcctgggcaacatagtgacaacctgtctcaacaaaaaaaatttaaaaataaccgggcgtggtgtgcatgcttgtggtcccagctacttgagaggctgaggcaggagggtcacttgaccttgggaaattgaggctaccgtgaactgtgattgtgccaccacactactttggcctgggcgacagagtgagaccctgtctcagaaaaaaggcagggtggtggggcttgacaatttgtttaatatctgaaagtattagaaaaaattattctcaattttttttttttttttttgaggcagagtttcactctttttgcctaggctggagtacagtggcatgatctcggctcactgcaacctccgtctcctgggttcaagtgattctcctgcccccgcctcctgagtagctgggattacagatgcccaccaccacgcctggctaatttttacatttttattagagatggggtttcaccatgttggacagggtggtcttgaactcctgacctaaggtgatccacctgtctcagcctcccaaagtgctggcattagaggtgtgagccaccgttaccagcagaaaaaaaattattctctttggtattttcaaaatatgtggcagtgagagggtgcagtaagttaggagttaagtgacctgactaaatatctgtgttctgctgaaatcttgcagaaagtgggatgctcaggaagaaaatagtctatcccacgaagccatttcccacaagcagctgaaggcagggcacaccgttatgtttattttggtaaagggaaaacagagttaagtttctcaggggccccaaacctcaaggatgatgaacacacacattcatacacagaagtgacttgcgttgatagacatccttatcttgaatgcctcactcagagacaaatctttccacaaatgtgcactgcccaggtgagccttttggaatcggagaatcaattattcaagaatgtgacttttaagccccaaagcaaagtttggacagttttcccagagccaaacctctggatattagtccacttttccgggataatataatttaattttagtttagttttttagagatgaggtctccctttgttgcccaggctggtcttaaactcctggcctcaagcagtccttccaccttggcctcctgagcagctgggactacaggcacacagaccgcacccagctcattagtgtccttttctgtcaatgagcataggggttcgtagacgccctttttataaagagatacgttcttgaaattgcctttaggccagacacagtggctcatgcctgtaatcccagcactttgggaggccgaggcagcgggatggatcacttgaggtcaggagtttgagaccagcctggccaacatggcgaaacctcatctctactaaaaatacaaaaaaattagccaggcatggtggtgtgcgcctgtaatccagctactcagaaggctgaggcaggagaatcgcttgaactcgggaggtggaggttgcagtgagccgaaatggcaccactgcactccagcctgggtgagacagtgagactctgtcacacacacacacacacacacacacacacacacacattgccttttgacttcctaccctcaggcatgtgtgcattaattgaggacattaggaactaaccacgtgcacacgcgtgtgtgctgagggaacaaaaggtctgaaatctggtccaggggagagttggcaaggtaaggcctggggaaagcaggctggcaagctcaggaagcagaggggcgccatgcatttggagacgtgtgagtaggtgcagagcctgcgcaggggaggcacatgggctggagatgtctggggcctggtcttgaattccatgctgaggagattgtgtttttatgctgaaagcaaaagaagaaacaaatcactgagtaatttttaggctgaagtacaaatttgaaaagatgacggtggccatggggagaacaggttggaggaaaacaagcctgaagactgaggatcaacttagaaggccacagctgtaatccaatagagatatgcatatagctctaattagggccatggtgtcgggatggagaagtatggctgagaggtttcaggaggcagggtcaacaggaagaaatcactaactgatgttgtgtgaaagggggagggagaaggtaggatgcttgcaggtcccgagagggcgtggagttgactgatgccatgttccatgtaagtcaggagctgttaggaagagtcaagtcgggctgggactgataggacttttagacatttagaagctgctaaaacaagaatagaagttctaagttgagtctaaccagggagttgttcttaccagaaaaaaatagagaaataagtccaataaaaccactgcttggtttgaaaaatcaagtgggaagggaatgaagaacaggaatttctctgcagagcatcttcatctgatgcctcgtgtgaggatctcgccctttctgagcctgagagatggcaacgatccttctgttctggaagattaaaggcacaagccgttagcccagaaggtacttcagctgagatggtttggggttctgaccagtgaggactcaccacttcaaggaagtggaatcctgtcttagttcaggggatcatttgcagtgtgagggtcaggcccgaggtagcctggcctaggaaaggaggcaagagaggactgtggagtgagacagactccgtcaggatcctaggtctgtcagttgtcagcttcacaatcaaattacttgaagtcattgtccttcagttttctcattttacatgtcgttaagtagattaaatgtgaacctaggcaaagtgcacaaaacagtacctgactcatgatagttcctcagtaaaccctagttccttagttgatatggaggatggtttataccaccattgggctgtatttcctacccttggccttttgacctaaatgaggcttgatccctggggctgactgccatcatctctcctctcttctattccatgtcgctggctatgtcagcagatgggagagtgttctggaagctttcccatcaccacctctctctttctaggcaggcattttggctgtgtctgtgtggtcccaacatgtgtacgtgtgtgtagcagggagggaggagtgagtatgaagaggtccaataacaacaattgagaaagataaaataaattctttccacaatatcggaggctatattatctgctaaactagtttttcaaaatgctaaacttttgcctcttaattttctcatgcttatgaggagtgcccttcaaatcttgtattagtcaggatgtaattgtatcgctttagcttcttttctctcttgctaaaaaaataaaatgcaatccttaataagagactgaagttcgtaacgtttgtgtcttgtcagattcagtggggaaaaatcagatttgcttgaaaacaagatgataaatatgtggtgttggtgttttcatacaagaatctaaagataagctgtaacagcttagagaacataattgttactgtaccacaaagaccaagttttttaaaaaataacttttgaaggtcttactaaaatttatcacatttataccatgttggatggtgatattggccatgttttcttaatatcaaaatatgactaaagagtgtcatatgttggactccatccacagacacagagacttttctgacatgagccggtctctgagtcttcctttttagaatacgagcttattttctccagaatcatcacagctgtctagagccttcctgttcctcctttcttggagtcactgctggcttcatatttgttcacttggacgttctcttgtataccaactgtgatctctctggggagtcaaaaccagatctggttttccttgtcctcagggaacttgcagtttagctgttctgatatttgtgccatgcactgtccagatgccactagttttctttttttctttttcttttttttttttttgagacagagccttgctctgtcacccaggctggagtgcaatggcgcaatctcagctcactgcaacctccacctaccaggttcaagcaattctcatgcttcaccctcccaagtatctgggattacaggtgtccgccaccatgccaggctaattttttgtatttttggtagagatgaggtttcaccattttggccaggctggtctccaactcttgacttcaggtgatccacccacctcagcctcccaaagtgctgggattacagcatgagccaccgcacctggcccagatctcactagttttttttttttcttccccaattctcttttgatgtggataattccactggcctttggctcagctgctgtatagagcttcttaatatcttaaaaaacctcactgagagccttggtgctgtcttccacccctttcctagtcctggaagtttacttattttaaacaagagcatcaaatgcttcttggaaaattccatcagcgctcatattttctgtgtttgctgtcgattatctagcattcaaagccccgctaacgttcagagcttcttgttgtgtgacattcgcaggtttccttttgggacaggtttggattgacttccttcctctgccaagagggcaaccagctgatgacagtttggagagtttgtgttggcatcagacgggtgctggtgatgtgcctgaaagtcactcctgagattctcgtttatttctgtcccaggctggagtttcacaggcagtggatgttagtgggtggcccgaaccaccctcatcctagctgtagacagaggcagcttcactcagcagggagccttttatcctcaagaccttttctgtacagataaaacgctcagataagatctggagaaaaccctttgttctttggtggctctgcatcctcttttctcttaaatgctgttccttactctgctctcctctggcctctttggtgtgattatcttgatgttctctgtatctgttaagggatgattgttgtctgagtaaatatgagatggcatctttgattatcacatttcccaggaacctggctgatgcgggactcctttctcaaacctgcttgtgaatggatagccaggccctgtttgccttcctccacctcatggggaactcattgtctcctgaaacagcctagtttatcttgacgcatctctgtgagaaagctcatttccccctttcgattgaagtggagtttgtgtccctggcacatctactctttattggttgttctaacctttggagccacacagaccaagtttaatcttcttttcacatgacaaccattctggtattcatatgtgatgagagttgatcatgcttccagctctactcccctccttctgtacccagtgccatctcttagtatctcagtttctttttttttctttttgagacggaatctcactgtcacccaggctggagtacagtggcgcgatctcggctcactgcaacttctgcctcctgggttcaagggatttctcctgcctcagcctcctgagtagctgggatgacaggtgcgtgccaccatgcccgactaatttttgtagttttagtagagatggggtttcaccatgttggccaggctggtcttgaactcctgaccccgtgatccactcaccttggcctcccaaagtgctgggattagggcgtgagccaccacacccggccttcttctccttctttctttctttctttctctctttctctttctctctttctctcttcctctcttcctccctccctccctccctcccttcttccctccctccattcctccttccctccttccttccttccttttgagacagggtcttgctctgtggcctatgctggagtgcagtggcatggtcaatcatggctcactgcagccacaacctcctgggctcaagccatcctccgagctcagcctcctgagtagctgagactacaaggtgcgcaccgccatgcctggcaaatttttgtgaagatgggggttttgcccaggggttgtccctaggggttgcccaggctagtctggaacttctgggctcaggccatccatccccctcagcctcccaaagtgttgggattataggcatgagccaccatgcccggccagcatctcagtagggaaaccactccttcctggccgctcttttttctcttttcttttaaaaaattaatcaacagacattttatttagaagataagcatagctaactagatttcttcccatacccacattcagtgataaaaagtagatcaaatgctttttggatcccttttgacctttttgacaacaatgttgctgggtagatttttgtgggagttctctaccatcgggcacgcttggctgccacagggcaactgcttggccttttcatcccccagtgtcggcatcagttttacagggaacattctgtggctctttcaaggagatgcctccagagccccatttgcagtcatataagttgtgttgtagtacccggggctatggatctcatgaagttatttgtaatattctaacagaaatgaaaagtcttaaagcctcaagtgacttgaaggcactatgtgaagagaaggtttactaaagtgatctggatgtaatataatctggctgctgttttttgtaaaccagactcttggtgatcagcctcaagcagagggggctgcctacatcagctgggcatggagctgatagcagcatcagcaggttccctttgctaagggggctgctgggctggtggccccttcatcctttgggctccctgcatgttcctcagaggctccgaagaaggcagacggggctggccgtccatcacaggcagatttgaacagggaatctaatgtcagccccacaataagagcaggtttcttccaaatctgagagtcgaggatcccatcttgtatttactcagtaacagtcatccctttatgtatacacagaaaatcaagataatcgcaccaaagataagcatagaggtgagtgcagtgaggaacagtacttgtgtgaagagacagacttttgagatagctgtgtggagttgttctgggttcaaggggagtctgcagtgtggttaactgccctgccctgttgaaactagatatatcatttccagaggtcaccgtggtgtttgccaattatctcacagtgaatttgtcacctgtgttcctcacacttttttaaaaccaaaacaacaacaacaacaacaaaccaacaaaaacaatccaccaaaaccaagatttgctttcacgtctcatccaccctacaatcaaatgattggtttcttaggccgaggttagggttaggggcttcaaattctccttattaaacctcatttttgttagacttgatccatgattccagcctgctgatctgtttggctcctgaactctcatatattgcattgtctatgtttccgaagttgtagtggttaaggacacaggctttgggggtgagagagaatgggcataaatcccattccaccacttagtgggttgtgtggttttgggtaaaggcacaatgaagaatcttctggggcatttcacggagcagatgaatggtgtcttatggaacccatggcaggaggcagcagccttgggaaggtagaactcggacaactgagatcaaatacatctccttatctcatctcagcttcggtctgaacatttaagtcctttttcttttcttcctggaggctgactcttccatctgcatgataggcataacagtgtctctccaaagatgcccaattcctaatcctggaatctgtgactatgccatcttgcacagcaaaaaggatatgcttaatttaaggaccttgagctggggagattatcctgcattatttaggataatcacaagagtccttatatgggagacagggaggcaggaaagttggaatccaagaaggagatgtgacaatggaagcaaagccagagaagatgctacgctgctggcgttgaagatggaggaagggaccaagagctgagaaatgcaggtggcctctagaagcaggaagaggcaaggagacagagtctccctaaaatgaggaatgcagccctgttgccccttgattatttgaatcattttaagccactaaattgccaaaagattccttcccttaaaagtcttccagattctacccaccctcttgcagtaatgagctccccacctatctctgagccccatttggaggcagggttgttcctgctttcacatgtcctccatcactcttgtctccctcagtgcctggcacgggcccaacgtagagcatgttcttggtaaatgtctgtggaaccaaagcccccaagggaaagctgatgatgcctttcagaaatccagctgcatgattacagttctttgggctccttctgtagtagctctgccagaaaagggaacaaggttagtttctcctgattttttcccagcgaacctccagtgggattagagatggcggctgcttccctgagtttccctttgccggccgtgggatccctgctctggggcctccgtgttgtgaatgcacctcctctctgagactgaaccgctgtctctgtagtcctcaaatatcagaggttgggttgaaaaaacccacagaaatacagttttgaggccttctagttcttgagtgtactacaattgaaaaggtacttccacattgctgatcccttttagtccctgtggtagccccttgaagcagccaccctcttttcgatttgctcagtgttttttttttttttttttaaattgtaaggatgagtgtaacaacttctagcctctttacatgtagggttggaaaccgaccattcctttattttttgttcagagttgcaggttggtaacttgcccaaagtctcactgcttgtttaggcagaagaggtttctgttcccagtgctgttggaacctcagctcaccacctcttcaaagtcgtcaggaacattctcattttcctctaagatccctggctagacctttgcatcctgctcttccttctacttaagccagcatcctctcctgacccctctatccctgctgttaagatagccttcttggtgtcagggcctacagctgcctgcagccatcttgcttctgttttgaatttgtgttgctccaggaaggcctccagattggcatgctgctctcagaaggcacttggtatcacagtgtcctaggaacttgtctctactgctggggtgcacacacagatgctttagtcagtgctggagtgttggttacctggaaactgcatcctcagccttctttctcttcataatcctctacaggtggtccccaacctacaaaccagatgagttctaacagcttattttgcagttagttgattgtttggagttaggctgcatcttcctgaggattcagtgtcatgaatggtggttaggttctaggcccccaaccaacatctattccagagttcagctacaatagtagctgttgtatagctgaactctggagtcatgaagagaatggtctttggactcagacaggccttgatgacttctgattctgctctatctgggtgaccctgggcaagtgatttaaccactgagcctcagttgcttcacctgcaaaatggtgttaattaatacttacctggcggggttgctgaacagtgaatataaggtgtttaacatagtacttagcacttggtaaatgctcagtattatttattactgcactattacgtatctagtttgtttaatagcactaaatacctaattgtttatactgccctttcttcctttcctttcctttcttttctttctttctttcttacagagtcttacccaggctggagtgcagtggtgggatcttagctcactgcagcctccatctcctgggttcaagcaattctcatgcctcagcctcccgagtagctgggattacaggcgtgtgccaccacacccagctaatttttgtatttttagtagagatggggttttgccatgttggccaggctggtcttgaactcctggcctcaggtgatccacctgccttggcctcctaaaatgctgggattttaggcatgagccactgcacccagcctattgtgccatttctgtgggtaaactgactccaaggtcaaatgctacattagtcactcagaattgaaatagtgcttttttttttttttccttctggggatttcagattgctggggaaaaggagtctctctcgttcatttattcattcaattcataagcaattgcattatgccagatatactggggggaaaaggtgagcaaaagccaatatagcccctgttctcatggatgttacagatggatgatggagacaaatattaattaaaacaaaaatcatctaaatgtgaaaatacagctgctgtgaaggagaggtgatgggaaagggtctagggaggtgtttcctgggtatttgatggatctctggattggttctttgtcattgggtggcagacactgtcttcagctaagtggctcagagctttgacagcattgactttgcatacgaacaggggtggaggtggcttgagcctttgggggttggtagtagaagcagcagtccaagttgtctgagatgttggggacaccatcagggacacctaagtggcgggttaagggggaagcatttacaagagaggagtagctgggaagaggcattgctggggaggagaggaggcttcttgtctgtggatcagggatgctgggttctcaggtggtgcttattaaggagtgttttaacttggctaccccttgttttcagccaaaataacaccccagtccatatttcctgccactgtggcttcctatggctaaacaagcgtaatgaatatcttgttccatataattgcctccatctcatgcctcattttttggtactcatttcttgctctcaattcctttctgtttctctttttttctctcctattcggtttctcccgttctgctctgtgattaatcagttcggtttttcatccaattatcatgtctgtcttggagaagcatgtttcctggggaaggttggtctaccatggttgcccagctctctgcctgctccttcttccttctgtaagatggcagtttgctgtatttttagccctctagttctactctttggcttgtgggaaactgtccacagctcataaattatcaccacattgctcataatcacaccctaccttgtctagtcccctgagcttggagacttactgggcttctctttatgtacctgtgatgtgatgctgtgtgttcacgggcccagggagatgtttgccctgttcttcctggcagaagaagagcagtgttctgagacctgaccagcatgtgtgcccggtgacctattgaatgatgtgagtttctctgcgctggccgtccgacatgccagagctggcgggtgagtcgggagttggacatgcagccctggagtgaccacactgactgcgtcagtgggtttcactgcctggtgccttttttttttttgagacagagtcttgctctgtcgctcaggctggtgtgcagtggcgcaatctcggctcactgcaacctccgcctcccggattcaagcaattctccttcctgcctcagcctcctgagtaactgggattacaggcatgcgccaccacgcccggctaatttttgtatttttagtagagacggggtttcaccatgttggtcaggctggtctcaaattcctgaccttgtgatccacctgcctcggcctcccaaagtgctgacagtaaggcgtgagccaccgcgcctggcctcccttttcttgacattgctttaaaaaaaaccctttaattttagaatagctttagactgataaggaaattgcaaagatcatacagaaactacacccaatttcccctattatcaatatcatgcaattggtttgccataattaatgaaacatttttgataaattattattagctagagtccacactttatcccgattttcttagttttatttaatgtcctttttctgttgcctgatcccatccaggatactacatttagttgtcatgtcttggctgtgatgctttgagatattccttgtttttgatgaccttgacagttttgaagggtattggttgggtatttgctaggattggaatttgtctgatatttttctcatgattagactgcgattaggaagtcccattatggggcttctatgtgggaggaagaccacagagataaagcacccttctcatcaaaggacatatcaacatgatttatcactactgatattgatcttgataaagcatgtgcttggctcaatcagtgtctgccaggtttctccactgtgaagttattcttttccccctctttctatactctagcttctgtgaggaagtcactatgtgcagcccacacataagaagtgaggagttatgttccctgtcctctggggcaggttatctaaataaattatttggaattctgcatgggtgagttgtctgctcttccccatttatgtatttatttagttataagtgtggattcatggatatttattttatactttgagttatccaacactattttttgggccattgggagatcttttagttggctcctgtgtccctttgatataccttaatcattgtgggtaattttggttccttttttaagtacttgtttaatttctggcactgtaggatactccaggctcatcttgtatatttcctgccctagtcttagaagaataagccatttattcaaagaaccctgcttccttttattggagaacttgttggtattagagaccaagatctgggtgctaggtactcattgatactggagtactgttgtttctaggtgctctcagccaaaagagcaagaaaacatagatgtgtacactagcctgtgtatatagacatgtttataaatattcctatatgtaaccatctacaaatcaggtgaaacatgagttcatactgatgtctccactttcatcaattaaccacatgggtcattctaacctcctccccttgcatgtctataacttctcactccagcagtaagcagactcccaccacctggcatctatttacttaattgttcaattccactatacacatatagtggtttcggaatcgttaatgcattcctctatgggaaacaactttatcaactatagtaaaatacttatgtacagtacctttgcctttggtcttacagattccactcatttctggagttatttagttcagcatgtttttctatcacctccttctgtgaagttgtttcatataatttttaatgcagttagattctttttagtctgatgactcttgaaaagagataaatgagcaggaagataaagactcagccattagggaactaagttagaaaaagcttgtgaacaattcgttttctatctgctgaatgtttggtggctccatgctgctggatgatgatattgtactattttcccatccccttgcttttattcccatccatttgctatgggctgaatgtgtcctcacaaaattcatattagaggttaaaatcctaactcccaaggttacggtatttgaagatgggatctttgggaggtaattagggttagattaggtcatgaggatggggcccttaaaatgagattattggctttataagaagaggaagagtgagagagattatctgtgtgctcttaccaaggaaaggccgtgtgagaacatagcaagaagacagctacctgcaagccaggaagagagccctcaccaggaactgaattgactggcaccttggtcttggacttcttacctcaagaactgtgagaaatatatttctgttgtttaagccactcagtctgtggtattttgtcatagcagcccaagctgactgatacaccattatatatagaaaaagtatagacatccctgtgctgtggagaggctcttaaaccaaatttcctaattcgttttctacccttaaacaccgaaaggaaccctctttcctcctggcttaggagatcctgggcttaggagatctgttcaggtaatgttcttggtggtgcatttagatgtaagagctccaggttaagggtctgacaagacacttttggctaaaacaagcgttaggattgggagaatgtttctcagtggaaacagtataatcacctaactgaaggaaaaaatggcccctttccccaaatattctgagcctgctttagagcaggagagcccacttttacagcaggaaacaccctgagaaggaagtagagaatggtgacgtcagtggccctggatctgggtcccgtccctgctcttcagtatgcagagctgtcaggcgtcgtgtgctcctgtgtagagtgtcaggggtcgtgtgctcctgtgtggacagggacagcagcagggtcctgcctgagatcatgaatatggatgtgagtgattgttcccaggcctaagtgaaaggctttcttgaggcagatttttctctgggatgctgattgtgagtttttaatgtctcccctttcgttattcagtgttcttggcttctttagattgatcatcatgtcttctgcctacaaatatctgctcatattttacaagcagagaagtgactggagctgtaaccagcctagctgaccaaatgaagtccatgtggggccctgtcatttatatgggtgattaaaacaaaaacaaaaaacccttaaaccctgccagagggtaatttttcatggtctgccttttatgtttcttccttttttctcttcagtttttttctcctttccttgcagttattttttttttttcttttattgcctgtttcatttcacaacctggcactattctggtagaaatgtctgcttcctgccaccctcaggaagtcagagaacagggtaaatttgtccagggcttcaccccatgatttctaatggtgtgactcaaggctcccatgggagagatctacccaggaaaataaattgtgtgttggtttttaatacaagaaccttcataaactgagctcctaggagaaaatgaagacatttaaatactcttctctttttgcagtttgctctgtggtcatcagttaaccacccaaatggaagtgcatgtgttaatgttcaacagtgggttaatgtctggaggatggttttggacagcatagttcggagcaggttaatgtttaatgtaaaagtacttagatgagtacttggtacatagtaagagtgtttaagagttaattacattattattattattgcaaactaaaaattgctcccaggttgcatgttgtgagatagtaaggcgaaggtgaggcacctagtgtcagtattggctttaggtggaagaaaataaactggaattgctattgttgcattactggtgtaagaaaagtggtgatggacatggaaatagatcccagagcagaggtttgggcctgaaaatttggaactaggaagtttgaaagtgactcatctaagggaaggcaggggtgtgttagatggtccccaaaagcctttttgccttgagaatgtgattttatgtaagttcccctccacctggagtagtttgggggtagaaggtaggcatgaatggctatgggggttctgtagaggagagggagaagaagtgactctttttgtctggtttggattctcttatcaatgtttttgccggcattcccaggataaggaggtatttccatatgcttctgcaactggtttttgttaaacacagaccatacctcttcagctgatcgtgtcacacccttaggggctcagctgaactcagacaacaggcaacagccagaggaaggaaaaaagtaatagtccataaaattaggtaatggtcctgctcagaaatatttgagcataaataccaggttatatctttttatttgtacccccaacccccatggctgtaaacacatccctggagagaggaaataaatgtagcagatttcatactgggctgaaggggaagagtgtgggatgggtatctgttttatgagacagccttttttttaacgttaatttctgcatgattaacatcccttgaaagagttatttttcctccattcttttgttagcccattctggtccagcttccatgccttccactctgacatcaaagttcttgctaaggtcatgttccatctgcatcccgtcttgtgcaatgatgctccagtctttgcctgcttaatggtagcctttggcttacctgacccctccttccttcttgcatccccagcttctctgggcttctgggatgccaggctctccagatttcctcgcatccccctggtcgctccttctcagttgtctgtgtctgcttctcctcttttccctgtcttcttagtgttggcctgctagagcatagatcctcattctgaatgtgggaaaagcagatgatgattcattggatctcgggtggaatccacgattctgcatctctcatgtgctgccaggcgatgctgttgctgcggggctgcagagccaccgcagctcggtgctggagctccatcctcgcttctccatctatgtgacttcctagctgagctcctccagtccccggctttaagtcacacctcgaatcttattggtgacttctcgccccacttgggtcaaaacccagagttatattcaggcccacgacaccctgtgggtttggctcctgcccactcctctgcccttagctgctctgccctccgcgtctcccactgggctctggccaagtctgccttcccactgattcttcgatttgtctagcacgtttctccttcctgagctctaaacttgttgttctctctacctggcactcacacggcttagatctcatcttctctttcaaagcaaatattcccttcccagcgagggcttccttaactgtctatctagaatggaccttcactaccaccaccatcacctcgctgtcacctaccccagttcattttcttaccatgctatgtgagtttcttattcatcctcactctccctaccagagtgtgggttctgtgggaaaaaggaccttgtctccccatctaactgctgtagaagagtgactagcatagtaataggatcttggtaagaacttgttagtaattacataaagcattagtatcagcatgtcccagatgagctgatgagcacagatactaccacgccattccagtgtctgtgtttttaatggtttgggtatcgggttatattattgtaagtatcatgaactagtggaaagaaccaagatggacagaacacataaacgatgcccttacaccccatgaagacccaacagttttatggcaaactagagaaatgaaggtttcatagttgtttgaataaaaaaaggtggtagaaaattgaggcatctcattgtacaaggtaggtaacatctgtgcaatgaaatcatgacttgcactattgaagtccctgttcacaccatataaggtgatacagtttcagcaaaatgatcatcctacatattaatgttgtgaattggaattatattggctttgtaattgcatttgtatttaatgtgcagatgttttggtattgatggtaatataagaactataatcgttttatatttgtacattttatgagaaacattaagtgaacactaagaatcgttgagatttttttttctttagaggcatctttacattatacaggcttgtgaaagactaaaataggaactaagcaagattgaaggtgtggctgaggacagggaaaggaaaaagttttaaattccaaaactgcttgtaggaagctatttttaacaaaataagaataataggctgggcgtggtggctcgtgcttatagtcccacctacttgggagcctgaggcaggaggatcccttgagcccaggagttggaggttgcagtgagctatgatctcaccagtgcattcccacctgggtgatggagcaataccctgtctcaaaaataaaaataagaaaaaaataaaaagacgctgagtgggctatcaaattttagcatgctttcaagagagtgaaattttaaaatatctacattcaggccaggtgcactggctcacgccttgtaatctcagcactttgggaggccaaggtgggcggatcacttgaggtcaggagtttgagatcagcctggccaacatggtgaaaccatctctactaaaaatacaaaaattagccaggcatggtggcatgtgcctgtagtcccagctacttgggaggctgaggtgggagaatcgcttgaacctgggagatagagattgcaatgagctgaggctgtgccactgcactctagcctgggtgacagagcaagagcctgtctcaaaaaaaaaaaaaaaaaaatccgcattcatatgaatacacaagttgtactgacaaaccctaaaaggttaaaatatattatcctttttttgtttatataattaaaacttcaattttggattaccagtctaatttctggttattgaaaaatgtaaattgtgaaacttttcttgctggagacatctatatattataaaatatttaaatataaaaataatggagtaatggagtagatggcctttactcaccaattctagggcctggcttaggaaggtatgtaggcagggacccccctcccccgccacaattctaacttgtgccccaggccctcctcctttcttctggctcctggagatcagagaggaagggattctgcacttaagaaatggcgctaagaagaagaagacacattctttttttttttgagacagggtcttgctctgtcacccagactggagtacaggggcatgatctcggctcactgcaacctctgcctcccaggttcaagggattctcctgcctcagcctcctgagtagctgggattacaggtgcacactgctatgcctggctaatttttgtatttttagtagagacagggtttcaccatgttgaacaggctggtcttgaactcctgacctcaagtgatccacctgcctaggcctcccaaagcgctgggattacaggcatgagccaccacaccaggccacattttttttttttttttaaagacaggttctctctctgttgcccaggctggattatagtagtgcaatcatggctcactgcagcctcaacctcccaggctcaggtgatcctcccacctcagcttcctgaatagctgagactacaggcatgtgtctccatgcttggctattttttttttttttttttgtattttttgtagagacaaggttttgccatgttgcccaggctggtcttgaactcctggggtaaagtgatccgcctgcctcagcctcccaaagtgttgggattacagggatgagatacagctactggccaggagacacattcatgctttgaaaggagacatgaatggtccttctccctcacacatttcctttgagtgtatgtgtttgtttctacccagttcatttccacatataatttgaggctaacagagccatctatatagatctgtgatgccagggagcctggggcagaagatgaaggctggaatggggtgagggtgctttaggaaggagagagggagctaagggccacagcactgcttgcagtgtctaaatgaatggccgttctgcaagtacctgaggggctggtgagagcaaggcacagcgtgtttggggtgactttaggatttgggtttgggtagtcccccttcccctgctgcccatctgagagaattctggggaggaaggtcttactggggcatgaggtccctggtgtcatcaactttgcaggtaacagctgtcttgaacaacaacagagaacctgaatttatacatgtagcaagctgctaggtttctaaaaatatttcagaaggtttattttgattttatttttaaacattttgggtgcctacacagtgttatcttccatgtttttaatagccacactatacaatacagagtaggtttctgtggacaaatacaggtgcctatcatttatagcacagtctctctgggacccgtgcaaacaactgactcatgcgtttatgagactgggttggtttgtgaatcgatgacgcccagggagctgggaaggctgcatggcatggacgcttccccagtggctctggattttgcaatcatttggctaaatttgctcatgatgcacattccctcacccctttccctgatgaggacaaagatggctaattttccctgattggatctgttgttttgagtgaccgagaagaaagagatactttgctgaaagcacaacatattccgagggagaatactgagctttggaattcactttgcagacatctgcgaggatgttccgggagccaggcttgttatagctggcattgctggaattccacacccccccatgcctcccttaagagatacttgataaccccagggcctaatttctacttttggaacatacataccttgtgaagtggaggctggaggtgggaaggaaagcccccttgaggctgtggatctggttctcatgttttaaacagttttaaatattggggctggagatgcctgaaggatgggtatttgttatggaaaaccttgacttttttttttttcttttacattgttcacattttaaaacaaagttcagagagctgtgtacattgagcatgctttattagttcattcatttatgtgtgaaacactgttctggatgccagaaatgtggcaaggaggaaggcctggccgaggagtgacacttccactgagctctgacagatgagagcttgtcttggtggcacaccagtgccgcgggacatggtgacatgctgtggtccacagccctccagtgaccatgtgagcataattaaatacaaactgtgggaggcagaaaagtgaaaatgtggtctctgctcaagaaagagtgcaggtcttagagacaaagtctgggtctaaatcttggtgctgcccctggcccaggtgtaaggcctcagaggaaattacctgccagagtttacacatctctaaagtggagagaagaggtgctgtgaggatctcatcagacaagatggtacaaagaaatcaccggggctggcctcgtggagggatgatgtgtgtgtctgactcagaatcagtagaaaaagcttaaaatgtggttgctgggacaaaactaatctaccagagaagccgtggctggagagcctgtgttgagctgtgtggtgctggtctgtgctggaatgccaaggaagaggcaggagctgcctccagtaggtgagcctcgaagaaagaacaggattttcataggtgaagggagacagatttttactggaggaaaaaaaaatgtctaaagtaaaggtcataaaaacagactgtgggccgggcgtagtggctcatgcctgtattcccagcacttttggaggccgaggtgggtggatcatgaggtcaggagatcgagaccatcctggccaacatggtgaaaccctgtctgtactaaaaatacaaaaattagctgggtgtggcgacatgtgcctgtaatcccagctactccggaggctgaggcaggagaattgcttgaacccaggaggcagaggttgcagtgagccgagattgcgccactgcactccagcctggcgacagaactaggctccatctcaaaacaacaacagcaataaaaaaaaaaaaagtgcagctgcacagtttaagaacagaagcttcttttgttgggtacttgcaaaaatattcccttcctcttggtagcgtggtctaatggtattaatgccaacagtgtgaacctgagcataaggtatgccctgagtttgagtagcttttcagtgctgagttgactacacaattaccagtgacaacactgagaaatctaagaagactccacttgacttggggggtgggtaatttatttcttggacattttggcttcagtgtaggtttaggtaagtatcatatgtcagggatggcaagtgcattttattttgtgtctgcactaaccaaccaattggtagtgactgcaggggtgcagtgatgaggaggattctgaagccagatttgcgcttagagagaaaacgataataaccctttattgatataatttggacttaggcttcgtagaggaaactgtagcacaaacggtgtggatctgttatctctggttgggaggttttctatgtacatgacagtatgaagatgttcatttattcacccaacaaatatttattaaatctccgctatggacatagcattgtactttagattcttagccctctggcttcttcattagttaataaattatttcaggatattggtggttaatgctgcttggttaattagtgggggtttttagtctttttctcataagtgtttcaaaacattttatgaacaaagccagctttcttgtgcccataaatgctacattgaaatctttctcagatccctcttattttttgagacagggtctctcagtctatcacccaggctggcatggggtggcatgatcatagctccctgcagccttgacctctctgggctcagctgatcctcctatctcagccgcctgagtagctgggactacaggtgcgcaccaccacactcagctaatttttgtatttttcatagagatggggtctccctgtgttgcccaggctggtctgagactcttgggctcaagtgacccacctgcctcagcctcccaaagtgctggggtgactggcgtgagccactgcccggctgatcttcgtcatttcatttagcatacaatatgtgattttcctaattactttatgaagtcatcactgacagtctgactttagagacaggaaaacagagaaattaaagaacttctccagagccaatattggacttgagccgcatgtcagaaatatttcctgcttctgcatctcggagtcaggtgccattacttgtcttcagaaccttaaactttcgtagcttagctctgccctggtaggagaaactttcagaaatcattttaagcctcaagaggtgaaaaggatgaatgacttatctaacactttttttgggacatgaattctgtatttttttcagtaaccatgaagaatataaaatacgaaccactgaatttattaaagtaatacaaattaaaaagtaaaagttaaattgataacatatggacaccgtaaattaagtggtgatatatgtgctaatcagttaagagaagtgggcaagggaagtgggacccatccacagggaaacgaggcgggtagacttccagggggaagtgggggcttcttgggggagagccacttggtgcccatgctctcagggccaggccatgtggatcagatgagttgagtcccagtgactccacattttcttttttgagatggagtctcactctgttgcccaggctggagtgcagtggtgcaatcttggctcactgcaacctccacccccagggttcaagtgattctccctgcctcagcctcccaagtagctgggattataggtgaccgccaccatggccggctcatgttttatatttttagtaaagatgggattttgctatgttggccaggctggtatcgaattcctggccgcaggtgatcaacctgcctcagcctcccaaagtgctgggattacaggcgtgagccagtgcgcctggccaactccagattttcagactcctggttgattctcctaggtctccaaccctagtaaaaggagcctttttacaggcttttcttttttgccatcttcctttttgtacaaggtgggtttagggggaagctgtagcactcaatgttataagtttattttttccccccaaatagaaaagttttagttgtcaggttcatttgaagacattcgaaccatcctgaactgtgtgaaacagagagcaactctgctttcatttccaaacctcaagtttatttttgaaattgttttcccagggagttctgaagggttgactgtatacaaagacacttcctttaaaatctgaagagtttggtcagtttcctacatttgcactacaaaacacgtagagagaaaacataaagctcagtttaggtaaggctgcctctttctgtcatgttagggaatacattgaaactaatatgtgttttgctaatcttggctttccacaccctgatctttcaatttcatctggttgaggttctagtgtgaatatccccatacaaaattctgtcttcccactagttccacagacacatcctttaggagtaaatgtgttaaccactgtttagcaagcttgtccaacctgcggcccgtgggctgcctgtggcccaggatggctttgaatgcgcccaaagcaaattcgtaaacattcttaaaacattttgagttttttttgtaattttttttttaaacctcatcagctatcattagtgttagtgcattttatgtgtggcccaagacaattggtcttcttccaatgtggcccagggaagccaaaagattggccaccccggatttagaggttttagctcatgtttatcatcagcctggtagtatcttctctttaaatgaggcagtcacaggatcccactcaggggaaattactttttggttggtgggtcaattcttatttcctagaattaagctcaagactgcactgagactcatcacctctctacccactgtattagatgctcttttaagtgatttgtatggtaaaatagaattacttgttcaaagcaaacatacctagagtctctgccccatgctaggtactatgccgattgcttgggccagcctggcttgactgatggggactcttgtccttggaggcaagggccagccacagcataaaggtgaaggtttcagattgcctggttgcatttcctccgtagccacagggcccctggaatggctggtgaatatgcatgcaggtcctggaggtgccactgagaattagagttgtggggcggggatgtgtggaccagcattacgtgactaatctccatgctcagctgataacatgtgatggcccagagagaggaaatgtttctatctggcatatgttcatagttcttccaagagctaagccctttgttcttacaaacacactcgctgatctcgctaactaaagcaattatcatcatttagcagtcttttcataaagtattatttccactccaaaacaccacttttatttgccaagtgccacaatgttgcatcctggcgattgatcagcgtttactgccaaattatgtaagcctttggttaggcttagtccccgacggcgcaagcgtgtctgtggtgtgcattaggattgtaaacgtggcccagtgcctggaagtggagaacagctgtccctaaattcattaattaattcagtgtttacactttgattgggaaggaaatccacatttgcttaagacaccagtgcccagctgagaaatgttgttccatgaaattattggattgaggtttgttgtcaaggaaatgtaaattgtggatgtttcatgaaatttaaatatgtggattaattgaccaacagggagctaagattgtaataagccaaggtggctttattcaaagattgaaatgtaattagtgttgactgtagtaggaatagctatttgaatggaccataaatcctgcacaagaattttactaataaaagaggaaatattttcattgaaaagtcagtgtcagcataagaactgatttttcttacaacacttattggtgagtagaataaccccatttagtaaataccacacacaaaaaatttcttctgtttaaaaagattattagaaactttaacaaatatgaagacttctagagatgcagaataaaatatgccaatgctgctcagaaaaaaggggttaagacacacctggttattttggtgtcagccctcacgcatcacttcattagtctaaggcaagctcgctgtacttgtccttagtattgagttgttttatgatattagtagccttgtcaaaccagataagtttagaagttcttctccttttcaaaattccactcaaatggtagtaaggggagaaaaaatgtttaaacctgcaagaggcaaaaaatggcagtggaggctttggtggcaactcctgcaatgatgcaggggtgatccccgggctggctgagggttagacccctccacccaaagtgcccacattgctgaaatgaggtgctttgcctgcagaaccacagagaggctcagaagtgggaaggcattgttaccatagtaggccagagagattggccaaatatagggagttattaaaaccagcataattagaccctacaccctgtccctgtctcccttccccaccccagcagcagcctggaggtctgttctctggagaaatggaactggaatggtgttggggtgttggtgggggtgactaaaaagagagactgatgacagctgggagcttggtcactcttctgctctgtccatgatggcagcagccaggcgtgtgcagccccagcaatgaagtggaagactttccttgagaaattgaacaactccagaaaaaaatgcccccagataactgaaatgtatgggttcttcagtggaatacttttttctttcacattaattgacactcaccaactaatagtcttctccacacttgcagagccaccaatctgctttggtccttcattcttaaataggatcaggcagtcagggttcatcaggtgtattaccaaagccttcaatatgaaaagtaggggccaaaacaggaaaagaacaaccttgcagaagatggtgttgttgcagaaagcagagaaaacgtgtttttagaagaaagttacagttttccttgcagagagaagttatttcatatccaaaataataataacatttatgaaagaggagcaattagagaacaagaaagagctattgagtattacaaattaaatactggaatttaaaaaatgttgaagttgtatctctgaaaagtagagtaaaaaagatggagttaaaaagcaggagagaaaagaaatatgaaaaattaaaatgtgatctaaaaaattcaacattgctattatagtagatgcagaaaccaagaacaaaataaaatagtaatctgaacattatcacagaaagaatgcaaaaatattttatagaactaaagacatgaatttccaaattgaaagaatatatatattatgtgctcatgttttataaaagagtccactttccccaattttataaaacccacccctgggtatgccattatgaaatttcagaataccagtgataaaaggtcctaaaagctttaaggggaacgtaaacaggtcacacacaaaggaaagggtacaatgagcttcagaattcttaaaaacatccttggaagctagaagataatgaagtttgcaaagctttaaaaaatacgatggaaattatttctaacctggcttctatgtccagctagaccaccaatcaaaagtaagcatagaataaagacatttttcaaaatacaaggagtcaaattttttttccataggactttttcttagaaaactactggaagtgtcttctatcagaccaattgggtaaactaacaaagaggaagacatgaaacccagaaaataatataacacaaaaggaagagagcaatgagaccctaatatagggtaggaggagggaagactgtaaaaaagaggtcaccaaattacctgatattttgatcatttggaaattaataccgataagcatctcacagatgtaatgtagttgagggaaagatttaaggataggtgtatagaaaagacaagtaaaacagtaatcgatcattaacgctagaaaagtaaaaattttataagaaaagttctgtaagaccatagtatataattttttagtgaatatttatattgtcataataatgtaaatagttgactcttgattttattattggtaggttagccaagtgagagacttgtatgtatggtgtggtatccaccctatgtagaaccaataagttaaggaatcacagtcaggaatattgtttagcaaaagggaggtaagtattagaagaaatagctgaaatttgcaggtttttttgtttttttttttttcctcctgggcagtgtgttcaggatcagggaagggaagctgaagaatgtaggttttcacttattttactttgattaaaaaataaattatttaaaaatactagtataactgaaaatgaaagttgacaatgaaatatttggaattggtgagataatgataaatattacagatgaatgtacctctctgagttgttcctatctttaaagtggtaaatgatagtagctaaaatgtttgagatttaaaagaattatcaccaagcaaaactgacaacactatgctactggtaggaaactgaatatattcagaaagccccaagacagaacagagagacaaaacaagtaaagatgtgctagagccaaacaacataattattaaggttgtacagatggatagattttgaatgttatcccttaaaatggagactacacctagtacctgtgaagcattgacaaacattatccgtatatttgctcacagagggaagctcaatatatttaaaaaggaagaaatggtagagacttcattttctgaccacaatacaggtagagattagcaacatttacaaataaagaccctccaaacaaaaacagcacagcaacaaaatactacatatgcaacaactttctcagaatcaaatcttgggtcaaagcagaaatcaaaaccccaaagagaaactatctagaaaatagtaatagaaacattactgtggtggaaactgtttactgcctttctaaagtccattctcctctctctttttactaacagaacattgattttgttgcatgttgatgaccagcttaagtaccctattttccagtctcccttgcggctgggggtggccatatgattaagttctcactaataagatataagggattattgttaggtggggattccaggaaagctatttaaaaagaaggttgagtcacttggcctaagcttttgggctatgtgatgctggatcagctatcttgtaatcataatcataagctatctttaatcacatgttaaagacagatgagtggaaagatagaaggggtgctccttatcccagggtctctttcagtcctagacttcctatctctggggaaaagttcctgtcttaagctgctatgtggggagtctattagtaggaactgacataatttttaagtgacatagttacaaaccacaatttatgtgattaaagaatgaaaataaacaagtaaagcgtccaagtcaaggagtcagaaatagaacaacaaaataaaacaaaggaaagtggaaggaaataataaaaatcaaactagaactcagtaaagttgaaaattaaagaaaaaaatgcttgataaatccaggagctagttctttagggaaacaatttaaaaaaatacatacacatatatattctaccagtgtaatcaagaaatagaagaaaacacaacattagataataaatgatttatcctacccaaattctgcaaataaatttgaaaattggatggaatagatgattttcttggaaaatgtgctagtagattgactctagaatagaaagaaaactcaaaaagtctctcaaaagtggaaaaaaaaaaagacaactgttatttgtgaccagttgctactgttcttcctggagtccctttgccattgctgttttgcaaagtgttagaagtgaatttctggtgaggaacctcggagtgtgaggcagggtgagcatcctgcttggtgagctctctgcagtcatctggcaaggttggccacacaccagaaaggcaacggcaactattcttggcatcaggacccatcacaaaacacagagccctgagtgttcttcattttttaaataatattttccagatcaatatgctattgaacttttttgctaagaagaaaagattgaaaatgatttataatcatttaatttcactgtcagtctcacaaacaactgattccttatggtaaaagtgttggaaacattatattcaaatagtagtgttaaagattttgcagcaagattgtgggtaaaaaaggctgaaagtgttttgagaggaaaatgaactgcagagtaacaaagaaaaatggtgagcgtcagaattccttagctcttaattattttcatggaaaagtacctagttctcaaatgctggtaactggaacatcctattggttaaaaataaacagcataaagtttcaggaaaccaactaaacagcaaaaaaaaaaaaaaaaaaaaaaaaaaaaaaggcaaccagaacagcccaaaacagaataacaaagtcagaataatgaagctacgccaaaagtgtcaggtcattacacgggttgtctgccctcaggccagggttcaaacccagtggtgacaaactcagtggccacgtgggctgaagggcatccagaaagtcctgctgggtcaccagagggctgcccttcagcacttggttctgaggtgtctttgctgtttaaaatgtcttgttttctttgaactttgaagtttccccttcctaattatttcagtcttcatttaaacagatgtaattctaacctaatgtcctctttttaccccatctctccctggtagctggaacagtgaaccatggagctgtatttcggtgaatatcaacatgtgcagcaggaatatggggtccatctgagactcgcaagtgatgatacccaaaaatcaaggagttcccagaactccaaggcaggctcctacggtgtcagtattcgggtccagggaattgatggtcacccctatattgtcctgaataacacagaacggtgcctagcaggcacatcgttttctgaaaatgggccaccctttccacctccagtgataaataacctgcctctacattccagcaatggttctgtgccaaaggagaacagtgaagaacttcagcttccagaaaacccatacgcccagcctagcccaataagaaacctgaaacagcccctgctccatgagggcaagaatggagttctagatcgcaaagacgggtctgtgaagccatctcacctgctgaactttcagaggcatccagagcttttgcaaccctatgaccctgaaaagaatgagttgaatttacaaaatcaccagccttctgagagtaattggctaaaaacgttgacagaagaaggcatcaacaataagaagccttggacttgctttcccaaacctagcaattcccagcctaccagtccctccttggaagacccggccaaatctggtgtgacagctattcgtttatgcagctccgtggtcatagaggaccccaaaaagcagacctcagtgtgtgtaaacgttcagagctgcaccaaggagagggtgggagaggaggcccttttcactagcgggaggcccctgactgcccacagcccacatgcccaccctgaaaccaagaaaaccaggccagatgttcttcccttccggcgacaggattcagcgggacccgtcctggatggagctcggtcccggaggtcctcctcgtcatccacaactcccacgtcagccaactctttgtacaggtttttactggatgatcaggaatgtgccatccatgccgacaacgtcaatcgtcatgaaaacagaaggtatattcccttcctgccaggaactggacgggatattgatacaggatcaattcctggtgtggatcagttaattgaaaaatttgatcaaaaacctgggcttcagagaagaggaaggtctgggaagcgaaacagaattaatacagatgacaggaaaagatccagaagcgtggatagcgcctttccttttggcctccaagggaactcggagtacctgattgaattcagtaggaacttgggcaagtcaagcgaacacctcctccggccttcccaggtgtgcccgcagcggccactgtctcaggagcgccgtgggaaacagagcgtgggccgcacctttgcaaagctgcagggagcagcgcacggggcttcatgtgcccactccaggcctccccagccgaacatagatgggaaagttctggaaaccgaaggtagtcaggaaagtacagtgatccgtgcgccctcccttggtgcacagagtaaaaaggaggaggaggtgaaaacagccaccgctacgctgatgttacagaaccgggcaacagcaacttcgcctgattctggtgccaagaaaatttccgtgaagacatttccttcggcctcaaatactcaggtaacactagtgcgattcctgtttggttttttttctcttccttctaaataatgtaatgatgtacttatgctgcaggaggccataggaattacacatcctcaatcttgtatcaggaatcacacagctgatctgtttcaggatccagttgtgtcctactgacgatgtcctactgccaattgtatagttttctgggttctttgaagttcagctggattcccattgtgatctctctgtaaagtaacttggcagacgctacagagaggctcaattgttctgtttgtgtatgcatgaaatctgaaagtatgcagaatttgtttctacacagaggctgaatagttaggtttgtgtaggtatattaattttcctcataaaattgagtgactgggttaatttctagcctgaaaaattaggttaattttcatttaggttaattgtcaagtgagaatctaagtggcacatttagtgttttgatagtaacaataaaaaataatgatattgataaaatggtaaaaaaaaaaaaaaagtagctaagtgctaggcactgtttgttatatattacaggattgcaccaaccctgtgcaggtagtacctattaacctcaatttacaggtgagaaaattgaggcgaggagaagttaagtaacttccccaagattatgaagctggtaaatgttgtaactggctctaagaaggatgctcactggaggaattgtttggtgtttggaagcctctgggaacttcatcctcatggtctaacaacaggccttatgttccaggccacaccggatctcttaaagggccagcaagagctcactcagcaaaccaatgaggagacagctaagcagattctctacaattacctcaaagaagggttagtgattttccctctgaaagagcaaagtattgttgtttctggtgggactcttaatttccttttccgaggctttaatggttaccttcctttcttgccctgtgccagccgttggagggttaaaactcaatggctggggttttcgtgacggcatttgtcttgtgtggtatggggtgggggctttgggaggggtgtgtaggaaaggacaccatactttaaaaattaaaatgaatacatttttaaagtgaccctttactatttcaaaagcaaattcaaagataggaggagtttctactcttcaggtttgaatggagtccgccatcaccttgagttcttccgtgcaatgtggtagtcctttagaagttacaaataaaaacacctcccctccccagagttaacattggccaagagcccctgcttccattatttttaaagcatgtgtgagtcatttaaaagcagtgctttccatgcttatcttggtggttgaggtggaataatcagggtttcagcccttacttagatactaactgtgctggaacttgagcaaggaatttgaggtttctgtttcagttctctcaacagatgtgattaagaggaaggacaaaaaaaaaaaaaaaagctttacagcctacatgactgaaaaccagccacttggcaaatcctcattggtatcaaaatactgtatatttttgtattgtgccttacaattatttgtcagttttagagctaacaacatagtaaggctcaaaatataaaacaggggatcttttgaaagggggaaaaaaaaagtaacctgaaagattaatctagctaagaactggttattagtatctccctgtggaagactttaccatgttaagattaaggtagaagaaatcttgacttttaaaattcattattttttttttattttttgggacagagtctcactctgtcatccaggctggaatgcggtggcatgatcttggctcactgcaacccccacctcccaggttcaagagattctcctgcctcagccacctgagtagctgggattataggtgtgcgccaccatgtctggctaatttttgtatttttagtagagacacagtttcatcatattggcaaggataatctcaaactcctgacctcaagtgatccaccagcatctgcctcccaaagtgctgagatgacagacgtgagccaccgcacctggccaaaattcattaaattcttttatgtatgtattttttggcacatgatttattgagacattggtaagacagactttagtgggaggtgcctgttgaaggaagtttattttaaatctttttcttctaattgctgacggtgtggtagaagttaataaaacttagtatctccgtgttacctgtgaaagcccagacaaagggctgccatgctgataatcttggcttaggggttttatttttttaaacataggttaaacaaattaagatcattgtagatcattcttagtgtaagattcagatgtacagcatgtttgtgtgtgtgagagagatatacacatacgcacttcaaagaaaaggagaattctttttggaatggacatgagcatttgaatcaaacaacaaattactaaatgttcactgggtgtcttctccaagcttactgaggatgtgtttatgtgcctctcacatatttgcaagtgggaaccctgtcccaaattgagtggtaacacatcatttatttgaaaaaaaaaaaaaaaaaaaaagacaccatccatcctactctcacactgattttgtctgaggctttaattaattcacagctcctgcaaattatctccttaaaggacctgttgggtgtgtgtcatgacatataaattgttctgagaccagtggttgtgtccctcattgttttctctgctgtccctttttcagaagcactgataatgacgatgctactaaaaggaaagtcaacttggtctttgagaaaatccagaccttaaagtctcgagcagctgggagcgcccaaggaaataaccaagtaaatggaagttttgtattttgtagagtgcatttagcatggaatgtggtaaacaacttgctgtttcttcagtctgtatgtttgtttatagcagtaagtgggaagttgcctgagtagtgaggagtactcttcatgttttacatgttgcagcaacattttattgagacagagtctctgtcaccctggctggagtgtagtggtatgatcttggctcactgcaacctctgcctcctgagctcaagccatcctcctacctcagcctcccaagcagctggaactacaggcatgtgccaccacacccggctaatttttgtgtttttagtagggtgagggtttcaccatgttgctcaggctggtctcgaacgtctgggctcaagcaatccactcacgttggcctcccaaagtgctaggattacaggcgtaagccaccatgcttggcctttcccagccttttttccagaaaagtttaaagatattttatttaaaaatacatagactataacaggatgatacaaacagatggcgagatttagaagaggaaaataagaataggaagactagcattgtcataggcaaacatggaaggtaagtgtgaacaggcttggacccaagctctggagcttcaggtgtgaaagagaatgggactagagactggtgacactgatcagctgtggtgcaggggacaggaaagagcccagtggtgccaagttagtttttaaataactgcctgtctgattgattgtgctgaatttgagtggggacatagagatttttttggttaaggaaggagccctctcacatttgataaacaactactctatgtcagacacacctggtgccctggaaggaagccactcgtaagagagtacggctaaacactcgttcctcaatcttccaccgccttgtgtggaactcatttcttgcttgtccatcttcctttcccctcccaggggagttctgcatgggaaggaaagaggaagacacctggaggcaggtaacaggaaacttgtctgtagcttctttctaacttgggaagcgtacatacaggggataattttaggcgtcaacctaccatctttactacttgttattcccccagcactcagctaacccatgactgctgctgtggcctcaaatagaacaatgccgtacacacacatacgcaattcccactggggaatctttacaccatagtccttgcgtattacaccatagtccttgcatatacatagccttgaggagctctacatagttcttaaagtcagtccagtatttgtttgctaaaactctgaagtccaaattatcaacacgattcttgtttttttgtatacctgcatacaggctatgcagggagtgcgggttggaatctcaccggctgttacagagcaatataaagggtcttgaacacaggggctttgggtataacttagctaacagatgagtcttcaacaaatatcctttttatattgttttattggggtataacttatataaagtaaattacacaaattgtatctgtacagttcattgaatttttaacatagttttgcatccatgcaaatctcaaccagatcaagatgcagaacactcccatcacccaggtttcctgggtttcttcccccatcagttacaccccattcttctggaggtaatcatatcctgacttctatcacctagagtcgttttgcctttcttgacttttatataaattttcacaatatgtattcttgtgtgtgtagctgcatttcctcaacattatatcatcaagattcattagtgttgcatgtactcgtagttttttttggtatcgaaatgtaattttccattgtatctgtataacatagtgtgtattcttggtgtacatttctggtttggggctattaggaataaagctactgtgaacattattgtacttgtttggggaggggagtaaacacattcactcatttctcttgagaatatacctagaagtaaaattgctgagttgtgagttaggcatgtgtttaactcgtaaattatacctgtttgttcttagagtgagcgcagtctttggccttgatgttgagattgtccttgtgggtcacagactaggggtgaacagcctgaactgggtaagtcagggtagcccttctagggacagtgacactaatggtgccccaagagatcatagaattatttgtgagaagaagggaagctggggtgttctaagttaagtgactagcacagacaaatataaagaggcatgggttgccatgttagagggaatttagtgtagtgggaacacagagccaggatgggctgaggaagagcctggtagcaaggacattggaagttggaagttatgtaagaagtttccatttcgggctgggaaggggatgggttaccattgttggattttaaacagatgtgaataccattgtgtttgtgaaagtttattccttttgtggcttttggaaagaggtaagattagaggaagagagaccaatgaaaagctaatgcctgtctaggtgtggtccctcacacctgtaaccccggcactttgggaggctgtggagggagggtttcttgaggccaagagtttgagaccagcctgggcaatgtagtgagaccctgtctctagaaaaattaaaaaattagccaggcgaggtggcacatgcctgtagccccagctactcaggaagctgaggcagaagtcacttgagaccaggaggtggaggctgcagtgagctatgattgtgccactgtactccagcctgggtgacagaatgagtcattgtctcttaaaaacaacaacaaaagaagctgccaaatcaagagatgatgagaaaatgaaccaagacttttagacttcaggttcctattacagctccatgactgtttaattgccacgttttcctactcctcttccctccctcttaggtttggaatctgattacttgctggcaaaggttttagagttttatctttgcggtgtcacttaagtgattaggagagaatgtaagaaccctctcccttagggacggagaccatactggaaaacagcaaagcaggtagagattttgtatgggaaagaacaatgtataatttccctcactgggttggatttctgtttctaaaatggattgttattttgcctaagaaaattggaagttgtgtgtttgtgtttctaatcatcttcacaggagtaggtagggaagtacctcattccaagtttatcacacacaacttgcacctggattcagggatgtgtgagccaagatgccgccgtttctagctttgattcctacttttatttcttcccctcagctatttgtagttttctaaccactttactgtaggattttagccaaatccttttgagagaatcatcatgttattttcatggaagaagaagaagaaaaaaagatccattaatattcatactcagatcagagagataatattttgtaatagactctcttcaatcagatccctcttcattatggaaatgtaacatctaaaaggagaaagccaatttagctaacatacacttatttactacttgcatacaggctatgcagagagggatggaatctcactggcggtgactcagcaataatctctagtgtaatgtagattacactgtaacaaatatatgtataaagggtcttgggaacacagaggcaggggctttgggtataacttagcaaacagataagtcttcaacaaatatctgtttttatattgttttattggggtataacttatataaagtaaattacacaaattccatctatacagttcattgaatttttaacataggtttgcttccatgcaaataccatctagatcaagatatagaacactcccatcacccaggtttcctgggtttcctgtgttccttccccataaattgtcccccttccttctgggggtgatcatatcgtgacttctatcacctagagtagttttgcctttcttgaattttacatacataaaattttacaatatgtattataataagtattctcgtgtgtccggcttcatttcctcaacattatatcagcaggattcattaatgttgcatatactggtagctattttgtattgaaatgtagttttctgttgtaatcagtcaacatagtgtatactcttagtggtcatttctggtatttagctgctaggtgtaatgccaaactgaacattactttttttttttttttttttgtaaacacactcactcatttctcttgagaatatatctgagagtataatttgtgggttgtaaattaggtgtacttttaactgttaaatgttcccaaatgattttacacagtgattgaaacaatttacactcctggtagtgcagcatgccagttccagtggctatatatcctctgtaatacttagactcttttccattactttggtctacttgtctctccttacactactatcgtacggtttaaatactgccactttagtaagccttcagatctggtagctttattcttctccgagattatcttagctattctaggtcttttgcctttccatataaacttttatcagcttgtcagcttccaccaagaaaagcctctaggaattttgattgggattataccaaatgcatagataaatttggtggaactgacgtcttaatattattggtgttcttatttgtgaacatgaactttgtccccacttatttatgtcttagcatctctcagcagcgttccgtcatttttgttagagaggtctcgcacatctttcatttagatgtagtccctttccagtgctgttcattcctttctgtacttctgtgtttccatctcggactggtttccttcagcctggagaactattttttgaatatcctctagtacttttcgtgggcattgtttgagaatagctgtcattcactctcagttttcaggaactctagtgtggcaagtattgttttgcttcatgaatttaaagacgttattcgtcttttgacctcagttggctccattggaaagccagccatcattcttagtgttattctcttgaaagtgatgtgtcttttccctctgggtgcttttaataatttatctttattgtcaattgttagattttgactatgacgtgcctaagagtggtttttcttttatttatttttcttggggttcaatgagctctcgacttgataggttcatcagatttgaaaaattcttggctattatttatttgaatattgcttctttcacattcggtctctcccagctcttctcagactccaattacatgtatcttagaaattttgatggtgttcctcatatctcttgtgctctattctctctcttttcgtgtgtgtgtgtgtgtgtgtgtgtgtgtgtgtgtgtgtgtatgttgtatgtttggggcatcagatattctggatattttctattgacctttcaaattcattagtcttgttttctggctacgtcaatcttactttaagactttctcttttaagatgtctttaaaagaatgtttttcttcatccttcatttaaaggatggttcttttaagaacttttctttggccaggtgcagtggttcatgcctgtaatcctgggagtttgggaggccgaggtgggaggattgtttgaggccaggagtttgagaccagcctgagcaacatagtgagatcccatctctacaaaaaccatatttaaaaattgccaggcatggtggctcatgcttgtagtcataactgctcaggaggctgaggtaggaggatcacttgagcttagaagtttgagattacagtgagctgtgatccagtgagttcttaactttcagatattgtgtactgctgttttagagtgtctacttggttatatttttatagaatctatctctggaacttgattaaaaaaaaagggccaggcatggtggttcatgcctgtaatcccagaactttgggaggccaaggtgggtggatcacctgagatcgggagttccagatcatcctggtcaacatggtgaaaccctgtctctactaaaaatacaaaattaaccaggtgtgatggtgcgcacctgtaaccccagctatttgggaggctgaggcaggagaattgtttgaacccagaagatagaggttgcagtgagccaagatctggccaatgcactccagcctggatgacagagcaagactctgtctcaaaagaaaaaaaaaacaaaaaccctttgtccataattgtttctattttaaaaatattagttatagttaatttgtagtccttatctgttaactttaacatctgggtcatctctatgtctgttgtttattttatttagttactggttagttcttcctacttctttgcatgtctaaggatttttttttttaattgtatgctagaccgagtgggtgatgagttatagatgttctggaatgtgttatctccccctgaagaatgttaagttttgttttgacagacagttaaattacttacagattaccttgattctatatggttggttgttctaggcattattagggagtgtctatttaagtttttgcccttactcttaagacatgacccatgttcctttcttggatttcaaatgaatgccagaatgtccaccaaggtttctctattttggttgagttggaaccctagtgtctccctagcattgggcaacctgtgaagtttctgttgggttctttgcctcctaataggtcttctctgcagtcctcttgaactcttgctctgctcatatacagcttaggatatcatccaagaatccagggagtatttattgtaggttcttggaacttcttctgtggacctctctcctctctcataccctgaccttgaaatccctgttgcttactatctctaaactctaatctctatttctttcatcagtgagttgccactctggacacttttctcacttaaattaacaaaccttatttttcagaatagttttaggttctcagtgaaattgagtggaaagtgcagacagttcccgtttactgtcctgtccccacatacgccctccaccactgttagcatcctatagcatggagcgcacctctcacaatcaggggacctacactggcacatcattatcactcaaagacgtccatagtttacgttagtgttcactcttggtgttgcacattctacaggcttctgacaaatgaacaatgacatgtatctatcatttagtatcataaagaatagtttcactgccctaaaaatcctgtgtgttctgcctgtttgttcctttctctcccctaacctctggcaacccgtaatctttttatggtttccaaggttttattttttctggagtgttctgtagttggaatcacacagtatatcaccttttcagtttggctcatttcccttagtagtgtgcattttttcccatgcgttttgatggattggtagttcatttcattttagtattgagtattaatattccattgtctgatataccacaatttatacattcaccttttaagggcatcttgattgcttccaagttttgttagttatgaataaggctgctttaaacgttcacgtacaggtttttgtgtggacatgagacttcaactaatttgggtaaacacccagagggcagcttctgggttgtatggtaagagcatgtttagttttgtaggaaacaaccataccattttctaaattatctgtatcatgttgcattcccacaagcaaagaatgagtttctgttactccacatccttgccaccatttggtgttgccagtgttttgaattttggccatcctaattcgtatatattggtatctcgttggtttgtctgtttgttttttgagatggagtcttgccctgtcacccagtctggagtgcagtagcatgatcttggctcactgcaacctccacttcgtgggttcaagcgattcttctgcctcagcctcctgagtagctgggactacagacgtgtgccactacgcccggctaatttttgtatttttagcagagatggggtttcaccacgttggccaggctggtctcagactcctgacctcaggtgatcgttctgcctcggcctcccaaagtactgggattactgcatgagccgccccacccagcctcattgttgttttaatttgcaatttcctaatgacattgtctgtgcttataaaattttattgtgctgtggtttggaaatggagtcatggagaacccagggtgaatgtggggctacctcctgtcttttcctttgtaaggatcataactctgtgttgcttgcttttcagtgcctgtcaacaattgttttatatatttttgtctagctttcatagtttttgctgggagggtaaatctgatatttgctactctatcatggcaaaaccagaattctaacaatcatttactgagatttgattaaatttatgagatacattgggttctgtagatacagaggtgcataaaacctggtccctgccccataaaagttcataatctcctgatgtagtaattctcaaaccactcttaagaaacactaaagctaaactgtattctgccattaaaatagaaaaaatgactgtctttacttacaaaaagattttgttgctgattttttgctaaccattgatttccatgctctggaatatagaatttattatggagaggctttttaagttttattatcctaaatttaatgcattgctattttataatattctacagaatacattacggacttctaacaaatatgccatgtatgcaagttttagtcatattggactagtgttgatatacctgatgaaacaatacctgtgattggtaaatgctgtagaataaagttcactggagtcccaaggcaggcagtaacattaactctgcccaccaagtcagggaaggttccctgaaggggttgatgtttgaattgggtcttaaaatgtttagtgttatgcctcatctgttactgcactgattatatttggagggggaagataattaaaataaagcaccctgaacatttaaattagtatatctttgcaattaattataggcttgtaattccacatctgaagtcaaagatctattggaacagaaaagcaagttgaccatagaagtggctgaacttcagagacagcttcaactggaagtcaaggtatctggtttttcctttatgttattttttccatttctgtcttggttgataaagaatattttacatgcattgggataaccagagtgaaagccaattttttttcccccaaaagaaacattcctctaatcactgaataaattcctgtgtatttggctgctgctgtccaaagaatttttttttttaatgtaaccaaagcctatagagactgtttgcttagacagagtaaaagaaaccctgttggatttaggcaggccaatgggaaactaaatgtatataaaacatctgaactaaatcatagaaatagcagaatgaggtttggctgtgtttgtgttttcttttacaagtattacagttcattaaatataaatgtttgatgttctttctagttaagaactcctgtgccttaattatatagtttgattaagttgtttaataatgtaagtgcaaagatatggagtctgcttgttgagaagtaggcttctgtggggttacgttaatgtacagtggaggctctttaaaatcacactgattcctgttagaatcaacagaacattaaagaagagagagagaggatgagagcaaacctagaagagctccgaagccaacacaacgaaaaggtggaggagaactccacattgcagcaacgactggaagaaagtgaaggggagctccggaagaatctggaggagtaagttctgggctgagagcctgttgcccttcccaggttctctatgacatgtagctagaaactttctgtccatttaatactacccagccttccaaatatttataaaggcagctggcttttccttttcttcctcttatctttgtaaaattatgaagctggcgacacatgtagactgataaacaaaaaggttagtaattcttaacattctttgtgcaccttgaagtatacgttacaaagtttcagtccttaaagtggacctcctagcaggtaagtgggaagcagggagcactgagcgctgatactgaaagacagagttcaaggagcctgggcccagcttctaaaaagcatgtgttacgtggcccccgtgagctctcagcctgtgcattttatcctcgatggtgctggtgtttgtgatgggtgcttatacctcctctgagtctacagagaaggaaagttaggtccaagatgcccctgccattgtgttgtattaaaagctgtggcaaaggaatcgaaaaccaaggtctaagaataaacagtgctatgacgttctgtggacacgacagaagccttaagtggaaagtcaagtgggaatgaaatctagggggaagttcaagaaaaagaggacattatataataaaagcatttgattgtccttgcagttttgatggtggtgttttgcgtttaaaacaatcatagatgctaattgcagaaaagagtttagtaagaaaaaaatcagaaaatatagggtatagtaaaagttttacaaaataaaaaggtatagtagttgtgagtttggttcaggacagagttttgtaaacttttttttcatcaggtggtgattattttagggtttgtgggtcatatagtctgttgcacatactcagctctgccattgtgtcgtgaaatgaaatggctgctcataaatgaatgagcatgaccatgttccagtaaaactttacactaacaggcagtgggctgaactggcccacagaccataatttgccaactctcctggtctagaacactgggatagtagacagtggaaggatggggtggctttagtgggaaatttttctgtttcatttctttatcttctgcatccaaattctagtaccctaccatctccttttggggagaaaatgtctccgtataaccatacccactttgttggtttgagttctcatttatcctcttgtaagcaattagaccatagcctaagttcttctcagccaccttttcaggttggtgatcccttgctcagtgcagaacagagaatggggaggctccttggggctttagagacttgtgtaaccctctgaagatcagaaatcagactggatggaaataagcagagcccagaagagcctgtctaatgggcttccttccctgccaggctattccaggtgaagatggaacgggagcagcatcagactgagatcagggatctccaggaccagctctcagaaatgcacgatgaactggacagtgcaaagcgatcggaggacagggagaagggagctctgattgaggtaagcagggctgtggggtcaggtgataagacaggccccacctgcctggaaagatggagtggctagggtttgtggactgcaagccactttctgatgtgcacacctgctccacctgtgctcttatgatctgtgagtcagtggatgcgcttgattctctcctctcagcttggcatttgctaattattatgggtttttattatgtattctctcttctctagattattatcttgttgaggtattagattcacatgtatgaaattattagcaagaatgttggttttcaatatgtacatttttgggagagggaataagtataattgagggtcagaaaaagacaggacttttatctctgcacccatttaggtgtttgatgtttgctgtaacattatcatcacctgtattctagcatagttttggaacctacttctttataagtgtggtttgtaggaatagcccaacaaagagatgataaacaatttagaacaaagccaaaaaaattaaaagtcaaaacataaaggtactgtgttaatatttaattttctacttcctccctctttgggcttaggtgttttctctctcccttacttggggctagaagcttctggctctgaagtccctggaacactctttaagtctcagttgtctactgttctgtcactcctttcctcctccagttttgaaataattcctcaggagagattttaggtcctactttttagaacttagcctttcttcacccgatgacctggcaggagctcagagatgagtgactctggtcacccagcccaggagttctcatgaatccatttttcacattggcagaggagggtgattgcctcttctccatatatgaccatctctctttccctattcagaccttttctcctgagaagccctcagcattgttccttaccaactgggattcctctttttatcaaatgattccttaaaaaccaccacattcttggtataatactgcttctcatggtgctgttttctctcagggctcagagttacaaagacaagaagatatatgtatttatcactgaaataatattaaaacaacataaaacgaaaattgaaaaaagggggagggggggacgtacacatactttcctaatacctgagcagccatttttatttctataatctctgtttgcctccctatctattgatagctttcatctacccatgtatatataatataaggacaatcataatgtccctacagttttgatacctgcttttaaaagttaagatatcaaaaatgttctttcttattatactttatgctctttgtatttaatttttaagaagataaaccacaatatatttaaccattctcctacattttttttcccttttttgtaattttgaaacaaagattgtggggaacattttttacatttatacttttactactttaaaaattgtttctaagaataagtttccagaaatgatgtcaatgaacaatttatggctttcaataaaagtgtagcttcatgaacaaatttaaatagaagataaaacattgtcatattcttgattccttgtgtgaacattttattggttctaaaagggaaagatgttatcttagctcttgggaagtctctgaagttgctgattttccgcagtaactgacagctgtcactgtgagttgccccctgatatcccctgtccttttagtttctctattttaactcacttgacgttgcacatattttgtatctttcttctgctagccagctaattcaagagcaatcacttttgcttctttccgcatttcacatctagcacagtgccaagcaacagagcaaatgaataaataatttttcgtatttaaattacttttaaaatgtcaccattttttaaaaaagggaataattctgaaatgaactgcatacttcttttcctctttaaacatgccatactgcatatctattaactgaacatcattagtttattgatttatttatactgatgatgggataacgatatgagactgttttggtgatgtgttcaggcagaggctgataatgcgagatacaggagtgggcaatagcacatattttcttaaacctgttcgtgatgttgctggcttacaggtagtttgtctctttcccacaacaggaactgtatcatttactgctgcctttctgcaagatgagttagagtgtaattagtctccctaggccaaagtgggtttctcttgctccagaaaatcaccctctgtttttatcagtttcctttgacttgtcagcaacacttaaactatgatctacggtttctacgtcactagtaaaatagaccctgtctccttgtcactttcaatttattcttcatatcttaataaaaagtggcctgggggaatttgataacagagtatagttgtggccaagtttcccatggcagttagcttggaacaaactcttaacacaatgagcattaaacacttatgcttttgaatgtttgaaaaaggttgaaggcccaagttttgcaagtcctgcataatggaccagattttgcatgaaatatcttttaatatgtcactttttgttaaataacatcagacccctgtatgcagtcagtaaagtaacattaagaaggaataggctgctctgtctatggagcagccattcttttgtttcttctctaataaactggctttcacttaaaaaaaaaaataaataaaacagtttaaaaaaaaaaagaagggagaaatagtagaaaacactttcttagagtaaaccataaaattgaccaacaaagggttgactttgttattcttagttaaatagatgattctgaaattttttttttttcagctcaagttacaaaaatgattatagaacaggtttccaccacttctctgtcaggaatgcattaccttccattccaagggtgacaggtcaacgtgagacagctcgctaagtgccacgatggtggggttttctaattatcaaatgtctgctttgatgggagcctgcggtgctgagagatgggcctcactccagcagagtcttgtggtgttttatccctggcatttgccaagatacaggtacttcagtctcattaaaatagtctggttataaaattgtagtggtttgaggagagattgtgttcagaaattatgtctctaaaacttcttttgtaatgatattattgaacattctacaaatttttataaaaaaggcagccaaaaataccatgattctcaccagccgtgtgatgcttccttggccatcctggaacaaaaaaatgacagaattctttgtcagctaccgttgctataaaaccttttatttatgctttcagtgagcatgggccagagatagggaccctgtggaacttctgggaagcacttatgcaaaagagggtctagactggtgtcttcctcattttgatgtggcacgctcatgcacaggtggtgtgtgaagtagagctttttgtgagcaaatacattgccgttctcgacatcctggtgcctgtttctcagtgcgcatggtcgtggggtggccacttgctgctgctgcagaacagctggtctcatagtgtgttcctttttctctcagatctccttctacctgtctcttcaggctctggttgcttttctttgctttagtttaagaaggtggacctccttaaagggccttccagccaaacacagtgctctgttttgttggcatctgtactaggctgttttcatgctgctgataaagacatacctgagactgggcaacttacacaagaaagggatttaatgtactcacagttccatgtggccagggaggcctcataatcgtggcagagggtgaaaggcacctctcacatggtggcaaacaagaggcgtgagagccaagtgacaggggtttccgcttataaaatcatcagatctcctgagacttactcactaccacaagaacagtatgggggaagccacccccatggttccattatctcccactgggctcctccctcaacatgagggaattatgggagctacatacaattcaagatgagatttgggtggggacgcagccaaaccataatagcatctagtggatgaactccagtgtgactgcttgcttctcagccttcttgagtatgtggttttgtggtcaggtctgtactgaccatagtgaagggaaagggcattaggacccatctgggtcccattcttgactctactgcttataaggctgtgtggtcttaggcatgttagaatctcagagcttcgttcgtttatgaagaatagtaatcttcatctccttgagtatccatctctctggattgttagaaatgctcagcacagttcttatgatgtataaggaccagacacagtcaacttttctagctctcgccactcccagacagccagttttctcttgttttctttaactggattccatagagaggcaagttgacctctaatggatgtatacttacattttgaagtttatgtatttttctctcccttctttgattgaaataattaagccccgaggtgatggagtgaagtttatgaaacatcgtgtaccttttagtctctactctggaaaacttcaagtgctactaagtgatatggcgaggtgtaatctgattggatttgtgctgcacagtccacttaagcaacagataacagcatgtcgttgcagaatggaccataaaaacctcagtcttgacatgcattggcggcagcacacaaaaggcaacacaaaacatagagatatgctggaaaacataagtgtggggagaggaactgtcttatcatccaaacaattgagaaacgtgtgagagtaaaagcaggaaacaggggtcagaatcacagggcctgcactaaagatgctggcaggaggttccaggaagccctggggggtagccggaagcaacagtaattcaggagagactctgatcttccttaagaaggggctgggcagcggcagcagggcgtcctctttgataaatacgaggacagggtataatttcataagatctctgtgtttggtgctttgaaagagccagagccggcctcgttacctgcatgggtctcttgacatttcttctgagcttgtcaatgcctgctagttagattcttgatgggcaaaatcttagtctgtgcaatgcagccccaccctgggattgtagcggttcccctggttcaatggaggtgcatgtcctagagaaaatgaaagagatctcgttgtcggttatacttaaatcaataaaatgtttcttccctcatcagagacacaattctggaatggaaagtagcttatcatctctgaagccttgggtcccccggtggcaaccatgcctctgattacccaggggttccaagaaaacaggtcgtgttcttatgcagaagccacaagtgaaataactgatgagttcagaattctgacatctccagacacctgctgtactgcacttgtttatttatatctgaacagataagtgctcccaatattaatctatgcatcaaaaatataataaatcagatctgtatccttctttcaacaaggataagtaggcgagtcaaatgcagatgagaaaaatgattaaaatatatagaatgtaaaataaaaagtgttaagtactgtgagaagaacagctagagtgagatgggtattcaagagggatattcaaggaagacctcttggaggaggtcttaccgtatctgggtcttcaaagattttctgaaaggcagggagagatgggcctgagaagggagaagggcactccggactgaagatgctgcgtggattgccatagaggctgtaggtgagagcctggatgcggggagcagctgagtggttatcgtaaaccacctgcacaggaggtgaggagggctttacccagggaggtgacagaaaggattgaagatgttgcagaactaactttttggttatgagagactaggacgagagaaagtcaaagtcctgccaagtttctgagcttgagtgctgagggggcaggtggtgcttttcacaagagcaaagaacaaaggaagaaggaaggaaggagcatgatgaattctcttgaaattgtaatcttactgaatctgaggtgccacaggacatccagatgggttcatctagcaggtctttgaatgtgttagtgcaggtttgaactcagagaagggtaagaggtaaaggtttaggagtcatttacatagaattaatagttggaaaaacaaaaatgagcttgctaaaagagaataaagaatgcaaagttgcaatcttggagatcatcatagattttgggaagagggagtgaaaagccagaaaagattatcaaagaagaaacagcctgagggaagaaaacaggagtctgtgttatcttggcactacaagaaagaagggcatcttagagagacaggaagggaggatgaaagaggggtaaagaaaattgacaactgggaaaaggccatcggatatgagtaaaggtcacaatgaccttgcaggggactgtcttggtagagcagggacaaaaatcatatagcaagagattaaggagtgaatgggcagttgtgaagtagaggcagtgaacagaaattatgctttcagacattttggtggtgaagtttggcaggtagccaagattcaagagtatgggtaggaacaaaatggcagaaagaaaagacaactgtattagtccattctcacactgatgtaaagatactacctgagactgggtaatttataaacaaaggaggtttaattgactcacagttccgcatggctggggaggcctcaggaaacttcatggcagaaggggaagcaggcaccttcttcacaaggcaacaggagagagagtgagcaaagtggggaaagccccttataaaaccatcatatctcatgagaactcactatcacaagagcaacatggggaaaactatccacgtgatccaatcatctcccacagtgtcccccccttgacaagtgggaattatgggaattataactcaagatgagatttgggtgaggacatagagccaaaccatgtcaataactgatggagtgaagactgggagcaggctggcaggggacagtgcgttctctgtggagggactctgggtggaagaaggcctggagtgcagagaggggttgaggtggagagggagccaagatgcccacatctctctggctgagggaagagcaaaggtgtctgtgagggcgagtcctgagctggaaaactgagaaggtctgggacaaaaatgctggagggaaaggaatgccgagcctttggcaggacacactgggctcaggtaatgtgatttatagtggagcctgttgccccagctttgtgaccttcctcattaatacctggcagttaagaaggggaaaatatgaatattgtgctctgctcagatgggcaaatgagatagaagaaaaacaggcaaagttgtcctgagtacgaggaatgtggatgaagggtttgaccacactcagggtcccaggggatatgaagcaaggtaggcaagctggcgtgcccccgtgaagcaacagcacacacagggcaagagcaagggcaacagatcactgcacagaagtgaaatgagatggaagatacagacgtgttccccaaagcagtgaaatttacattagtttcccctttctccctcaaattcaatcaaatctccaagaagcagaggcagaggaatccaagggaatgatggcctctgagaaatgcagggggagaggaagaaatggtctaaacaggtgtgcgggatgtggaaggagagagtggcaaggccaggtgagatggctgtgcacatggggactgaactggaggggagatacagggcctctcaacaagatgtttcattgtcaccttctcccttcgtgtttcctctctctaggagctcttacaggcaaaacaggatcttcaagatctgctgattgccaaagaggagcaagaagacctcttgagaaagcgagagcgtgaactcaccgccctgaagggagccctgaaagaagaggtttccagccatgatcaggagatggacaagctgaaggagcaatatgatgctgagttgcaggccctgagggagagtgtggaagaagcaaccaaggtgagggatggggcaggagaatctggcttgtgaacagatgaaagggtaagaccctctctcccacaccactgcaaatccccttcattccttttaattagagagtgaatctcaattcatcagatcatggacacagagcttattaacaaagaataagctcaatggtcctgctattgaccttttaaagtctataaactgaaacgttggtagggacattggttaaatcctgttgcagagggggagatgaagaagctgcatatgaacacttgaggttctgcagccccttgcagagtggagggatgtactctcccaggcgttcctaacggtcagaggccgagggcattgtgtgaccaagttaatgggcagaagtgcagacgggacccagattcctggaatccttcatcccccaccctagtctgttccttttgattttgtgtagccttttgttggacaattcaggttcttttctcagcacagttacaagagggttaattggctgaattgccgaaacccttccaagataatttttctcttaattgaattcttggctcctacaaatagattcaaaattatgctgaagtcttttggggcagacgtcatactggctgttgaagaagagaaaaacagtattttgaaggggaaaatggtttgaaatgtcatgccatctttagggaaagaggggaattacagattataaaattttcagagactctgcaatatataggttaaaaatgatgaagaaagaattcttgatattgtttattctgtgatgattacagtgacagctcagagttagtaggccctctctcccctaagccctatggtgattcactgattttcaattatggcacagtaattgcaaatgacaagaaatgaaagatgggtttgtttgttataacaataaaaagtctgggaaatagactgtttggggttattacaacttggagaccgtttttaaaagcctcttgttgatttccctgtcttatttttttttagatttgactgaatttgagggagaaaagcgaaaccgatttaatttttattgctttgaggggacatgcctgttatttgcatctcatttcatttctgtgcaccagcctggtatccttgtgatctatctttatgtgctattgcttcatcaggtacatgccaataggctactgagttaaaatttttctcctttggacccatatctttatcacccttaaatcttgcctcaaaacttgacttaatgtggtgtattctgggtggctcctttaagggcagttgagaatagtgttgggggatatgtttgtagtgatttaagtataaggaaaatcaaacttgtgcctcacatggggtgggggctatttattggaagcttccaggttctctactgtcagagatatgtaagtgaggaaaggatacatggtaggtgaaaggatatctttgttgtatggaattgagatcatcagtagagacttatgttactgcattttgtcctgttcaaatgtctgcattatatattaactcatagtattttcattatgccatttcaagagcgacaactacattgacccatatcagtctgtaaaaacgaaacaggcgaagtagtcaagacgtgtatcactggcagagaatggacagtttccaggcaccgggaagctaacacaaaggggttcgccttagtacccactggggtgtgggccagcaagggctgtttgttccaggttgttttctatactgctgccagcaactttccttacaaaaccaaatctgatcgtgtcagcctttgcttaagtaacttgcttgactccccattgccccagatttaagctgaaaattgttagcatggtagggaagaagtcccttctctgcctaacccatctccagaaaactctgtgtctttcagacctctcacctcttcatacgtgtagagtgacttgctcctgctttgccatctgaacaggctgttgtcctcctgcaagaattcccccaaatgtcctctcttttatgaacatgccctagatacctatactccctttggtggagttagttgcaccttccttcaccttccttagggtttctgcggaaccctggccattcttctactgtagtttgtatcataccctattataatttctcatcttgtctgcttcctccattagactctgcacttcttaggcatagggggcacttttgtcctttttttttttcctgagagggagtgacaaactctagtacctctggggccagacagggagcataaatgagtaaagcactgagtctgttattgggatgataggagggtatggtggggactgtgacaagctggctggagggcatgtcctttgctggagcggtcagtggcttctctgctccagcttagagttgccagtgagagaatgctgggcccatgttgctagatctttcatttttttcaagaagccagatatctggatgtttctgtgagatctcccaacttttaagcatatcttcaaattacaaaataaataaagaaataaataaaataacatagaccaatacaccccatatgcaagtcaagagcctgtgctcttagcctcttgagctcagcatggtgcctgggacatagtcacatccgtgcggtgtctggcaagtgaaagttagtttaggacaaatttcctttctgactgggttttcagtccctgccatgtagttcctgttgaattttttcagtggtgatgtgggaggtctttttgggaactctagtattattctttgaatttctgtgccttgcttttgaatttctctgcggtttcttttcctttcctttcctttcctttcctttcctttcctttcctttcctttcctttcctttccttctttctttctttctctttccttcttttttttttttgagatggagtcttgctctgtcaccctggttggagtacaatggcacagtcttggctcactgcagcctacacctcccaggttcaagcagttctcctgcctcagcctcccaagtagctgggattacaggcatgtgccaccacgcctggctagtttttttgtatttttagtagagatgggctttcgtcgtgttgaccaggctggtctcgaacacctggcctcaagtgatctgcccacctcggcctcccaaagtgctgggattacagatgtgagccactgtgcgcggcttccttgcagtttcttaaagaggatcctgattgtgttttttcaccatattagcttttgcttctgaaggtggctgcttaacaaatgtgatagagtcatattttatgggggacaaatgtgtcaatttagtagatggatgctgtttttggttatattatttatgtcttggtattatagaatagaacattaagattattaaatatttggaggagagtgaattaaatataatttttaaatctggtaaataatgtttcttaaatatgtgctcttacacttagatttttcctgccccagggggagaacccacccaccaaccactatggctaaaaactgactttttttttttttttttttttttttaagatggagtctcactctgttgcccaggctggagtgaagtaaaatgatctcgtctcattgcaacctccacctcctgggttcaagtgattctcctgccccagcttcctgagtagctgggattacaggcatgcgccaccacacctgactaatttttgtatttttagtagagaccgggtttcaccatgttggccaagctggtctcaaacccctgacctcaggggatccgtcagcttcaacctccccaaaaaaaaaggacatttctttaagaaattttattgcattaaaaagtttattacttcaataggtcttatgaagcagcccaaccttctgtcatcagtttttcttattcttaccactgccccagtgtcaaaaccccctaaagtgctattttatcgttgtaaaataaccagcactttatcctagcttgagcactaaaggttttacgttactagaacatttggtgaaaaatgtcaaattatatttcgaatgttgtacaggtattccaaacagataactctgtaatagtgtattttgtaaacccatcagccatatcttttaaagaacagtttgattgctcagtggatggaattcatgaatgcctatgttatgtggggtttcctcacccagcagaatgaattgcatctcactggcagagcggtggaggtttgggttataatgtgcactatttaagttctcttcttatagagaaatggatcttcgtagtctgttaggagagtatatctaccaaacattcttttaaaggactaagcccttaagcaacttatttcataacatgcttttttctctgtttctggtcattttacactttttttagttttaaaaaggaaatgtcttcttcttccttgggttcgtggccatggctggaaccctttagaggaaatgggcgctcaatagggatgtgaatgactgccatctgggagtaaaattaaccttgttcacagccgttggcttattttttccaaacctaacccttcctatctgcaactcttgtgcaaaatagaagtacagacagtatagtttcttgaagtttctcagaaagtaggttcagctcaaattccagctcttccaggaacttccctcgctgccttttggaccttacagtttctagagacctggtattgttggcaattttgctccgggttttatcttccctgccgtactaggtactgtcatcatcttctacttggtaacaccattgtgcttggtacttaatagatgtttagtaaatgtttgtgggttagatgaatgaatagacaaaaagggagatgtctttagagtcctcaacaatctgaagaccaaccattagactgttttggcttttaatttataaattcaaattacttctcatgaaaatgaacaaatcttgtttgttaggagcagtatcatgatgttaatgttaatcttcgaaggagtaattttgcatctaagagttgcaagtattttgatgctgataaaacagccacttttatttttgtgccagataatatgacttttgggccattaggcactttcagagtgtccaacatacagcagttatgcaacaaatatctcccaagggaatggatgagggagaagaggagggaggttgaagacatgtgagatactcttgccatccttcatttctccgtttgcattatttttaaatacagcaccttacaaactgatttactgagcaactgccaagtacagggcatcgtgctaagttcgtgaggactatacatataaatcaggtggaatttacccttccaggagattgaaggggagatatgtaactctcaagctgattatagacaagagtaaatgacccaggtgaagtggagataaaatcatataggaatccctataggagaccccatggctgtgcttaggaggaggactgctggcaatcacgaaagattttagggaggggacagtatttgagttggattttgagtgatgtttgggcatgcgggctgaggacattttgggtactgagtacagcatgagcaataccttgtaggtgggaaagtgagatgtctgggctgggctttgtggagaaaatgaagttaaggtggctacagattcagagacttaaggggcgggtgcagagatccaatgagtggaccgtgctcggatcccaactgaaacaaactgactgtaaaaaacaaaaatagctaaaatcattgggaacgttttaacactctatattaatgatattaagaaactaaacaatttttaaggggtgataatagtgctattgtttttaagagtctctgtcttttttttttttttttttttgagatggagtctgactcttgttgcccaggctggagtgcaatggtgtgatcttgactcactgcaacctctgcctcctgggttcaaatgattcttgtgcctcatcctcctgagtagctgggattacaggcgcctgccaccacaccccgctgatttttacgtttttagtagagatggggtttcaccatgttggccaggctagtctagaactcctgacctcagataattcacccgccttggcctggcgaagtactgggattacaggcatgagccaccatggccggctaagtctctgagttttaaagaaacatactgaggtttttataggctgtctgaaatttgcttcaaaataatccactttgttgggggaagtcagtggggtatggatgaaacaagatcagccatgcattggtgtgtgttaaagctgggtaatgggtaggtgagagttaattacctatcctctctacttgttgcaaatgtgtgaagttttttcttcctttttttctttctttttcttttcttttctttttcttttttttttttttttttttttttgagacagagtctggctctgtcacctaggctggagtgcagtggcacgatctcagctcacttcaacctccgcctcctgggttcaagccatcctcccacctcagcctcccaaggaactaggactacagctgcacgccaccacacctggctagtttttgtaaagacagggttttaccacgttgctcaggctggtcttgaactcctgagctcaggccatctgctcacgtcagcctcccaaaatgttggggttataggtgtgacccactgcacccagcattgaagttttctttggtaaaaagtttgcgtgtgtgtgtgtgtgtgtgtgtgtgtgtgtgttaaagaataaacaaaaagagttaaaataggaaaggtggggtggggtgagattatggagactatttttagttggtagtcagtgagggagcaatgatgtttcttttattagggactgatatgatttggctatgtccccacctaaatctcgtcttgaattgtactctcataattcccacatgttgtgggagggactggtgggagataactgaatcatgggggtggtttcccccatactgttctcatggtagtgaataagtcccacgaaatctgatggttttatcagggatttccgcttttgcgccttcctcattctctctttgcctgctgccatccaagacgggacttttcctcctcgccttccaccatgattgtgaggcttccctagccacgtggaactgtaagtccaattaaacccctttcttttgtaaattgcccagtcttgggtatgtctttatcagcagtgtgaaaatggactaatacagagacctaatgtggggacattacttggtggtggtgtgacctgaggctgcagctggaatggttagaagtagagagtggggaggaatgagcaggtagtaggggctgactgaggagaccccgcagggagcatgaattggggtgaggaggaagaagagagacagctgacctgagcaggcatcgtctctgggtgcctggaagggggctgtactgggaatggaaaggctaatgagttcatcttgaggtcctgggagccctctgtgtgaacaatgagtgaggagcagggctgccctatccatctgggagtcgttggacggagtgtgagcgagtgacagagagagaaagaagcgaagggggccgagggcctgaggaggaagagaagacacagacacagagacctgaagagaagcagccacatccagtgacaggaaagccaggggaagggcagttcatttgacttagttaacagtctattgggggagtttctaaaagaaggctatttttgcattagacatgtccatactgagtttctgtacttttgtcttgtctgttcctcatactgtaaattctttctgcccatattttatattgtctaacccttataagaattttattcaaattcaataatgttgaaacttttctcccccttcaccaccaccctccaattttggctgtgtgtgtgtattttacccagcaatttggaaatgtcactgagtcttacagaaatgaatatatgttttggtaccgtgttcccacgtcatttctagttttgtcccttccctctttcctgccaatgtctgaagaggttcttccaaagcataaggtcagcagagggtcaaatggtaaaaccagtgctaatctcaggatcagtggaatcgcttcccttaagacatggctaattcagtgtaaaatctcatttctgtcttctccaagggagccaggttagctagggaaacagcaaaaattcctcatttcctctgcattttaacttcaaataatcaacttaccctgaatgacggctactgagagctggagaagtggtggggtttgcaatcaggtgcccaggaaaaggaaaatatctcttttccacagactcaagcctgcctagagtgacatggaactttccataggcaaaagtgaaatgggaagattcaaggctaaaaaaagatctctttttttttgtctctctttttttttttttttgcctgccccagaaatggctcttttaatagttgtataactcttctgcatcttgtattgattaaaaagtatataaataagaggtctagagtggtgtcctgggatgttccttttgaacccatcacaggcccagtgccccattctgtggctgtgatcccaggtgcctcccatgtcctgagagtcagtggctgtcatgaaaaaactctggggggctgggtaatggacagatctcttagcgggcctccatgagggataaacagagcatctctgcaagtcactcctggtgttttacctgagctgcctagagtcacttgctgtgggttaggctgtagaagacaaagatatgctggtttatctttagatatgcggattcatttgccatcaaatgcctgagtgtgttttctgtgccagcgcggtgctagtcaccaagaatataaaggcaagcaagctgtggtctctagctttgaggatcttatgtggtcttgtgggcagaaagatgtgcaagtaaaatgacaaagttatggttgctgtggttgaggtatgtgcagagtaggagattaggagaggtttattgctttaggtggcaaaattcaggtgagaaatagcatgtcagttctgtgagttgacaccctaagtgctttttatgtaccaaatacttaagaattagaaagaaagaaacgttcctcttcgaagaacctctctaggagctttgggacgttggtgtacctcgaacttgctgactttgtacccaacttcttttagtgaaactcaagagttaacaattagaattgctaggaagacaaagaaaaaatattgatttggctggtgagttaaaatacatttcacttattcagtaaatcagcttccagttacagttcagatttccagagcgtaggagctcataaactatttctgaggagagcctctacctttcctggctaggatgacagaataaagggcttctctttccaggtctaccattagggcttttggcgagtagatttagcagctgctattctgtagagaggattttggctttagcctcacagtgcaggaagaactgatggagaattccattaggaggatccctcacatggagaggtaggacactgggtaatttttaatgaccctaccttggtgcttcatgaacatgtttaagcaggctggcattttctagcagttccaataaggagcagaaggtagggctgatacccagggcacctcgatgactcaaaatcacagcaaattcacaggcagcgtgcggagaaagtgacaagacttagttgggtagagaaggaggtaatgcgctggaagcacagctgaggagcttggtcgcgtggtcaggctgcctatgcctagccttctgggggggcctcctgctcaccgatggagtgaggagggcccttgcctgtttcccacctgcgatgaacagtgatgaggaaaataggctcaaaccactcagatttcgtgttcaatagtcagtgtcaatgtctaactgttgggaatggattgttgatacagtttttggaatatccatccaataaatagttcatttatggtcattaattaagcaaatatctaaggagcattttatttatgtcaggcactgcgctgggttgtaggaataacatggagaaaaggggtgagaaggacgttattcagataatcacatggataaatgtgtgattttctgggtgtggttgtgcaccctgtagtcctagctaccagggtgtgtgaggcaggaagatcacttgcgcccaggagtttgagtccagttgggtaagagagcaagacccccatctcagaaaaaagaaaaaaatatatacatgtgtaattcagatgtgataaatgctttgaagttcagggagggagaaaaagtttccttgaggaaaacgatgatggaaatctgaaggatgaatgggaattaactagatttttaaaaatccagagactggtccaagcagaggaaatagcatgtgcaagggggcttgcagcagaaaggagtgtggtttgttcaagctgttaaaccatggcaagtgaggctgggctgtgaagggtggttgaaagtctggtatgagaggaagtagaagcagatagggaacagctcatgcagcctgtatggagcatccgaaggacagatttttagagagagagacagacagacaagcaggtgtgtgtgtagtgtttttgtgggggagtgtgaatgtttgacacagacagattacttccatggaaaagtgcctgctctgggcttgaccagtgaggtgggaggccctgggatgattcgttcatgctgacacttaggatggaggcacgggatctttgaggtctcttccacaatttcattctatttttaaagggattattacctgtccctgtctctcctgactcctgtggagaaagggatgggaataggattatgtagggccccattttccttatgagtttttgctccttgctaagtgccagtctgctgaatttataacatgtgtctttgggcaggtggatgagagatgatagggcttatagctgaaggcagaagtttggtatgctgacggagaaggtttgtaggaggaaagtttttatttgtttcttgcctaataaggcttttataatgggtcagcggtgggaatacatttaaacacttacagaagcagagaaagtaacgtagtggggtgcttgcctatctccccatgtggagtggatgttctgaaatctctgagccatccatggacactgcccagagtctggaagtgtgagtaacaaaggagctatggctactcactgatggccctacaccagatgcatttccagatgtggatatggtcaagccacaagaattgggtggtgcagtgagtggggctattataaatagcctgggacagtcacagccaccataatattgcaaacagttgaatccttaacatctaaaggaaaaaagctttattattggaaatcctattcaatctatgttatactctctctgaccctctaaattctgcctgatggatatttttctaaagacttgccaagatcattaagtagatttttacttggtggaaaaatttggcgttatgatttgatcactttaagcagaaaatggaatatgtcataaactctaaattcattagacaagaaccagtatggaaacaggaatacctacagtggcaaagttaatcagagtgcataaggcatttacagtagcccgttggcccccagtgacctgagccttctgggcctcttgctccattatagtcccttcccatgtcgaaaaggtctgatttgtgtaactaataggatattatggaaatgatggagtgtgacttccgttgcttgatcataaaggacatgtggcttcctccttgctttctcatggatctcttgctgtggaggaagccagctgccatgttgtaagtgcacttaagcagcctgcgaaaaaccccatgtggcaaaggactgaagccacctgtcaacagccatgtgagtgtgccatcttggaagtagatcctctggccccagtcaagccttcagatgactataaccttgactaacatcttgactgcagcctcatcagaaaccctgagccagaactgcctgattgagtcacttcttcttcttcttcttcttcttcttttttttttttttttttttttttttctgagacagagtctcactctgttgcccaggctggagtgcagtggtgtgatcttggctcagttgcaacctctccctcccgggttcaagcgattctcctgcctcagcctcctgcgtagctgggactacaggtgtgtgccaccacgcctggctaatttttgtatttttggtagagacggggtttcaccatattggccaggctggtctcgaactcttaacctcaggtgattcacccaccttggtctcccaaagttctgggattacaggtgtaagccaccgtgcccagcctttgagtcactgcttgattccttaccctcagaaactttgtgaggtaatgtttgtcactttaggctgctaagttttgggacaatttgttatgcgggaataaacaactgatagaacattttgacaaaccatctctttgaagctgcattttctgatagccactggctctagcagaacccacagcatcctgccatgcccttggtttagtccttgttatgctggactatatctcttaggtgatatgtcatgctcctcatcttgaaggaggggtgtcttgtccttcatatcgtcagtactttgcagaatgccctgtatttgctgtatgagtgaatcagaatgtgtagaggtaaataaaggacacccgcatagtttaaggacaggtcagggttttaaacccagctttgtcattgacttcatagaattctcctagtctttctctgtttttatttcctctcttgtaaagggatactatttgtgttataaaaaacatacataatatattgctatacatgcatatgtgcttgtgcacatatggattatttcaagagggagataactagtcaatagtggttacttctggggatatgtagggggatggagtaagaggaaaactttcaaaaaacagtgtgtaaacctttcatatcttttgaatttattccatgtacagtgaaataagagtattgatctgcacctctcctaaggcaggtcaagaagaagtcctaagtttagtgaagtatttttaattttttgtcactgggggcccctgcctctgccttgaccttgaccttcaccttctgtctgctacccaggtctgtggcttccacatccacagcagctcagttccatcctctgacctcctttctcacagttgctgccctggttcaggcctcagcagccatctccctatttccccaactgtgttgcccccttctgaccacaccacctgccgcaggttggccaccctcacaagtccctggtggcttcccttcagttacagagtcctgcctggtctccaaggcctgcactccaccacctggctcccacctgcctttgcaaccctggccctcactgttgtccctggtgagcttggtgccagccacactaaaggattccctgtcacctccacagaagagtgtgccctgttactccgtattagccacctctgggactttgctttgcaatcctgacctgcaagaaaggacagtccccacaacagagacatatctgacccaaaatgtcaatcatgtcactctgagaaactgggatctatgtatatacaagtgtggtgtgtgtgtgtgtgtgtgtgtgtgtgtgtgtgtgtgtgtgtgttttcttttcttctctttttacataaatgcctgctgtgcaaccccaagcctagttaatgagcaatagatggagtgactgaatacttttgacacaccacatctctgatcccaaagaatcttcttcttgcagtggggaaaataatcctcccagggctgtacgtattccagcctcagactgtcttttctgacctgctgtcctgtgctctctcactggattctctgcgtgtgccctagtggtctccctgcttgctttcttctttcccccggctcatattagcctgtctgtccccaacatccttcaccagcccccgagctatggtctccgccatttaaaatcgtgccatccttcatggctcaggtcagatgacatctccttcttgggtccacccagcagctgctgttctttctctttgaaatccccagggtcttttgtccctcgggtggcatttattgtgttttgctttgcctgtagtttttgtttgtttactcaacacatcaagcatcatgcgaaatctggggtgcagagatggacaaggtggcctctgctctcaactcttccccagcctagtagagacagacaagaaagctgacagccagttcggtgtggggcatgagaagctggcatatggcacggaaagcagaagttcggaaaagggtgactttgctccgtgtaggcaggccagggcgggttcctaagagggagtgaggcttgggtgagtcttgggggcagtgggaattagcaaggtgacttatgggtgggcaaggacattctagacgcagggaacttcttgaaccaaagtatgtcttgttctcctctgagacttgaacacctctttaggggtaaccattttccttattcatttttatgccttttatagttttaccttagacagctaatagttttgtttgcattcatgtatttattcattcaacaaatattcttgagtgcttatttacttgaggtactggatagatgtaaatggatttaggcaaatagttggtgacagaagaattcagtagaaaccatcagagtagtaggcggcctctgaagtgattagatgtggtttagtgagttttagctacagagtaagtcatgtgttcacggtgaccacacgttagaattctggaaatgtgggccagaacaagtccaagttagatgcaatggaaaaatccctctgtccgagtcatctctagggaacagaacttgtttgaaccagcattattagtttagtttcatgaaagacaaaataaagggcaaggtgtttgctccacagggtgactgcagcagttttcacagtaatgaataaagtaatgctgttttgtcagcagtgagtaggagttggggactgggagaagcttgttccattcctcaggaaattccaaagtcatgcacgggccttatccttggggaacttacagatgaaggagagaatatggccaagcacacatatttctccttttaacacttcccttctttttctttctttttgttttatttgttaaatttctgcacatgtttctcaagtgtgtggtctagtgggaaggaatactggcagtctctgggtttagggaaacattgagtccccttacagttagaaataaaaggctggacgtgcttcaaagactttttgaaataaggctggggacaaagaagtcaagcaaataaatgatagagtccagagaaggtggcattagagatagatctgaaagcattcagggagacgtggtgcaggaggatgggaaaatcttgttttttccatccctgaattgtccaagagcccaaagacatctactctgcaaagtgtttgctggatgacagtgcaacgaagacttagatgctagcaaacttcgttggaaaacactgggttcttcatgtatttggagcaagaaccaaggcattagtaaactttggaaaataggcagtgaggttgtccgatagagtccatctggggaagtattttgagccagttgggtttataactatgaccctaaacttgagtccagcatatgccaagtccaaaggaaaggtatgttctttggacccctcatgctctctgatttacagggacctctttctgcctggtcaaggcatttcatgactctaagcctatgactttttgtgagaagaagccttccatggctcctttgctgcttggttttggggttttggaggcaccaggatgccaggctcctaccctgtgtgcagtgcttccttctccccgtcccattgtgaactgtttcccttgcaggttcaactcattgccacttcctgtagctgtcttagtgacccttcaggccagaagcagatgcctgtgctgtgtaccatgcccctcctgctgctgaactggagagaaaacgtggctggcaggtggtgaactctctggctgattcaggcccagtggagaaggagggttaataatttactttgcccctgtgtagccactggtgttgaccttgtcaaaacactagtagaaattaattagagtctggcctgtcatttaactaacaggatagtaaggccccaaaataacttcttgttttgaggttaatcctgtctctgagtttacggctgacattcctgtacatccggccctgtttgcatccagcagccaggaccgtgggctcatggtgttcatggggctcacaaagagggcacacaaggtcaggggcctgtctctccatgggagccgctcattgtggtaggaggacaaaggccacagtgatcaagatgctctgtaggagaggcggcagaacaacatgtgggcctggtagatattgcaggtgaagagcctccccatcccccaagcttctttcattttaaattcacagcttttgtttcttgagaagttccgaatcttttgcatctggtgctgcgagaaggttcacctggttaaacatcctcaagtcaacagcacagctccttctggaaggcactttaactggatgggatcctctcactgtagacattgctacctccctttcctgaaataaagcctgctccagagcagtgattgtcttgtggtgtgttgtggaaagctgttaatagcttaaaaggtctcattagctgctagataggcctagactgtgaaaggatacatggtgacccaagggtagattctttttttgagagtctcgcactgtcacccaggctgtagtgcagtggcataatcatggctcgctgctgcctcgacctcccaggctcaagtcatccttccagctcagcctacagagtagctgggactacaagtgagtgtcactacctctggctactttttgtattttttttagagatggggttttgccgtgttgctcatgttggtatcgaactcctgggctcaagtggttctcccacctctgcctcccaaagtgctgggatagcaggtgtgagctacagctcctggcccagattcttaccttattagggagtatctaaattaatctgtttattgatctcttaagtagaatctgattaattgtccatcaatagctagctgcaaagcactgcagaagcccacttgccactctccttcccccagctctccaggaaggtgcaaggagttgtttgagatggttctgacatccagcttttgggtccctggtttattgccttttccagtacattggctggcacctttatccagccaacaaatacacgctctgtaaacatgcatgtacttttggagaaggcagttggaccaaggtgagggtgtggaggatgggagtgaaaaacagagtaagccagaaaaaggggtcatgggaaaggaagggcaggagctagagggaagaggcctggggactgactagtgcccagcaatagaaacaatcagcattagaaatgggcaaaggggctgggcatggtggctcatgcctataatcctagcactttgggaggccaaggcgggcagatctcctgaggtcaggggctcaagaccagcctggccaacactgtgaaaccctgtctctactaaaaatacaaaaattagctgggcatggtggtgcatgcttgtaatcctagctagttgggaggctgaggcaggagaatcgcttaaacgcagtaggtggaggttgcagtgagccgagattgtgccactgcacttcagcctgggtgatggaatgagactccttctcaagaaacaaaaaacaaaacaaaatgaaacaggcagagcagtttgaagaaacttctcaagaaacaaaaaacaaaacaaaacaggcagagcagtttgaagtatgatgggaatgaggtacaggggaggcaggaaggagaaaagtgcaaagggatagtgagaagatgggaggtggtgtggagaggaagcagggaagctggtagcaccaagaagtgaaagaggagtttgagctaaatatctagaggataaagggggaaaagatgagtctgaaaggtatgagagggtgacagcaaaggacagaggagaagccgtgagctacatattatgccaggtgagatttctgctccaggaattttggctcacggttatcccaaagagctgtggcagcaagtgttggttttattgcagtattagcagtatgtggttactaaataagtgacttttgaaataaagtgtgaactgtgagactctagaagaggataaatgaaacttttatcacctgagatgggtaatttttatacctcttatttctagggtctctctatccacagcattgagcatgggtatgaaaatatgcattgaggccaggagctcacgcctgtaatcttagcactttgggaggtcgaggtgggtggatcacctgaggtcaggagtttgagacccgcctggccaacatagtaaaaccctgtctctacttaaaatacaaagaaatttgttgggtgtggtggtgtacatttgtaatcccagctacttgggatggtgaggcaggagaattgcttgaactcaggaggcggaggttgcagtgagctgagatcctgccattgcactccagcctggacaacagagtgagactctgtctcaaaaaaagaaaaaaagaaagaaaatatgcattgaatgtaatactttaaaaagttacaaccatcatttgtctgtgggggaaaataccatagtccagttagttgtacctgtctctagtggtctttgggcaggagtttgaagagatcattggaaagacatcagaagaatttaaatgacccatatcccgtctttcagaatgaaactaatattcattaaaaaaaattgtatgctctggctgagaatttatacagccttctaaagaggagacaggtatgcttttggtttccagtgatcagtctgtgaacttggggcattactcagtggatctggaaccttcttactctcaccagttggtttaggccatcccccttcctcttgaaaccaactttgtttgatatgtcattgtagattttctattatttcccccaaatcattccttaatgaacagtacaccttaaatgccttctctttgtatccagaaattatcagctcaaccaataaatagtatgtttgttagtcaagccagtgatccaggaaagacctggggttttttttttttttttttttttaaagatgggcaaagtttaaaaaagaatttttaaaaaatcaaacgttttgagatagttataaatttatatgcaattgtaaaaaaaaatacagctagatgccatataccctttatcctgtttcccccaaatgtaatgtattgcaaactatagtacaatagcatgaccaggatactgacattgatacagctgagatatagaacatttacatcactccccgcattcttcatgttgtccttttatagccatgccatctcgctttccctcccatccctccttgacccaactagtgtacttctctctggtttttaaattttatcatttccaggatggtatatagatggaatcatacagaatgtaaccttttggaattggcttttttctctcagcattgttctctggagattcctccaagctgctgcatgtatcaacaggttctttcctttttattgctcagtggtattctatagtatagatgcaccacagtttgttcaaccattcactcattgaaggacttatgggatgtttcttgttttgtactattataataaagcttctatgaacacagctttttgtgtgaatatgttttaatttttttctgggataaataggagtgtgaatatgttttaatttttttcttggataaatatctaggagtgtgaatgtgatttaatttttttctgagataaatatctaggagtgcaattgctaggatgaatggtaattacatgtttagcttttaaagaacctgcaaaactactctccagaatggctgcaccattttgcattcccaacagcaatgtatgagtgacccagtttctctgaattgttcccagcatttggcattgtcaatatgttgtattttagccattctgataggtatatgtgatattatattgtggttttacgcagttttctaatggccaatcatgttgaatgtcatttcatgtgctcttttgccacgtatatcctctttggtgaaatatctattcatgtcttttgcccatttcctaattggattgtttggggtttgttttttttttaaactgttgagttttcaaaattttttatgtattctagatatgagcactttgtcaaatatgtggtttgtaaagacattcttccaatctctagtaaaacaaaacaaaacaaaacaaaacaaaaaacctttttaacaaggtctttgaaaggtacaagtctttagttttgatgaagtccaatttagtttttccttctatggattgtgcttttggtgtcaagtctaagaattattttcctaccttagatcccagagattttcttctgtgtttttgttttctaaaggtttcttagttttgcattttacatttaagctcacagtccattttgagttaaattttgtgtaaggtggaagtttagtttgaggtttatttattttgcctgtgaatatccagttgctccagcgccatttgttgagagggttattcttcctgcaataattgcttttgaacctctgtaaaagtgggttgggcatttttgtgttaatttctgggctctctattctgtttcattgacctgtgtgtctatccctctaccagtatcacatagttttgatgactgtggctatattatgtcttaaaatctggtagactgaatcttccactttattcttttttaaaattgttttagctattctagttactttaccttttcttttcttttctctcttttttttttttgagatggagtttcactcttgttgcccagactggagtgcaatggcatgatctctgctcactgcaacctctgccttccggattcaagcaattcttctgcctcaacctcccaagtagctgggattacaggcagccgccacctcgcctggctaatttttttgtatttttaatagagacagggcttcaccacattgcccaggctgatcttgaactcctgacctcaggtggtccgcccaccgcggcctcctaaagtgctgggattataggagtgagccactgcgcctggcctaccttttcatataaatgttagaattaccttgtctgtatctatacaaattttgctgaagttttgataggttgagtatgactatgttgagtattccagtccatgaacatggtctaagtaaatctccatttatttagatgttcactgctttcatcatttgattttgtattttcaagcatacaagtcctgtatgtgttgtgctaaacttatacctaagggtttaatgtttttgagtgattataaatggtatatttttacattttagtatccttctgttcattgctagtatacagaaatgcagttgtatgtttttatttatgtttattttatatcaggacctttatttctttaccttgctgaaatcacatattctacaaagttttctttttttttttttttttgtgacagggaggtggtagattccttgggattttttatatagacaatcatgtcatctgcaaacagggacagttttatttcttgctttctgatgctttctgatctatataccttttgctacttatttcctgccttattacgcaggctagaagctccaatactatgttgaatcagagtggtgggagcaggtatcccagccttagtctcagtcttagggggaggtattcagtttcttactattaaatataatgttaattatagatcttttgtgaattggatgctctttagttgagaatgttcctctctattcataatttgtttggagcttaaagaaagtttaaatcatgaatggattttgagttttgttaaatgctttctctgcatttattgatatgatcatgtgatttttccctcctgattttaaactatcaaaccagcctagcattcctggaataaacttcacttgatcctactgtataattcttttaaaaattgctgacttttatttgcttgtattttgttaaggattcttgtgtctatattaatgaaatatattggcttatagtccttttttcatgttttcctttcttttaggatactatttggattttgatattgaataatactgacatcattaaatgagctgagaaggatttcttcctcttctattttctggaagagattgtgtagaattgatgtttattcttttttgaacactaggtagaattctccactgaaaccagttagacctggacatttcttttgggggagttttaaaatatgaattcagtttccttaatagttatgaggctattcaaattattatatttaatatcgcataagttgtggtagtttgtactttttaaggaattggtctatttcatctaagttgtcagatgtgtgttgagttgtttatagatgtctgcagggtctgtggtaatatatcttgtttaatttctgatattggtaatttgtattttatcctttttttctttgtcagtcttaccagaagtttgtcaatcttactgattttttttgttaacatttgattagtggtttttagattttttattttttattttactttaagttctgggatacatgtgctgaatgtgcaggtttgttacataggtatacatgtgccatggtggtttgctgcacctatcaaaccatcatctaggttttaagccccgcatgcattaggtatttcttctaatgagcttcctccccttaccccccaatccactgacaggccccggtgtgtgatgttcccctccctgtgttctcattgttcaactcccacttatgagtgagaacatgcagtgtttggttttctgttcctgtgttagtttgctgaggatgatagtttccagcttcatccatgtccctgcaaaggatatgaactcattcttttaaaagaatcagtttctcgtttcattgggtttttttttttctattttttttatgttttcagtttcattgatttctgttctttattatttctttccttctgcttgctttgggtttatattgctcttccttttccagattcttgaggtaggagcttcgattattgaattcagacttccttttttctagtatcaacatttaatgccatatattttattttaatttccattcaggtcagtgtgtgtttaaaacaaaattttcttgaggcttgctctttgacccatggattacttagaagtgtgttgtttaatttctaagtgcttgggtgtttgcctgttgtctagttcgagtccattttggttagaaaaccagtctgtatgatttcagtccttttacatttgttgaggtttgttttatggctcaggatatggtttatcttggtatatattcttgaaaagattgtatattttgctagaaagagatttcaaaaatagtaaatatgaatcaacctgaaggataaaaataaatgatttttctttcctttggcaatagaaatattgttactagttggacaagttatctttattcacagcctgagttatacaaaaaataggaatacatcctttttggtggtttacaaatctaattatattttcatgttaaaagtaagtggtggaggatatgtgaagtgtcatagtatttgccacagaggctttttcccattcaaattgtaattgtgtggaattttttattttgtagttgctttagtaaaaacaaatgatagaaaaagcttgctttaaattaaattgaacaatgcataagagtatagagtagaagaaaatatattttggatcatacttttgacaccacctttttcctctctcacaatacatttggaggatcttttcagatagacgtacatagaatgtcctgtatgccattctttgatggcagcagcacagctctccagatgctgatttaaaaggagtttagccacgtgccatttctttcttctggtgcccagtctcactaacctctcctaatagtctagcattggcccctagagaaattcaaaggtctgccaaggtaagtcagcaaaccagtcaagggccaggaagtcaggaatgtgtgagtagctgagtcaggggtctggaatcagaagtgagggtgagtcaggagcagggcccgggctgactcaggcaggctgaggtggtgacctgtggaatcagctgccttactggtgctccagggcaggggcaggctcaccatgctgaggcctgaaacttcacttctttcagggatcagctaatagatgtggtcaaggaatttggtcccagtcaaccttccctgcttcttctgtgttaggtcatctgtcagaaaatgttaaccaaactttagggccacatgactttgtttctctttgtggaaatgggaatgatatcactgcaaagagtcagggaagaggtcgtggggggaaaggaagagggggtcaaataaatcagcgagaaagagagaaacagttggaaagccagacagatactgggcgcttctgcaagagttataaactgttcttatcaccaaatctggtccattctgtcactcacatgagtccgtccagtcttcctctctcttattcccaaaattttagccttttaactgaagtccctcctcacagctgtggattgattggagagaatgagtgagaacagcttgtcaagggtgaccttcagcttttacgttaggtgactggtgaatattggaggcattgagaaggaacagaggaggtccatgtcttggagtggtaagtgggatgaggacttccattttgtgcatgttgaatctgaccgtgttgagtttgaggcatctgtgggacacccaaagaggggtatctggcacaagagaaaggctaggctgaagctactgattttggttgggcccaacagctgcttgcaatagttgcatgctcctgagggggaggctgtttgcattctgtccttgttttacatttccattgggagtggtgttttagaacttcttacagatgtcacaataattgtagacctggccctaccagccatgcttgaggtattatgtagattatctacttctttgctgctagttttcccagcccagttcaactatttcctgatgcaaatgaagcttctaagtgtacaaacttaaaatacctttattaccagtgcaaccacactaaactctaattgcccagcaactagaaagactaggagtagacagtttattgtatgtgtgcattttgatggagggaagagatgaatatttgcaaattcatattatgaagaacaagagtacttctccttgggagatgggtttttccaagatggtaaatgagttgcaaagaacaactttttctttcttttcttgagcttattcaactttttttttaaagcttattttgacttcag

SEQ ID NO: 905 - DNA, 37379 bp, Homo sapiens
cttccaaacagtcccagtaagtatgaagacttacacctgtgtggagatagcccctctcttctggggtgtggggctggggtcccagcattatcatgtctgggggagttggcactcagctgccaaagcctctccatcccttactctccagagacctacagtccaatgtcttaggtttaaggttgaggggaagttgtcagccaacatcagtgtttggttgcaatgagtttggtgtattgaaaatgcaccttattaactgtgtgtgtggaatcccttcttccagcaggggtggtgggagcaaaggaggggaaggaaccccaaaaaagagcctctgtggaaaatgtggatgctgacacaccttctgcctgcgttgtggagagagaagcttcgactcacagcgggagcagaggagacgctctgaatctgagaggtctcaaaagaagcaaaccagacgccacctccatttcccaagaagagcctcaaggagaagccacacctgtgggcaacagagaatccccgggacaagctgagatcaatccagttcattccccaggccctgcgggcccagtcagtcaccccagtggccaagaagtcaaggaactgctgccctttgcatgtgaggtgtgcggcaagaggtttaagtatcgcggcaagttagccgtccacacgagatcacacacaggcgagagactctttcagtgtaatctctgcgggaagcgcttcatgcagcgcataggcctgcaatttcaccagcgaacccacactggcgagaggccctacacgtgtgacatctgccagaagcagttcacccagaagtcctacttgaagtgtcacaagagaagccacacaggggagaagcccttcgaatgtaaagactgcaagaaagttttcacctacaaggcaaatctgaaggagcaccagcgcatccactctggagagaaaccccacaaatgttccaagtgtccaagagccttcggtcggccggcgaccttaagacgccaccagaaaacacatcgagaagccacttcacagtgacttcaccatcgggtctgtcttctgcaccaagaaagtgtgaatgaagatttttcaccgatgttgtcagatgacgtttgacagatgaagggcgcctggcacgcagaggagtgccctagataggaattcctaggatgtttgtttaaatctttttcctccccgggggaattttggtttttgtttcattatttctattgttttaggtttattttggtttgtgttgctgttctttcaataaacatcttattagttttcaatattttgtaacaaaaaacagtctcctgattgacatgctgttgttatgcactgttttgctataaagtacaattgtccaaggagggtgtccggattaaatacacgatatgcctcgggaaatctgggtttcagataaacgttttttgtttttttagtatcagcttgttctaaattattcattatttatctgaaactcagcttttattaggtatcctaaatagttttcttttttatttttttttctattcttttttttgagatggggtctccctctgtcaaccaggctggattgcagtagcaggatcatcgcccactgcagcctcgaccttccaggctcaggcagtccttccgtctaagcctcccaagtagctgggactacaggatcataccaccacttcggccaatttttgtgtttttttgtggagatgaagatttgccttgttgcccaggctggtcttgaactcagaagtacaagtggtccaactgcctcagcctccttaagtgctggcattacaggcatgagccgctgtgccctgtattgtttttattagactttattataattatgatattcaaatttttggaaataattttttgtagtgatgggattttttgttgcccaggctggtgtggggtgagccaccacgcctggctaacgactttctttttcagagctgtcttaggttcacagggaaattcagtggacagcgcagagtccccgtagactcccaccccacacagcacagcccctccccgcccagcatccccagcagagcggtgcacctgttccatcagtgagcctgcctggacatatcaccaccacccagagtccatggtgttcattagggctcgctctgggtgttgtacatcctgtgggtttggacaaaggcctcatgagtacccaccactggagtattgtggggggggtattttcactgccccccccgaatcctctctgctctgcctatttatctccccgccccagatggtgtattttgtggcctaaatttggcaacctctaaattcctgatttgactcttgaactacggaggcattgggagtctctggtgactagttggtcttagtgatagtaccatcccctgaagcctttgttgatccagagatgggtggaccccaaactcagagcttctgatttagtaggccgggggtggggcctgagagtgtgcattaaaacagaattcgtaggccgggtgcggtggctctcgcctgtaatcccagcactttgggaggctgaggtgggcagatcacttgaagtcaggagttcaaaaccagcctggccaacatggcaaaaccccatctctactaaaatacaaaaattagccaggcgcagtggcacgtgcctgtagtcccagctacttgggaggctgaggcaggagaattgcttcagcccgggaggcagaagttgcagtgagccaagtttgtgccactgcactccagcctgggcaacagagccagactcagtctcaaaattaaaaaaaaaaaaagaatttgttttagaatagctttctaaagtccattgagctccctactgtccccacaccatttcctctattattttttgtttgtttgtttgtttgtttgttttgagatggagtctcactcagtcacccaggctggattgcagaggcacgatcttggctcactgcaacttccacctcctgtgttcaagcgattctcctacctcagcctcccatgtactgggactacaggcatgtgccaccacacccagctaatttttgtatttttttagtagagatgcggtttcaccacgttacccaagctggtctcgaattcctgacctcaagtcatccgcccatctgggcctcccaaagagctgggattacaggtgtgagccactgcgcctggcctcccctattgttaacatggtacgttagtatggcacatttgccacaagcgatgaactgactggatatattgccgtgatctaaggcccataccttattgaggcctccttagtgtttacacaatgacctcctcttccttcctccccatccaggatgccacattgccttgagttgtcacgtctccctaggatcctcttggtgacaatttcttagattttacttgtttgggatcacctgagaatgtgcattttaggtggtgctgatgctgctggtcttgggagaacattttatggatgagctgacaggcagagtcctgcagtctgcagaggtctggaaaggtcccttcccgaataggctggattcatttattaaaggccacttttgtaagactttggttcttgtcatcttaatttaaaggaaatttatcaagagacacacagcaaagagatgcatcatagagtaactattgcaaaggaaatagagtattttgaaagttaagggcagaatagacaggacatcctgggagcaaggattcagggccaactgctcctaaggatgagacagcaaagacccgctagagggagactcccctttatgggagtctcggatcattacacaagggggtgggaagaggtgttactagtaagcatgttctgggtggtcccctgggcacacaggtgcagtagctgtgcacacgtctctttagcatcttaagtctccacccaggggtgtgttttttactattataacgagcaaagggtcagtttgtgaacaggtaaaatcacaatgctcatgttctctacagggaaaactcccttttgtagatggttttgtgtgaatgaactcaattagaaagtgaaggctggggctgattgtgttggctgtacggtccccatgggtgctgcgtttggaggacatggtcaccttcttgactacctatcctgactcacccaggtccatttaggagaaagagtccttgaggtagaaacctgaatccgccatcaaatgtacacagactcccgtttaattcaagaagtggatgtttggtgggtagtggttctccatttagatattgggtccaacatccttctccagacacagaaaatgtgttgatgataccacctgcccacttaatttaaatcatgtttctctatgatccattaaccacatccgacatttctttagagcttcatttcccaattttcctacatgttggactcacttgaggtgttttttcaatatttttttaaaaagcaatgcctggggtccagccccaaggtaatgatgtgattggttgaggatgtggcccctgtgttgagagtttataaaactcctcaggtgatcaaatgtgtggctgagtctggcaggtcggttttctgattgtctggtcactccaattcctgttctctcatggggatcagtgagttcatttccacggagagtcatgcacctccattcccagtctaaagaaggtagactccacagctggctcccacccaccctgcacgggggtccctcccactgtggctggctacatgcaccactccagggactgcccctcatggctctgggcacatgtggcactgggtggcctttgcactgctgctccttatccacctatgtgctctgagccaagagcttgatttacctgatgtgacaatgaaaacaggatacccactgcaacctcaaaaaagcccagtgcggctgggcgcagtggctcatgcctgtaatcctagtattttgggaggccgaggtgggtggatcacctgaggtcaggagtttgagaccagactggccaacatggtgaaaccccatttctactaaaaataaaaattagctgagcatggtggtgcacgcctgtaatcccagcattgcattccagcctcggtgacagggcaagactcagtctcaaaaaaagcgccatgctagggatgactgaattgaatttagaaggtgcccttgctttcagaaaaacaacaacccaacactgcttaatctacccaacccggagccaaatctgcaccaaccaaccacctggcccacctggtggcttttcagactctgaccttgacgatgggacatgaggtggggaaggaggtggaagcacagctagggaagaaggggcaagagacccactcccctggcatgatccctggggtcttggaggctgggccggtcaacatggctgcagttatttctagctttctggattcccagaaaaaaacagctgtacttcaaagaaaatgcagaacaaggtgaggtcgacgtggaaaatcatcccaacatcagccaaacggaactgggctctgctatccgagtgcactcaggccaaacacccacgtgaagcttttacagtgagagaaaggaagacatttatttgcagggcaccaagcaaggagaatcgggcagctaatgtttaagacctgaactccccccatggcttaggagtaagggtttttttttttgtttttttgtttttttttgttttgtttttgagacggagtctcgctctgttgcccaggctggactgcagtggcacgatctccgctcactgcaagctccgccccccgggttcatgccattgtcctgcctcagcctcctgagtagctgggactacaggcgccatttttatgtataaatttataaagttaatattgataatgacagacagaaaataatgccttctctaagaatgtgtgaccaaccaccatccttccctcatggggatgtggagtttcccttgtcttggatgcctaacagagctgtcaatcaccacacatcctagaccgaccacatctttccccacctcacgtaagggtggctccagcccccttgatgtgcaatccacaagatttgtggggttatccttgattcctgcatttccctcacatgacacactcagtctctcaacaaatcctataccttaattaatgtgtttactgacatgaatttcacgcgacataaaattaactgttttatctgtacagtttagtggcatttggtgcatttacactgctgtgcggcagctcctctagctggttcctgtgcctgcatgtccagagtccaagttctgacatttgtacatactcatgaagtcattgccgtcatcaagaagctgaacatccccaccatcctccaacgcttccccaggctcttcatcatctgtccctcccacaactccatccctggacaaccactggtgttctctgtgtcattacagatcactgacagaatttccttatttttgccttttttttcttttttctttctttttctttttttttttttttgagacagtgtcttgctctgttgcccaggctggagtgcagtggcacaatcatagcgcactgtagcctcagcttctcaggcttaactgatcctcccacatcaccctcccaagtcgctgggaccacaggcacacatcaccatgctcggctaattgtttctatttttttgtagagctggggtctcactatgttgcccaggctgatcctgaactcctgggctcaagcgatctgcctgcctgggcctcccaaaaagtgctgggattacatgcatgagccagtgtgcccagcctaggggtagaattttctagcgatggaatcataccttatgtactccttttctatctgccctccttcaccttcataattattttgaaattcactcatgttcttgggtgtaatcaatgattcctttttactgctgagtagtattctcaacttcattgaattgtaccctttgcatatgtgtgatttattgtatatcaactatacctcagtaaaactatacgaaaaagataaggggttctctgttttttgttttgttttgtttttgagatggattctcactctgtcgccaggctggagtgcagcagcatgatctcggctcactgcaacctctgcctcccgggttcaagcaattctcctgcctcagcctcctgagtaactgggactacaggcgcacaccaccatgcccagctaatttttgtatttttagtagagacggggtttcaccacattggccaggatggtctcgatctcttgacctagtgatctgcctgcctcagccgcccaaagcgctgggattacaggcgtgagccaccatgcctggccaggattttcttaaaacttaaaaacaaattcagcatttgaccagttctccccatttcaactttcagtattcatggtcaagccaacagccatcaacctggatgactctgttgccatcctcactgagctcctggttccttcccttcccctatatgggctgttatcttttttctcttttttcttattttgttctttttttttttttttttttgagacagggtcttgctctgtcacccaggcttgagtgcagtgacacaatcataatgccctgcagcctcaacctctcaggctcaaacaatcctcccacctcagcctccccagtacctgagactacaggtgtgcacaaccaggccttacaatttttttttttttgtatattttgtagagatggggtttcatcatgttgcccaggctggtctttaactcctgaacccaagctatccacctgcctcagcttctcacagtgctgagattacaggcatgagccaccgcggttggctgtatgggctattttcaaggcatcttctgagaaaacgctaaagagaagtcagaaagctactctatgaaggcagaggcattcgttggagctctgagtgatgtacctgcaatgtctagattctagttttaggagtcggcagagtcagcccaattctatgtgtcagaccaattcaatgactgaaatagtggcagctccacctactagtacaatgggtcaagttttcacatttcacttgttcctacaggatggggcctggcaggcttgagttgagatttatgcttgtttctatgtagctttggatcgttgtgaaagccaggtcatttcaatcattttgtgcaaacatcattgtgtgtaaaaacggtgtccacgttttgtctttgaaatggtccccgccctccgctcgttatcgtgttgagaatgaaatgagaggacatgcttggcacctggagatgattggatattacagctgtgcgccataagggcaaatggttccattgtttgatgagccgtcctggcggtgggtgggtcggtcacttctaaacagataaggaatggctagaaagctcttgtaccaaaccagcttgaagcaacctcacccacaccgaatccctccacgtttcttttcttttttctttcttcctttttttttttttttttttttttttttttgagatagagtctcgctctgtcgcccgggctggagggccgtggtgcgacctcgggtcactgcaagctccgccccccgggttcaagcaattctcctgcctcagcctccggagtagccgggattacaggcacccgccaccatgcccggctaatttgtgtattttagtagagacagggagggtttcactgtattgtccaggctggtcttgaactcctgagctcaggcaatgcgcccgcctcggcctcccaaagtgataggattacgggcgtgagccaccgtgcccagcaaatccgtctacttttcttttttctttctttctttcttttctttcttttctcccaacccccctccccccgtcaaacaaccaacagttttttaacacagaaagtaaggcataatccagggcttggactgtctttcaagaaaaccccaaacccgctgccaggaagtcacagccactaagtcccatcccaggcccagttgctgccaggaaacacaccgcgtggagacccagcatgactgctgactgattgcaagtccccaggagggctttatttttgcttttcaacatcctgttctgcaggttccttggctctttttgcccgtatgccgaagagccgggcattgggacgggccatgcggagactagcgaaggctttgaaattcttctcctcgatgatgactccagctttctccttctaggcattccggttgggcatgaccggtcctgtcagccgagcggccagtttcagttcttcagcagaactgtctcccttctcggaggccgagggcttcccggggaagcggatgcgtttggagcggggctccttcagccgccgcacgttggcctgcagggactgcgcctcctcggatccgcagaaatgccggcgtccgggcccccttcttcgcgtgccggccaccctgagctcctccaggcggaggccgcggccgtgcgcaccttcgtgtggtaccgaaccgtggggcagcgcacgatgggccggatgggccccgacgcggggcaggggcgaggcggcgcgccttggcttgcccggcctggcgcctgcggatcttctgggccggctggttgaaccgcttggccacgcgccgctgcagtccttggggaagcggggcttcgagatcgtgccgttccggctgggcgccgtggctgcctacggccctgcggctgcagaccagaggggagccaccgaggggaaggtccctgcgcgcgcgcaccccatccccggcctccgcctctaacctcccagcctgggccggaggccgcccctagagcccgggccccggtccaatgctgtctgcgaagaaggggcccatccatgcccgcgttggcggcagcgccaggccgatggcgctggatggagcccgaaggccgagaccccaaatccctctgcttttctaagaaatcgccctccagtctttttttttttttcagatctgtaacttgttttcacccctgatttaaaacaataccactgttctcccccaaattttcctttgatacagtaggtgaacaaaatagatttttttccccacaaatatcagcagacacttcttggcaccccacactgtattggcatgggtgttaacagtcccagttcaggtgtgcagcctttcaggtggatgcactgtaacaaggatgtaaatgcggagccatcctaagaatcacattcagtcatggggttgcccttccaagctggcagaaaaggaacccgggccaggcaccgtgaacacacacagtaactcatgcctgtaatcccagcactttgggaggctgaggcgggtggatcacgaggtcaggagatcgagaccatcctggctaacatggtgaaaccccgtctctactaaaaatacaaaaaattagctgggcgtggtggcgggcgcctgtagtcccagctactcgggaggttgaggcaggagaatggcatgaacccgggaggcggagcttgcagtgagccgagatcgcgccactgcactccagcctgggcaacagagcaagactctgtctcaaaaaaaaagaaaaaaaaaaaaaagaaaatcgacctgccagactcagccacacgttagatcacctgcggagttttataaactctcaacacaggggccacatcctcagccaatcacatcattaccttagggctggaccccaggcattgcttttaaaaaaaatattaaaaactcctcaagtgactccaacatgtagccaaattagaaaatgaagctctaaagaaacattggatgtcattaatggatcatagagcaccatgattgaaattaaacgggcaggtggtattatcaacacattttctacgtctgtgaagaaggttggacccaatcaccaaaagggagaaccaccacccacccctacctccacttcttgaatgaaaggggagtctatgtacattttatggtggattccaggtccctgcctcaaagaatgctactccgaaacggacctgggtgaggcaggataggcagtcaaggaaatgaccacgtcctcaggatgctgcacgcgtggtgactgtacagtcaacacagtaagcctcagcgttcacattggaattgagttcattcaagcaaggccatctccagtagggtatttccactgtagtatttccactgtagagagaatgtgcacgttgatcttacccatccacaaaccgacacatttcttgttatgatagtaaaaaacacacacctgggcgggcagttaagacgctaatgagacatgtgcacagctactgcacctgtgtgcccagaagagcacccagaatatgcttagtagtaacacctcttcccacccccctaggtgtaatcatccaagactcccataaaggggagtctccctcaagcaggtctttgctgtctcatccttgggagcagctggccctgaatccttgctcccaggatgtcctgtctattctgcccttaactttcaagatattgtatttcctctgtaatcaattattctatgatgcatctctctgctgtgggtctcttgattaaattcctttaaattaagatgacaagaaccaaagtcttacaaaagtagtctttaataaatgaatccagcctatttgggaagggacctttccagacctctgcagattgcaggactctgcccgtcagctcaatcagccatccataaaatgtcctcccaagaccagcagcatgagcaccacctaaaatgtacattctcaggtaatcccaaacaagtaaaatctgagaaattgtcaccaagaggatcctagggagacgtgacaactcaaggcaatgtggtgtcttggatggggaggaaggaagaggagggcattgtgtaaacactaaggaggcctcaataaggtatgggccttagatcacggcaatatatccagtcagttcatcgctccagtcagttcaaaggtgccatcctaatgaaccatgttggcaatgggggaagccatgtggggcattagggagctccatggactttagaaagctattctaaaatgaattatatattttaatgcacactctcaggccccatgcccggtctgctcaatcagaagctgagtctggggcccacccacctgaggattaaccacgccttcaggggatggtagtatcactaagaccaactagtcaccagagactcccaatgcctctgtagttcaagagtcaaatcgggaatttagaggttgccaaatttaggccacaaaatacaccatctggggcagggagataaatatgcagagcagagaggattccgggggcagtgaaaataccccccaggatactccagtggtgtgtactcatgaggcctttgtccaaacccacagcacgtacaacacccagagcgagccctaatgaacactatggactctgggtggtggtgatatgtccaggcagcctcactgatggaacaggtgcaccactctgctggggatgctgggcagggagaggctgtgttgtgtgaggagggagtctaggggaactctgtgctgtccactgaatttccctgtgaacctaaacagctctgaaaaagaaagtctagagccaggcgtggtggctcaccccacaccagcctgggcaacaagaaatcccatcactacaaaaaattatttcaaaaatttgaatatcataattataataaagtctaataaaaacaatacagggcacagcggctcatgcctgtaatgccagcacttaaggaggccgaggcagttggatcacttgtacttcggagttcaagaccagcctgggcaacatatcaaaattccatctctacaaaaaccacaaaaattagccaagttggtggcgtgctcctgtagtctcggctgctcgggaggcttagatgggaggattgcttgagcctggaaggtcgcggctgcagtgagcggtgattatgccactgaacctcagcctgcgtgacagagggagacgccatctcaaaaaaaaaaaaaaagaaagaaagaaaaaagaaaacgaaaactctacaggatacccaataaaagctgagtttcagataaataaataatttagaacatgctgatactaaagaaaattgtttatctgaaactcaaatttcatcaggcattatgtattttatatggccaccctccttggacaactgtactttacagcaaaacagtgggtaaccccatgtcaatcaggaaactcagttttccgttatacaatattgaaaactaataagatgatcgtttattggaagaacagcaacacaaaccaaaataaacctataagaaaacaatggacataatgaaacagaaaacaaagctcagtggggaggacacatatttactcaaacatcctggcaattcatatctagggcactccctctgtgtgtcagacgcccttgcatgtgtcaaatgtcatctgataacattgatgaaaaatatcattcacttcttcttggtgcagaaggcatagaccggattatgcaatcactgagaagtagcttctggatgtgttttctggtggcgtcttaacaatttcagccgactgaaggctcttggacacttggaacatttgtagggtttctctccggagtggatgcgctggtgctccttcaggctccccctgtaggtgaaaactttcttgcagtctttacattcgaagggcttctcccctgtgtggcttctcttgtgacacttcaagtaggacttctgggtgaactgcttctggcagacgtcacacgtgtagggcctctcgccagtgtgggttcgctggtgaaattggaggctaataagctgcatgaagcgcttcccacagagattacattgaaagagtctctcgcctgtgtgtgatctcttgtggatgactagcttggaattacacgtaaacctcttctcgcacacgtcacatgcaaagggcggcagtgccttggcttcttggccatccgggtgactgactgggctcgcagggcctggggaatgaattgaattcatcccagcttgtcccggggattctctgttgcccacaggtgtggcttctccttgaggctcttcttgggaaatggaggaggcatctggtttgcttcttttgggactgctcagattcagagcgtctcctctgttcccgctgtgagtcgaagcttctctctccacaacgcaggcagaaggtgtgtcagcatccacattttccacagaggctatttttggggggtccttcccctcctttgctctcaccagatctgctggaagaagggattccacacacacagttaataaagcgcattttcaatacaccaaactcattgcaaccaaacactgatgttggctgacaacttccgctcaagctcaagcctaagacattggactgtaggtctctggaaagtagaggatggggaggctttgacagctgagtgccaactcccccaggggatgataatgctgggcccccagccccgcaccccagaagagagggactaacccctgtggatccaagtcttcatactcactgggactctttggaagctgaggctctggggatgtcagtcctgggttctcttccctgttttccttcagatccttctccaaggtctgcttgggtctcagagactttgggtcacctgttacgtcaatactcttgtgtagcagaaagtcctctccctgaagaggaaaaaccaagagtaatgactgctgtgtccaaactggtggaagcagggacacatctgtccccttctgattggatgcaacaactcttctaatgacacaggtgtggaaatacgtgcagacttcccctggaccaccccatcaccccacgtaaacatcaccatctcatttctgtgtctgtccctaatctgcaccctccatattccaaatcagctcctgtgcctggtggttttcactgtttggttctctgagcatatttctccccgccgtgccaacgtctccctgcacctgacactggaaggagcatgactctagtcgaggcccctcagctgtggcaccactggcattggggctgcatcaccctgctggagggggcgctcctgtgcagagcagagaccccacctccaccctctagatgctattaacaccccaccatcccctacaatgacacacaaaagcatctccagacatggccatgtgtccggaaaggcagaatcaccccagttgagaaacactcctcaaattaagaaattgacaatctgtagaaaatggtttccttgctgaattattacattaaatgtctttgaggaaactggctacggggaaggaatcttcattcatctgtgcaaactgcctccctcatttcactgagatcatttcttatgccccaccctaaatgctaaaagctctcatggtggagagaaaagtagatgaggcttccctctctgtgatggctcaggaatgaatgtttggggatgtatcatgtccatggggaatggctctaatcttgtcctgtgtcaaatctctcaatcagtccagcggccacacgatttcctcctgttccttctcccacctctgcccagacaccaaggcctcacacactcacctgcctcctggacaatgcagggaccctgggcaggatctgcagctctcggtgggcctggccttcccctggacgcatctggttcaccgaggaggcccgttggctggacacgtctttcagatcatctctgacactggagggggcttcagccatctcgatatctgagtcctgcacaatatattcctttccgtggaaggtgaccacagactgtagagagaaaaaagacaatcagactcaccatgagaacctgaaagtagctctcatattccctgggtcctgccataatgctcacactttactgtaattaatgttcaaatctgccttcccaatagagagtcagctctgtggacacagcaatcctgtctgaattttttcctctctagactccagcacctgcctgcgcctggaatattctagttaagtacataaacatgggtcctttagatgaaatagtctctaaaccaaagagaagacaaggagaaatattctgggtgaatccaactcaattggccgatggcagctcaccttgtattagaacttaggggctcatttggggacctgggggcagatccctgcatctgataccaaccactttccctgcttcaggatgggactcctgggccccccttcagttcactctaatgcctccttccctacattccatcaggcctaatatttcaccaatgtctttctttcatgttggcctcacacagtgtgtgggtccctgtaccccctctgcctgtccatctcctacaccaggaacttgccgtctcagcacagctgatattggaatctggatgattatttgtcatgatgggttgtcctgagcgttagagaacgcttagcagcgtctcctgtcctccctgacaacaaaaactgtccccagacactgccatgtgtccccgacgggcaaactctcctctacttggaagccctgacctagagcagcccctcgggtcctctcgagtccagctgcaccgtgcagcccccatcccagctccccttccctgcaccaatcacgagggtcccactcacccatttcttgggtcttctgttatttcgtagcaggtcctccaggtctttgcagctctgcacaccgttcatcatgactaagacctggagctcctggggcatggagatcatgaactgctccatcaccagcatgtccaggatctgctctttggtgtggaggtcgggcctcagccacagatggcacagctcagtgagtttcctcagagcctggatggggtccgactccttcgggcagctgaacatcctgaagttcacgtgagaaatctcagggtccacgtcgtgatttccaagttgagtttctgaggatgccatagaccgtggcagctccaacccaggtctgttgcaggattctcctagactccatgaggatgtgcaatttgcagccatatctagtggagaattttttaatcagtctctgagaaagctcttccagtagctggtatctaattgatacctatctacacaggcttcctctggttttcctcagtaatagattcactgttcattcagaagtctgggggggaaaagtatgagcctcattagtttaagttactactccatccatccctcccttcgaaatccctcatcctggatgccacttcttcagcagcatcgaattcagcacagtggaaatcttccagtgtctatacctgactacatactctggtttaaaatcttaatgacccctggattctgatctctaggaaatcactgtgcagaggctgaatcagttttcctgtcaattggaacaacattgttcttgactataaattaaataagatagttaggtgaagctctgaaaatgtgatgcaacaataaagtaagccctttatgtttccccatcaggacaagatccaaggcaaagcccttagtcataattatgcaaaaggatagagaaaaagagttagaatgtaatattttccccaacacatattcttgttaactccagaacatttacttgctccagggaagggacagcattaaaggatcctatgaggattaagcacctacacagatattttgttattttggtaaaatgtacattcataaatttcatcattttttactctcttcaagttcacgattttatgggactaagacatgcaccatgttgtacaaccattaccactgtttacttccagaattatctcatcaacccaaaagcaaccccatccccatcagtgatcaccccctgcccacccaccccagcccctagcaatcactaatctaccttctgtctctaagggtttctgtattcctaatctcatctcagaaaatggatttaaagtctagtgctctttgatattttaaagaagtgggttgatacaataataagatttttaaaaattaattcctaaacctagcttcattaggcaggagccactgagtgatactctccaggcatcaattatcgtccaagttcaacagctatgagaacacagccctgctttcctagacacaggtgggggaagcaacctgaaggtctgcagaggggagaaaaaactggcagaagggtcttgggaaaagtcactggtagcctggagggcgagtgccccacacttcctggaaggactttgagcaagtgcagaacagagagacagccagggagacaatcggcagaggcgggagacaacccagaggaggagacaatatttacacaccacacatctcacggggctcctgtgcaaaacataagcaactcaaactcctccagagcgagaaaacacataacccactagaagggcttaaggcgcctgtgtggacatctcagatgaagacatgtgaatggccagcaggtctaggaaaaggtgctcattatcactcatcatcagggacatgcaaatccaaaccacaaggcacccctcacgcctgctagagtggctgttcccaaaaagacacatggaacgagtgttggtgaggatttgggggaaaggggtcctctgcgccctgtgctgggatgtaaattagagcagccgatatgggagacagtatagaagctcctcagaaaattgaaagtccaacaactgcatgatccggcaatcccgctccggggcaggtacacagaggaaaggaaatcaggacgtggactccaaaacagtgaaactctggagggatagagggagggagggttgaaaaactacctattgggtactatcctcatatcctgggtgatgggtagagtcatacctcacacctcagcatcactcaatatactcatgcaacaaatctgcacaggtacccactgaatctaaaacacaagttcaaattacaaaaaaaaatttaaaaagaagtaaataacataaataataattaaaaacccagtggaactcatagtagtagtgagtagaatagttaccagggctggggtaggggttgggaagatataggtcaaagagtacaaatttcaattgaagaaatcaattcaaaagagcaattgtccaacatggtgacttcagttcataacaatgtattgtatacttggaaactgcttaaaaaaaattagatttcaagtattctcaaaaccaaaaatggttagtacatgaggtagggcatatgaatattagctcaatttagccatttaacaatgtttgtaatactacaaagcatattatgctatatgccataaatatatacaatttttagttttcaattagaagcaaattaatttttattgaaaaagcacacagatatgatagagaaaagggagcctgaaattctggaattaaaagtggttttgccagagggcgcctgctgctgctcaggaggcagaggcggaggtgggaggatcacttgagcccaagtgtttgataacagcctgggcaacatagtgagatcctgtctctaaaaaagaaagtggtttcatgttcctagaaatcactttgtatttgatcttagttcattccccgttaaagtaagaaacaagacacaggaaaaaataaaggcagacacaggagttagtattcaattctgggagtatataccacacgggtcacccaggtagggacacttagctcagattctcattggcctagtaggttgatgctcattcatcaatgatttgatttcaccctgtgcaaagggaaaatccagcaatgctttttaaaaagggtgtgtggcaggcaaagtggctcaggcctgtaattctaacaggttggaagaccgacatgggaacatgctagagcccaggagttcaggaccagcctgagcaatataccgagaccccatctctgcaaaaaaaaaattaaaaatttatccagtcgttgtggcatatgcctgtagtcccagctactcgggaggcggaggcgggcggatcgcttgagcccaggaattccaggctagtctggaattcaagcgagaccctgtctctaaaataaaataaaatataacctaagcttgatgagaaagttagtattattcctagtttacagaagcgttacataacgagtcagagttaatcatggggtgcaaaggagacccgctgccttcacaaagtctccgagaaaacgcacgaaaaaataaacccaaactttctgaaaccaacccccgacatgccagctcctaaacccgacagacatccccgctggacactcacctccttcccggcttctgcctccgaccttctcggtctgggatgcgctctccaaccggcctggagctgaactgcgtctatttatggagaagcgggactccaggccgcgtttccggttccctgcgccgccccgtgattggtttagggccatagagtccattttacgtaatcggcgttgattatggttcccactgaaaccccacccacaggaaattaatgtactaaacatgcctactgtgcaaatatttcccgctctactgagttgtcatactgctgaagtatttggtggcctcagaaaatatagatttgcgagttttaaccattttgggtcccctcatgccacagacagtaatatcctaacaagtaaagaacatgttaagagctggtggattagtatcaaaccagtgatttgatctagtttgagcaaagctctcacatatgaatgtcaagatactgaaaaaaagagacagtctttgttgatacataatgaatattggtgataattttttactgaaaaaaagagacagtctttgttgatacataatgaatattggtgataattttttattttttaaaaagaatattggagttgacatgggaaagctttgtttgaactagactaaatcagtggtttgatatcagccaacctacccttatataaaaacagtgggaaccagagaaaggcacatggtccccactctgcattcattccaggacggtgatagggtggtttatagatacactgagggtcctacggggttccctagttctcagcccccctcagttagggctctcaagcacgaaaagccttaacggtgggtgtgaattttactgtgtggatcatggagttaatgtggaatgataattaagtgctaggcaggattagattacaatttgggaagttcacaccatcagttggatgacactaatccattcaagtagtgactcattcattttaatttcagaggaaaccttctcgtctaacctttaggacaaattggagggctgttaattttacactgattctggtttaaatccttggaaaatcttaagccgcttcactctgggaacttcaaacttcttgggagtagaactttcctgatgtgttgttttgaagatgaagtaagactatgtcagtaaagtgctcaatacaaggttcattttgccaagaaattgtaacaattattttctgaggcatgttctcatactttgttacattttttcttgtttaccactgaggtgttgactctaactcaactctaacaaatgagttagagttaagaatggaattattcactggaattaactgggagctgcctaagccactctctggctacccaattcccgattcccctaaatcctcccctctgtaaactcatagtcttatttctgtgaagctgccgttggtattttggaagagaccgcatcgaatctgctgatgtctattaatagtatggtctttttcacattctatgaacatggctttccatttttggtggtcttttttgttttttttcattagcacttaatagtttttcttgtggaaatctttcacctccctggttaaatttattaccaggtttttaggggttcttttgctattgtaaatgggattgctttcttggtttttgttccactagcttgttggtgtataaaaacactactgatttttgcatgttgacttcgtatcctgtagttttactgaattcctttatcagttctgttttactggtggaggtttcaggtgtttttatagatgataacatgttgtttgcaaagagagacaattcgacttcctccttctgaatttggatgccctttattccttgctctggctaagactttcccaacacattattattatattattattattattttgagacaaagtgtcgctctgtcacccaggctcactgcaacctctgcctcttgggttcgagcaattatttgcctcagcctcccaagtagctgggatttcaggcacacgccaccatgcccggtgaatttttctatacttaatagaaatggggttttaccatcttgcccaggctggtcttgaactcctgacctcgtgatccacccgcctcggcctcccaaagtgccgggattacaggcatgagccaccatacccggccccaacatattattattaacaaaggtcaccagggtgaagtttggaaacaggtatacgttgtgatgcaatcgtcagaaccaagctagttaacatctccatcacctcacatagataccatgttctttccttcttattagttatttaactcttgggctcaagcaatcctgcttcagcctccctagcagctggggttacaggcacgagccacatctggctttctttttatttcttgatgtgtgtgtgtgtgtgtgtgtgtgtgtgtgtgtgtgtgtgttggaaacatttaagatacaccctctgagcaaatttcaagtatacagtacagatgctcctcgacttacaatgaagttacatcctgataaaccctattgtgaatgtaaaatatagaaaataaaaatgcatttactattaggtcacttactgaacatcagcacttagcctagcctaccttcgacgtgctcagaacatttacattcccctgcagtcaggcaaaatcattcacaggaaacctattttataatagagcactgaatatctcatgtcgtttattgaacattgtactgaaagtgacaatcagaatggtgtgtgaatattcctcagtaacgtacacagctgaaagcagaactttgagatcagactggcaacatggcaaaacccagtctctacaaaaaaacacgaaagttcactgggcattatggtgcaagcctgtagtcccagctacctgggagtctgaggcagaagaattgcttgagcctgggaggtcaaggttgcagtgagctgtgatcacgccactgcactccagccagggtaacagagccagaccctttctcaaaaaataaatgaatacataaatgttcccctcatacaaaaaagataagtatgcaagtcactcatatgtcaaattattagatttagcattgcacgttgtatatatgtatcaaaacattatgttgtacaccaaaaatgtgtatgtaccatttttatttgtaaatttataaagttaataataataatgacaaaaagaaaataatgccttctctaagaatgcgtgaccaaccaccatccttccctcatgggaatgtggagtttcccttgtcttggatgcctaacagacctgtcaatcaccacacatcccagacctaccacatctttccccacctcacgtaaaggtggctccagcccccttgatgtgcaatccacaagatttgtggggttatccttgattcctgcatttccctcacatgacacactcagtctctcaacaaatcctataccttaattaatgtgtttattgacatgaatttcacgtgacataaaattaactgttttatctgtacagtttagcagcatttggtgcatttacactgctgtgcagcagctcctctagctggttcctgtgcctgcatgtccagagtccaagttctgacatttgtacatactcatgaagtcattgccgtcatcaagaagctgaacatccccaccatcctccaacgcttccccaggctcttcatcatctgtccctcccacagctccatccctggacaaccactggtgttctctgtgtcattacagatcacggacagaattttcttttttctttctttttttcttttctttttttttgagacagtgtcttgctctgttgcccaggctgcagtgcagtggtatgatcacggctcactgcagcctcaacttctcagccttaagtgaacctcctacctcagcccccccaggtggctgggaccactatgtccggctaattttttctactttttgtagagatgggtctcactacattgcctaggctgatcttgaactcctgggctcaagcaatccacctgcttttgcctcccaaagtgctgagattacatgtgtcagccactgtgcccagcctagtaatagaattttctagaattttatattgatagactcataccagatgcactttttttctggctgtcccctttcaccttcgtaactattttgagattcatccatgttcttgggtgttatcaatgatttctttttactgctgagtagtattccaaactttattaaattgggccctttggatatgagttatttattttatatcaactgtacctcaataagaccatgaaaaaaaaagaggattctcttaaaacttgaaaacaagttcagaatctgaccagctctcctcatctcaactaccagtactcatgggcaagccacagccatcaacctggctgactctgctgtgatccacactgagctcttttttcttccccttcccctatataggctaatttttttttctttttctttttctttttttcagacagggtcttgctctgttgcccaggctgaagcacagttgcacaatcatagctcactgcagcctccacctctcaggctcaagcaatcctctcacctcagcttccccagtagctgcgaccacaggtgtgcaccaccaggcctggctaattgttttgtatgtttttgtagacaccgagtttcaccatgttgcccaggctggtctttaactcctggacccaagcaatccaccagcctcagcttcttaaagtgctaggattacaggcatcagccatcatgtctgactatatgggcttatttccaagactttattccaaaaaaaatgttaaacagaagtcagaaagctactctatgaaggcagaggcattcgttggagctgtgagtgatgtacctgcaatgtctagattctaattttaggagttggcagtgtcaacccaattctgtctcaacactattcaatgactcaaataatggcagctccacctactagtacaatgggtcaagtttttacatttcacatgtgcctacaggatggggcctggcaggcttgagatgagacttctgcttgtttctatttagcttcagactgttgagaaagtcaggtcatggcattcatttagtccaaacatcattgtctataaaaacggtgtccacgttttgtctttgaaatggtccccgccctccgctcgttatcgtgttgagaatgaaatgagaggacatgcttggcacctggagatgattggatattacagctgtgcgccataagggcaaatggttccattgtttgatgagccatcctggcggtgggtggatcattcacttctaaacagataaggaatggctagaaagttcttgtaccaaaccaacttgaagcaacctcacccacaccgaatcctatacttttctatgaaatcacctttttttttttttttggagatctccaactttttttcacagctgcttaaaaaaaaatactactgttcaccccagactttcttttgatacactaagtaaacaaaacagattttttttttttgccataaatatcagcagacacttcctggcaccccacactgtatcagcatgtgtgttaacagtcccagttcagatgtgcagtgtttcaagtggatgcactgtaacaaggatgcaaatgcggagccaccctcagaataacattcagtcatggggttgcccttccaagctggcagaaaaggaacccgggccaggcaccgtgagcacgcacagtaactcacgcctgtaatcccagcactctggaaggctgaggcaggaggatttcttgagaccaggaatttgagaccagcctgggcaacatagtgagacccaactctacaaataagagattgtgtgtccggaggctgaactcacaaagatttcagaatgtcagtaggagaggaggtgtgtgggatagcagccaattcgtcagtgaatgaggcagagaaattggtaaaaagaaggaaagtgaaaacaagaagcatgttcccattttcaaggtcttcctggttcacaaagtgggaaggaagaaactactgaagaggaaagagttctcttgaagagtacagaattcctgggctccccggttcaggtcataaaaagaaaagagaaaacgtttgcagccatgcagggtgaacaagctctgaagatatattatacggactaggggttgtaatcaatgttagggaccatcccctacttctgagggctctgaggcaggagaatagggtgagggaagagagagaccctctcatattgttttatattgttttatactcaatacctgttttaaaaaaaaaacaacaaggaagtaaaaccaaagacaggcagcccggcgccaggcccgaaaccaggcctgggcctgcctggcctaaacccagtagttaaaaatcaactgataacttaaaaaccgatgttattcatagattccagacattgtatagaacaacattgtgaaactccctgccctgttctgtttctctctgaccaccggtgcatgcagcccctgtcacgtaccccttgcttgctcaaatcaatcacgaccctttcatgtgaaatccttagagttgtgagcccttaaaagggacaggaattgctcactcgtggagctcggatttcaaggcagtagcttgccaatgctcccagctgaataaagcccttccttctacaactcggtgtctgagaggtttcgtctgtggctcgtcctactacaagggaattagggtaaccaggggttaaggtagaagcaaaagaaccgcacttgcagccagttctaggcaagattaggcagcacacaggccacatcctcactcctgtgataacgagacagaagcctccactccagcctctgattgaccgtgggccaagcctccactccaacctctgatggacggtgggccaagcctccactccaacctctgatggacggtgggccaagcctccactccagcctctgattgaccgtgggccaagtctccactccagcctctgatggacggtgggccaagtctccactccagcctctgatggaccgtgggccaagtctccactccagcctctgatggatggtgggccaagcctccactccagcctctgatggaccgtgggccaagtctccactccagcctctgatggacggtgggccaagtctccactccagcctctgatggaccgtgggccaagtctccactccagcctctgatggatggtgggccaagcctccactccagcctctgatggacggtgggccaagcctccactccagcctctgatggacggtgggccaagtctccactccagcctctgatggacggtgggccaagcctccactccagcctctgattgaccgtgggccaagtctccactccagcctctgatggacggtgggccaagcctccactccagcctctgattgaccgtgggccaagtctccactccagcctctgatggacggtgggccaagtctccactccagcctctgatggaccgtgggccaagtctccactccagcctctgatggatggtgggccaagcctccactccagtctctgatggacggtgggccaagtctccactccagcctctgatggacagtgggccaagtctccactccagcctctgatggacggtgggccaagcctccactccagcctctgatggacggtgggccaagcctccattccagcctctgatggacggtgggccaagtctccactccagcctctgatggatggtgggccaagcctccactccagcctctgatggacggtgggccaagcctccactccagcctctgattgaccgtgggccaagcctccactccaacctctgatggacggtgggccaagcctccactccagcctctgatggacggtgggccaagtctccactccagcctctgatggacggtgggccaagcctccactccagcctctgatggacggtgggccaagtctccactccagcctctgatggacggtgggccaagcctccactccagcctctgatggacggtgggccaagcctccattccagcctctgatggacggtgggccaagtctccactccagcctctgattgaccgtgggccaagcctccactccagcctctgatggacggtgggccaagtctccactccagcctctgatggacggtgggccaagcctccactccagcctctgatggacggtgggccaagcctccattccagcctctgattgaccgtgggccaagcctccactccaacctctgatggacggtgggccaagcctccattccagcctctgatggacggtgggccaagtctccactccagcctctgatggatggtgggccaagcctccactccagcctctgatggacggtgggccaagtctccactccagcctctgatggacggtgggccaagcctccactccagcctctgatggacggtgggccaagcctccattccagcctctgatggacggtgggccaagcctccattccagcctctgatggacggtgggccacgcctccactccaacctctgattgaccgtgggccaagcctccactccagcctctgatggacggtgggccaagcctccattccagcctctgatggacggtgggccaagcctccactccaacctctgattgaccgtgggccaagcctccactccagcctctgatggacggtgggccaagtctccactccagcctctgatggatggtgggccaagcctccactccagcctctgacggacggtgggccaagtctccacgtcagcctctgactggtcgcaggtcagtccttcacggggtgtagccaatgggaggcctgtcaaagacaccgaggggtattgccgggttccttttaataaaaaccctaattgaggaagctcttgggcctcttgctggagccccgctcccagtctgtgaattgtcttcaataaacctgtgctttccttactccgtttttttgtgtttttgtctttcgttgctttgttcttttgttactttgtgcgtttcattcaattctctgttcaacacgcctagaacgtggacaactccatccggtaacagctccacgtacaatttttctcctttgcggcggtgctttcagctgtgcacattgctgaggaggatccacaccgccattctgattgtcactttcagttcagtattcaataaactacaggagagagtcaacactttattataaaataggttttctgttggacgattttgcccaactgtaggggaaggtacgtgttcagggcgggtttagggtaggctaggctaaactctgatgttttgtaggtgacataatattaaatgcattttttatcttctatattttcaatttatcaggatgtgacttcgctgtacgttgaagagcatccacactgtatcgcatacttgaaatttgctgagaagatcgattatgggccggggcgcggtggctcatgcctgtaattccattaatttgggaagctgagacgggcggatcgcttgagctcaggagtttgagaccagcctgggcaacatggcgaaaccccgtctctacaaataatataaaaattagccgggcatgggtggcgcctgtattcccagctgcttgggaggaagaggcagtaggatcatttgagcccgggaggtggaggttgcagtgacctgagattgtgccactgtgctccagcctgggtggcagagtgaggttctgtctcaaaaataaaaaaaatttaaaaaatgatagatcataagtgtttcaccacagacacacggacacacacacatacacacatacgcacacatacacacacacgtcaaagaaacaaaaagcaagccaggagtcgtggcatatgtgtctagtcccctagacacacacagagacacacccggacacacggaaacacatacgaacacacacccacacacagacacacacatggacatacacacatacgcacacatacacacacacacgtcaaagaaacaaaaagcaagccaggggttgtggcatatgctcttagtccccactactggggaggctgaggcaggaggattacttgaggccaggaattaagcaaataaataatgaaatgaaaatagtcactatgtgagttgacgaatacattaattagcttgattgtagtataattacaccatgaatagggatatgtaaacaccagcatggtgaccttagtcaccaaggacaggtagaggccaggaattggagagcagcctgggcaacacagtgatacccccatctttacaaaaaaatcttttaaaattagccaagtgtggtggtgcttgcctgtaattccagatactcactcaggaggctggagcaggaggctctcttgagcccaggggttcaaggctgcagtgagctatgagttttccattgcacccagccaaggtgagtgagaccttggctctaaaaataaatcaatcaataaacaaatttatccacacaggtaggagatctctacaagaaaaactataaaatactgatgagaggaaatgaagagggcacacaaatggaaagatagtccatgttcataaatcggaagaattcacattgtgaaaatgaccacactattaatagagatctatagatccaactcaatccctaccaaaatgccaaggacattccttatgagaacatgacatgtttcaagaggagaggactggagggaattgggtaggtagatggtggttttaggcagattctagttcattccacttaataactccattctgaactgactcactatcaacgcctcaattcttaacaaggaaaaatatcacaaagtatgagaaaatgcatcaggaaataagtgtcagaactttttggcaaaatgaccttgtgtcgggcactttactgacataatcttatatcatcttccaaagaacatatcaggaaggtaataattccctggttctattcacagggagcttgaagttcacaaaattcagtggcttaagatttcccaaggatttaaaccagaatcagtgtaatattaataacccttcaatgtatgttaagtgttagatgagaaaatttactctgaattaaaaatgaatgagccacaatttgaatggatttgtgaatcagtcagcggatgctgcgaacttcccaaattgtaacctaatcatgtaatctaatcatgacactcagttttcattccacaatgactccatgatccacgcagtataattcacacctaacattaaggcttttcacgtttgagaggcctcagtcagggggctgagaaccagggaaccctgtaggaccctcagtgtatctataaaccaccctctcaccgtcctggagtgagtgcagagtggggaccatgtgcctttctctggttcccactgtttttacataagggtaggttggctgatatcaaaccagtgatttagactagttcaagcaaagcttttccatgtgaattccaagagtttgaaaaagaaaagtaaagaattatcactaatatttattgtatatcagcaatgactgtatttttcaatatactgacattaatatgtgaaaggctttgcttaaactgcattaaatcactggtttgatattaatccaacaactcttaacatgtcctttatttgttaggatattactgtctgtgtggcgcgaggggacccaaagtgattaaaacttgtggacctagggccaggtgtggtggctcacgcctgtaatctcagcactttgggaggccgaggtgggcagatcactaggtcaggagttcaagaccagcctggccaacatggtgaaaccccgtctctactaaaaatacaaaaattagccaggcgtggtggcgggcacctgtaatcccagctactcatgaggctgaggcaggagaatcgcttgaacccaggaggtggagcttgcagtgagccgagatcacgccactgaactctagcctgggggacagtgtgagactctgtctcaaaaaaaaccaaaagaagaaaaaaaaacccataaaaccaaacaaaaaaaaacttgtggatctatattttctgaggcctccaaatacttcagcaatatgacaaataattcagtagagtgggaaaacctatgttatttgcacagtaggcatgtttaatactttaacttcctgtgggcagggtttcattgggaaatgtaatcaactcggatcacctaaaatggattacgtggccctaaaccaatcatggggcagtgcaggaactggaaatggggcctggagtccttcgacttctccataaataggcgcagttcagctccaggccagttggagagtgcatcccagatgcgagaaagttggaggcataaggcgggaaggaggtaagtgtccagaggccatgtctgtggggtttaggagctggcatgcaggggggttagtttcagaaagatttgggtttattttctcatgcatttgcttggagaccttgtgaaagcatcgggtctcctttgcaccccgtgattaactctggcttgttatgaaacccttatgtaaactaggaataatattaactttctcatcatgggtaggttacattttagagacgggggtctcactcattgcccaggctggcttgaattcctggtctccagtcattggcgagacttcacttcaccatcagctgggacgacaggcacctacctgccaacaggcccggctacattttatttttttgtagagatggggtctcggtatgttgcacaggctggtcttgaactcctaggctcaagcaatcataccacctgggtcttccaaactgttggaattacaggcgtgagccaccttgccggccgcactccacttgttaaaaagcatcactggattttccctttccacagggtaaaatcagccattaatgaatgagcatcaacctactaggccaatgagaatgtgcactaagtgtccctacctgggggtcctgtgtgctatatactcccagaattgaatactaacccgcatacctgcctttattttttcccatgttccattgcttgctttaatgggaaaagaactgagagtgaatacacggtgatttctaggaacatgaaaccacttttttaagagacaggatctcactatgttgcccaggctgttatcaaactcctgggctcaagtgatcctcttgccttggcctgagcagcagcaggcgcccttgcagcaaagccacttttaattccagaattttaggctctcttttctctctcatatttgtatgcttttttcaaaaaaaattaatttgctttcaaattgaaaactaaaaattgtatacaattgggcacagcataatgtgctttgtaggatgtgaacgctgtaaaatggctaaattaagctgctattcacatgccttactttatgtactaatcatttttggctgtgagaatacttgattgaaatctactcttttagcaatttccaagcatacattgttatgaactgaagtcaccatgttggacaacggctctcttgaattcatctctccaactgaaatttgtacccttagacctatatctccccaacccccatcccagccctggtaaccaccattctactcactgctactatgagtccactaggcttttaaaattattattcatgtcatctacttcttttttaattttttaaatgattttaacttgtattttagattcgctgggtgcctgtgcagatttgttacatgagtgtattgagtgatgctgagatttggggtatgactcaacccgtcacccaggatgtgaggagcacccgataggtagtttttcaaccctccctccctctatccctccagagtttcactgttttggagtccacgtcctgatttcctttcctctgtgtacctgccccggagcgggattgccggatcatgcagttgttggactttcaattttctgaggagcttctatactgtctcccatatcggctgctctaatttacatcccagcacggggcgcagaggacccctttcccccgaatcctcaccaacactcgttccatgtgtctttttgggaacagccactctagcaggcgtgaggggtgccttgtggtttggatttgcatgtccctgatgatgagtgatgacgagcaccttttcctagacctgctggccattcacatgtcttcatctgaggtgtccacagaggcaccttgcccacttctagcgggttatgtgttttcttgctctggagtagtttgagttgcttatgttttgcacaggaactgcttgtgagatgtgtggtgtgtaaatattgtctcctctgggttgtcttccccctctgctgattgtctccctggctgtctctgtgttctgtacttgctcagattccttccaggaagcgtaggttttccatccttcaggattccagtgacctttcccgagaccctcctgtcaattctttcttccttctgaagacctttcggttgcttcccccacctgtggctaggaagacagggctgcgttctcacagctgttgaacttggataataactgatgcctggagagtatcacacagtgtgtcctgcctaatgaaactacatttagaaccaaatttcaaaaaatcgttctttctttctctcttttttttttgagacggagtctcgctcttgttgcccaggctggagtgcaatggcgtgatgtcggctcactacaacttccacctccctgattcaagtgattctcctgcctcagactgccaagtagctaggattacaggcacgtgccaccatgcccggctaatttttgtattttgagtagagacgaagtttcaccatcttggtcaggctggtctcgaactcctgacctcaagtgatcctcccgtcttggcctcccaaagtgttgggactacaggcatgagccaccacacctggcctcaaaaaatctatcgtattatttcacttcctgaaaatttcatagagcactagactttaaatccattttctgagatgagattaggaatagagaaacccttagagacagaaggtagatcagtgattggcaggggctggggtgggtgggcagagggtgatcattgatggggatggggttccttttgggctgatgagacaattctggagctagacagtggtgatggttgcacagcatggtgcatgcatgtcttagtgccatgaaattgtgcacttcaagatggtaaaaatgatgaaatttatgaatgtgcattttaccaaaatagcaatatctgtgtaggagttgaattctcatgattacttaatgctctcccttccctggagcaaacaaatgtcctggggttaacaagaaaaggtgttgggggacaactgtaggttgtaactatttttctctatctttgtgcgtaattatgatgaagggctttaccttggatcttgtctggacaggaaaacataaataagttattgttgcatcagattttaggagcttcacataagtatcctatttaatttacagttgggaaccatgttgttccaattgaaaaaaaaactgatttcacttctgcacaatgatttcctggagatcagaatccaggggagcattaggattttaaatcagaacatatagtcaggtgtagacagcggaagagtaacagggtgggttgatttccactgtgctgaattcgatgctgctgaagaagtggcgtccaggatttggatgagggttttggaagggatgggtggatagactagaaactttgatcgggctcatgtttttttttgcagacttctgaacagtgaatctattattgaggaaaaccaaaggaggcctgtctagataggtctcaattagacaccagctactggaagaactttctcagagactgactgaaatattctccaccagatatggctgcaaattgcaactcctcatggggtcagggaggaccctgcaacagccctgagtcagagccgccacagtctgtggcttccccagaaactcaacttggaaatcatgactgggaccctgagacttgtcacgtgaacttcaggatgttcagctgcccagaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcaaggtgaacggtgtgcagagctgcaaagacctggaggacctgctacgaaataacagaagacccaagaaatgggtgagtgggaccctcgtgactggtgcagggaaggggagctgggatgggggctgcacggtgcagctggactcgagaggacccgaggggctgctctaggtcagggcttccaagtagaggagagtttgcccatcagggacacatggcagtgtctggggacagtttttgttgtcacaagggggaggacaggagacgctgctaagcattctctaatgctcaggacaacccaccatgacaaataatcttccagattccaatatcagctgtgctgagacggcaagttcctggtgtaggagatggacaggcagagggggtacagggacccacacactgtgtgaggccaacatgaaagaaagacattggtgaaatattaggtctgatggaatgtagggaaggaggcattagagtgaactgaagcggggcccaggagtcccatcctgaagcagggaaagtggttggtatcagatgcagggatctgcctccaggtccccaaatgagcccctaagttctaatacaaggtgagctgccatcggccaattgagttggattcacccagaatatttctccttgtcttctctttggtttagagaccctttcatctaaaggactcatatttatgtacttatgtagaaaaggaaaaaattcagacagattgctgtgtccacagagctgattctgcattgggaaggcagatttgaacattacagtaaagtgtgagcattatggcaggacccagggaatatgagagctactttcaggttctcatagtgagtctgattgtcttttttctctctacagtctgtggtcaattttcttggcaaggaatatcttatgcaggaatcagatgtcgagatggctgaaatccctgccagtgtcagagatgatccgagaggcgtgtccagccagcgggcctcctctgtgaatgagatgcgtccgggggaaggccaggccagccaagagctgcagaccctgcccagggtccctgcactgtccagaaggcaggtgagtgtgtgaggccctggtgtctgggcagaggtgggagaaggaacaggagaaaactgagtgtgcctctggactgattgagagatttggcacaggacaagaacagagacattccccatgga

SEQ ID NO: 906 - DNA, 9031 bp, Homo sapiens
ttcaccccagactttcttttgatacactaagtaaacaaaacagattttttttttttgccataaatatcagcagacacttcctggcaccccacactgtatcagcatgtgtgttaacagtcccagttcagatgtgcagtgtttcaagtggatgcactgtaacaaggatgcaaatgcggagccaccctcagaataacattcagtcatggggttgcccttccaagctggcagaaaaggaacccgggccaggcaccgtgagcacgcacagtaactcacgcctgtaatcccagcactctggaaggctgaggcaggaggatttcttgagaccaggaatttgagaccagcctgggcaacatagtgagacccaactctacaaataagagattgtgtgtccggaggctgaactcacaaagatttcagaatgtcagtaggagaggaggtgtgtgggatagcagccaattcgtcagtgaatgaggcagagaaattggtaaaaagaaggaaagtgaaaacaagaagcatgttcccattttcaaggtcttcctggttcacaaagtgggaaggaagaaactactgaagaggaaagagttctcttgaagagtacagaattcctgggctccccggttcaggtcataaaaagaaaagagaaaacgtttgcagccatgcagggtgaacaagctctgaagatatattatacggactaggggttgtaatcaatgttagggaccatcccctacttctgagggctctgaggcaggagaatagggtgagggaagagagagaccctctcatattgttttatattgttttatactcaatacctgttttaaaaaaaaaacaacaaggaagtaaaaccaaagacaggcagcccggcgccaggcccgaaaccaggcctgggcctgcctggcctaaacccagtagttaaaaatcaactgataacttaaaaaccgatgttattcatagattccagacattgtatagaacaacattgtgaaactccctgccctgttctgtttctctctgaccaccggtgcatgcagcccctgtcacgtaccccttgcttgctcaaatcaatcacgaccctttcatgtgaaatccttagagttgtgagcccttaaaagggacaggaattgctcactcgtggagctcggatttcaaggcagtagcttgccaatgctcccagctgaataaagcccttccttctacaactcggtgtctgagaggtttcgtctgtggctcgtcctactacaagggaattagggtaaccaggggttaaggtagaagcaaaagaaccgcacttgcagccagttctaggcaagattaggcagcacacaggccacatcctcactcctgtgataacgagacagaagcctccactccagcctctgattgaccgtgggccaagcctccactccaacctctgatggacggtgggccaagcctccactccaacctctgatggacggtgggccaagcctccactccagcctctgattgaccgtgggccaagtctccactccagcctctgatggacggtgggccaagtctccactccagcctctgatggaccgtgggccaagtctccactccagcctctgatggatggtgggccaagcctccactccagcctctgatggaccgtgggccaagtctccactccagcctctgatggacggtgggccaagtctccactccagcctctgatggaccgtgggccaagtctccactccagcctctgatggatggtgggccaagcctccactccagcctctgatggacggtgggccaagcctccactccagcctctgatggacggtgggccaagtctccactccagcctctgatggacggtgggccaagcctccactccagcctctgattgaccgtgggccaagtctccactccagcctctgatggacggtgggccaagcctccactccagcctctgattgaccgtgggccaagtctccactccagcctctgatggacggtgggccaagtctccactccagcctctgatggaccgtgggccaagtctccactccagcctctgatggatggtgggccaagcctccactccagtctctgatggacggtgggccaagtctccactccagcctctgatggacagtgggccaagtctccactccagcctctgatggacggtgggccaagcctccactccagcctctgatggacggtgggccaagcctccattccagcctctgatggacggtgggccaagtctccactccagcctctgatggatggtgggccaagcctccactccagcctctgatggacggtgggccaagcctccactccagcctctgattgaccgtgggccaagcctccactccaacctctgatggacggtgggccaagcctccactccagcctctgatggacggtgggccaagtctccactccagcctctgatggacggtgggccaagcctccactccagcctctgatggacggtgggccaagtctccactccagcctctgatggacggtgggccaagcctccactccagcctctgatggacggtgggccaagcctccattccagcctctgatggacggtgggccaagtctccactccagcctctgattgaccgtgggccaagcctccactccagcctctgatggacggtgggccaagtctccactccagcctctgatggacggtgggccaagcctccactccagcctctgatggacggtgggccaagcctccattccagcctctgattgaccgtgggccaagcctccactccaacctctgatggacggtgggccaagcctccattccagcctctgatggacggtgggccaagtctccactccagcctctgatggatggtgggccaagcctccactccagcctctgatggacggtgggccaagtctccactccagcctctgatggacggtgggccaagcctccactccagcctctgatggacggtgggccaagcctccattccagcctctgatggacggtgggccaagcctccattccagcctctgatggacggtgggccacgcctccactccaacctctgattgaccgtgggccaagcctccactccagcctctgatggacggtgggccaagcctccattccagcctctgatggacggtgggccaagcctccactccaacctctgattgaccgtgggccaagcctccactccagcctctgatggacggtgggccaagtctccactccagcctctgatggatggtgggccaagcctccactccagcctctgacggacggtgggccaagtctccacgtcagcctctgactggtcgcaggtcagtccttcacggggtgtagccaatgggaggcctgtcaaagacaccgaggggtattgccgggttccttttaataaaaaccctaattgaggaagctcttgggcctcttgctggagccccgctcccagtctgtgaattgtcttcaataaacctgtgctttccttactccgtttttttgtgtttttgtctttcgttgctttgttcttttgttactttgtgcgtttcattcaattctctgttcaacacgcctagaacgtggacaactccatccggtaacagctccacgtacaatttttctcctttgcggcggtgctttcagctgtgcacattgctgaggaggatccacaccgccattctgattgtcactttcagttcagtattcaataaactacaggagagagtcaacactttattataaaataggttttctgttggacgattttgcccaactgtaggggaaggtacgtgttcagggcgggtttagggtaggctaggctaaactctgatgttttgtaggtgacataatattaaatgcattttttatcttctatattttcaatttatcaggatgtgacttcgctgtacgttgaagagcatccacactgtatcgcatacttgaaatttgctgagaagatcgattatgggccggggcgcggtggctcatgcctgtaattccattaatttgggaagctgagacgggcggatcgcttgagctcaggagtttgagaccagcctgggcaacatggcgaaaccccgtctctacaaataatataaaaattagccgggcatgggtggcgcctgtattcccagctgcttgggaggaagaggcagtaggatcatttgagcccgggaggtggaggttgcagtgacctgagattgtgccactgtgctccagcctgggtggcagagtgaggttctgtctcaaaaataaaaaaaatttaaaaaatgatagatcataagtgtttcaccacagacacacggacacacacacatacacacatacgcacacatacacacacacgtcaaagaaacaaaaagcaagccaggagtcgtggcatatgtgtctagtcccctagacacacacagagacacacccggacacacggaaacacatacgaacacacacccacacacagacacacacatggacatacacacatacgcacacatacacacacacacgtcaaagaaacaaaaagcaagccaggggttgtggcatatgctcttagtccccactactggggaggctgaggcaggaggattacttgaggccaggaattaagcaaataaataatgaaatgaaaatagtcactatgtgagttgacgaatacattaattagcttgattgtagtataattacaccatgaatagggatatgtaaacaccagcatggtgaccttagtcaccaaggacaggtagaggccaggaattggagagcagcctgggcaacacagtgatacccccatctttacaaaaaaatcttttaaaattagccaagtgtggtggtgcttgcctgtaattccagatactcactcaggaggctggagcaggaggctctcttgagcccaggggttcaaggctgcagtgagctatgagttttccattgcacccagccaaggtgagtgagaccttggctctaaaaataaatcaatcaataaacaaatttatccacacaggtaggagatctctacaagaaaaactataaaatactgatgagaggaaatgaagagggcacacaaatggaaagatagtccatgttcataaatcggaagaattcacattgtgaaaatgaccacactattaatagagatctatagatccaactcaatccctaccaaaatgccaaggacattccttatgagaacatgacatgtttcaagaggagaggactggagggaattgggtaggtagatggtggttttaggcagattctagttcattccacttaataactccattctgaactgactcactatcaacgcctcaattcttaacaaggaaaaatatcacaaagtatgagaaaatgcatcaggaaataagtgtcagaactttttggcaaaatgaccttgtgtcgggcactttactgacataatcttatatcatcttccaaagaacatatcaggaaggtaataattccctggttctattcacagggagcttgaagttcacaaaattcagtggcttaagatttcccaaggatttaaaccagaatcagtgtaatattaataacccttcaatgtatgttaagtgttagatgagaaaatttactctgaattaaaaatgaatgagccacaatttgaatggatttgtgaatcagtcagcggatgctgcgaacttcccaaattgtaacctaatcatgtaatctaatcatgacactcagttttcattccacaatgactccatgatccacgcagtataattcacacctaacattaaggcttttcacgtttgagaggcctcagtcagggggctgagaaccagggaaccctgtaggaccctcagtgtatctataaaccaccctctcaccgtcctggagtgagtgcagagtggggaccatgtgcctttctctggttcccactgtttttacataagggtaggttggctgatatcaaaccagtgatttagactagttcaagcaaagcttttccatgtgaattccaagagtttgaaaaagaaaagtaaagaattatcactaatatttattgtatatcagcaatgactgtatttttcaatatactgacattaatatgtgaaaggctttgcttaaactgcattaaatcactggtttgatattaatccaacaactcttaacatgtcctttatttgttaggatattactgtctgtgtggcgcgaggggacccaaagtgattaaaacttgtggacctagggccaggtgtggtggctcacgcctgtaatctcagcactttgggaggccgaggtgggcagatcactaggtcaggagttcaagaccagcctggccaacatggtgaaaccccgtctctactaaaaatacaaaaattagccaggcgtggtggcgggcacctgtaatcccagctactcatgaggctgaggcaggagaatcgcttgaacccaggaggtggagcttgcagtgagccgagatcacgccactgaactctagcctgggggacagtgtgagactctgtctcaaaaaaaaccaaaagaagaaaaaaaaacccataaaaccaaacaaaaaaaaacttgtggatctatattttctgaggcctccaaatacttcagcaatatgacaaataattcagtagagtgggaaaacctatgttatttgcacagtaggcatgtttaatactttaacttcctgtgggcagggtttcattgggaaatgtaatcaactcggatcacctaaaatggattacgtggccctaaaccaatcatggggcagtgcaggaactggaaatggggcctggagtccttcgacttctccataaataggcgcagttcagctccaggccagttggagagtgcatcccagatgcgagaaagttggaggcataaggcgggaaggaggtaagtgtccagaggccatgtctgtggggtttaggagctggcatgcaggggggttagtttcagaaagatttgggtttattttctcatgcatttgcttggagaccttgtgaaagcatcgggtctcctttgcaccccgtgattaactctggcttgttatgaaacccttatgtaaactaggaataatattaactttctcatcatgggtaggttacattttagagacgggggtctcactcattgcccaggctggcttgaattcctggtctccagtcattggcgagacttcacttcaccatcagctgggacgacaggcacctacctgccaacaggcccggctacattttatttttttgtagagatggggtctcggtatgttgcacaggctggtcttgaactcctaggctcaagcaatcataccacctgggtcttccaaactgttggaattacaggcgtgagccaccttgccggccgcactccacttgttaaaaagcatcactggattttccctttccacagggtaaaatcagccattaatgaatgagcatcaacctactaggccaatgagaatgtgcactaagtgtccctacctgggggtcctgtgtgctatatactcccagaattgaatactaacccgcatacctgcctttattttttcccatgttccattgcttgctttaatgggaaaagaactgagagtgaatacacggtgatttctaggaacatgaaaccacttttttaagagacaggatctcactatgttgcccaggctgttatcaaactcctgggctcaagtgatcctcttgccttggcctgagcagcagcaggcgcccttgcagcaaagccacttttaattccagaattttaggctctcttttctctctcatatttgtatgcttttttcaaaaaaaattaatttgctttcaaattgaaaactaaaaattgtatacaattgggcacagcataatgtgctttgtaggatgtgaacgctgtaaaatggctaaattaagctgctattcacatgccttactttatgtactaatcatttttggctgtgagaatacttgattgaaatctactcttttagcaatttccaagcatacattgttatgaactgaagtcaccatgttggacaacggctctcttgaattcatctctccaactgaaatttgtacccttagacctatatctccccaacccccatcccagccctggtaaccaccattctactcactgctactatgagtccactaggcttttaaaattattattcatgtcatctacttcttttttaattttttaaatgattttaacttgtattttagattcgctgggtgcctgtgcagatttgttacatgagtgtattgagtgatgctgagatttggggtatgactcaacccgtcacccaggatgtgaggagcacccgataggtagtttttcaaccctccctccctctatccctccagagtttcactgttttggagtccacgtcctgatttcctttcctctgtgtacctgccccggagcgggattgccggatcatgcagttgttggactttcaattttctgaggagcttctatactgtctcccatatcggctgctctaatttacatcccagcacggggcgcagaggacccctttcccccgaatcctcaccaacactcgttccatgtgtctttttgggaacagccactctagcaggcgtgaggggtgccttgtggtttggatttgcatgtccctgatgatgagtgatgacgagcaccttttcctagacctgctggccattcacatgtcttcatctgaggtgtccacagaggcaccttgcccacttctagcgggttatgtgttttcttgctctggagtagtttgagttgcttatgttttgcacaggaactgcttgtgagatgtgtggtgtgtaaatattgtctcctctgggttgtcttccccctctgctgattgtctccctggctgtctctgtgttctgtacttgctcagattccttccaggaagcgtaggttttccatccttcaggattccagtgacctttcccgagaccctcctgtcaattctttcttccttctgaagacctttcggttgcttcccccacctgtggctaggaagacagggctgcgttctcacagctgttgaacttggataataactgatgcctg

SEQ ID NO: 907 - DNA, 45557 bp, Homo sapiens
caacatgggcctaactataaagaaaaaagaattctgaaggatacctagggaggaaggtttctcagaggaatgggaatccattgacaaattttaaagaatggagcagcacaattgggtttacctaatttaaagctcaacatgcctgtcaagtgataatggattggagggtgctgggtaagagaggatatgggagcaatcaagattctcttatggttttctgggagagaaaaaggagaactgatggattcaggtgcacctacccaaacctggcttgagcaggtgagaggctgtaacaacgcaaaggttggggccgcccaggagaaaaaggattacaccacccaaaattgagtttgaatgttaagactgaggacacacacatacccacactccaagagggtatgaagcttattacataacaggatttctgaagagagcagagtgggctttcccaagctggtctgaatgtggcttgagagggcagagaaaggaggctggtttggggttggggttttatggtgcttaggggatgggccacagccaggggtactgcacagggtttgaactccccactggcactagaagagggagtacccaggttttctaatcagcttgtccagctgtggggtgataagaaacaaacatcaaacatggtcaaacttttaataatcccaaggaaagagcaagtcaaaagtggaggtatgaacctcaacgtctgggtgaggcctctggttgggcaagggtgggaccatggtcaccaggggaaataggaggcagccttctggggtccaggggccaaggctggtggctggagtatggagaggcctgtggtaaggcagccacaggcaggagctggggtcgtgaacacgccagggggccccattcacgtggggctgacaaggccataacaggagcaagaagaaagacaagatggcggcgcagtggcgcctcttcctcctgggatatccctcccaccccctctagtggcagagcctagcactgcgctccctgcaaagttgccaggacagctccgtgattgcagggccggcactgaacctgtggacttagaagctgggaggcaattgactggtaactgacacagaagccctgttcctttcccttgcagaggtgtgagcctataggttcagttactctggaggctgaggtgggaggatcacctgagcctgggaattttgagctgtgattgtgccactgcactccagcttgggtgacagagcaagaggctgtctcaaaaaaaaaaaaaaaaaaagtcctctggatggtcagaagagcaacagaaggtgggcagggaggaggggtggagggggagagaaaaaaagatggagagagaaatttgtggaccccaagaatatagctcacctagaaaggttggaacacctgaaatggaagtagtggcttgtccgcaggatcatagaacttgtaaaagaatcccgtgcaccaaataaagcacgcaaataacaggaaaatgccagaaagctgaacacctgggtggcagtctgtgcaccccagtgaagggacgtgaacaagtggctcccatcggtgtgctggcaagacacacactggctggaggtgagggttgtgatattaaggactgaggtgaacagttttgaacgttgggatgtcaacagaatgaggacgcgtggggagacgttatccggtgttacagacactaaatacatttttttttcttacaataagaagttgaagatctgagtggatgagaactggagaaagtagggatgcagtgtctcttcgtcaattcaggttttgcacggggtaaggtggctgtgtctaagccggtgccactagcatcatacgcacccagcttatgttaaaaatttaaagttagaatgattttatagctaatttgtatagttatgacagatgtccagcagatggcagaaaagatcttgttctaacagataacagctagatggttctgcttctgtttgacattaaacataaccaaagcgtcaaacaacagaaaaggttatctaactgatataccagtgaatgagcatctttttttttttttttaaataagtcttcctcttctgttagtgtgaggctaaatttggtggttcatatgatggttcactcgatctgacatttttttcttgtactctactagaatgtatatttaaattttataatgaaatattttattattatacaaatcattgttgttggtcccaaagtattacataaactttggttgctatatataattacattctaattagtgtatagactattttatttattatacaatttcaggaggagaccaatgttttcatcatcttacctattagttgtaacaaattctaggataaactgctaacattattatattattttttctggtgtcaaatgaggtctttgtagcatgtgtcacaatgtcctccctttggaaaggggaataatattccattgtacagatggaccatattttgtttatctattccttcagtgaacgcttgggtagctcctacttctgagctattgtgaataacgttgcaatgaacataggagtatgagttcctgcttccaattttttaggtacataagcagaagtggcattcctggattatatcgtaattctatgtttaatttttggggggggctgccatgctgttttccttgtgtattaacagtataccagggttcccatttctccacatccttggcaaaatttgttattttctgttttttgatagcagtggtgtggttttgatttacatttccctaattattagtgaggtggagtgccttttcttgtgtctgttggccatttgtagaccttctttggagaaatgtctaagttctttgcccattttaaaatcatgttgttagtgttttgttgttgagttagcgttctttatatactctggagatgaaccccttttcagatatgtaatgtgcgaatatggtatccccctattccattggttgctttcactctgttgattgtgacctttgatgcaaaaactgtgagttttaaaatatatattttaaaatatatattttcttattacaattttatttaggaataagtgaggtacagtaaatggcacgttatcagtttatgatttgtcgtgttctgacattttcacaggctttctgcatttttaaagctgctcccattggaaacaggaaaggaacttccattttagttaggaaagcttttgaataatatttagatagtccaaaaaatacacaaagtgatatataacctacaattccaagaacgtcaatattgagcaaagcgtggacaatagccggctgagcgcacaaggtggggagtggggagggaagctatggatttgcctgtggtagggaagactttgcccagtcagccacagagaattagaaagtctgccgcccgctgctgcccacgagcaaacagaaaaacaaaaaacccaacctgcctcagtgctcacaggccgactctgtgccgtagcccagtgcaactctccacctgccatctcactgtttcactccctctaacgggtccacgttgattaattcccaaacccctcttgcctgtgacccaacgtggtttttccctttggctttttttttttctccctcaaagaagctgtttttcttgccagccctgagatgggttgaataaactgatcataattacacagcctacctggacggatgaaaaacatggtgtcgtctattctcagggtccctaggagggttgttagggtggttttaatgagtcccaaagcacctggctctatttctgcccgttgagctgctaaactggcatcaaaaagttaactctgaggaggcagaaaacatgatttgttaactgctggcctcaagggtgacttgatttatttcagggcttatttaaaaaacagtaattattgcctgtttccaatcctgaagataacatacatgcatgtagtgaatacatttggaaattgtattcccatgaaacttttaatgagatatttgaatagaacttgttaagtagctggtaaagttcagaagagaaaatgcacacacactaaaaaactagaaacacaataaaaagaaagaacagtcaggaggaaatgctttaaaatacagaaaaaaggataatggagaatatatgtcatccataatcccaccataaagagaggattttaaattttttgttgttttgtttgtttgtttgagacagggtcttactctgttgcccaggctggagtgcagtggtgcgatcatagctcactgcagccttgacctcctgggctcaagcaatcctccctcctcggcctcctgagtagctgggattatgggtgcacaccaccacacccggctaatcttttgtggtttttgtagagacagagttctgtcatgttgcccaggttggtcttgaactcctgagctcaagtgatcctcccaccttagcctcccaaccaaagtgctgggattacagagtaagccactgtgctcagcctgtatttttaatatgtagtgcatgtccttacatttttcaggtgtgtgcgtgtatacatatatacatacatgcattatatatattgtatatacacatatccacagacacgtattttaagatgcagaaaaacgggggagacactgaggagatttaaacatgggtgtggcatgattcaaatttcatatcattctggcagttagtgtggagacagatataggggcagcccctggtggcagggaccagtgggcaggtcacccagggcttgatccctgacatccagtcgtgtgacgattgtgtcctgagttcagggaagggctgttgatgaagcagaagaaatgtttgagaagcactggaaaaatccggagccacctgttttgcgatggattatctgttgcagatagtggtgaaaaaaaaaagcaaacaggtggttctgggatccccccgaaagggaaacccaagatgaggagctggtgggaaggggaaattaaatgctcatttaacttaacatgtgggatgtccagaggtgtatttgccatcaggggaatacctgcgtaagggctctggaatagacacctgacttggctatcatttctagcggggttagatagcccctcaaaagacagagtgtggagagaagagccacatgtcaggcttaggtccaagaggggcgagtttgcagaaggagtgatggcaggagagcggggaaccaggggcatcccaagtttggacagaagcaatgtgaatggacacgaaaggagagattcgagtgagatttacacgttagaatccctggaaccaggtgactgatcagggctgggagaacaaagggaggcaggtggagatgaacccaagggctgatctccacgttcccaacagatgtcacgggaggatacagaacacttgtccctgggatatggactgcagtgtccctgcagtactaaacagaccattggtatgtgggagcgagatgcccaccattgttacctggctgaagagctggtcccctttcacacctggctcctgcctcccaccactgcccatcttcttagacacaggcgccgggggactctgcaagcctttcacacctggctcctacctcctaccactgcccatcttcttagacacaggcgctgggggactctggaagcctttcacacctggctcctgcctcccaccactgcccatcttcttagacacaggcgccgggggactctgcaagcctttcacacctggctcctgcctcctaccactgcccatcttcttagacacaggcgccaggggactctgcaagcctttcacacctggctcctgcctcccaccactgcccatcttcttagacacaggcgccgggagactctgcaagcctttcacacctggctcctgcctcccaccactgcccgatcttcttagacacaggcgccgggagactctgcaagcctttcacacctggctcctgcctcccaccactgcccgatcttcttagacacaggcgccgggagactgcaagcctttcacacctggctcctgcctcccaccactgcccgatcttcttagacacaggcgccgggagactctgcaagcctttcacacctggctcctgcctcctaccactgcccatcttcttagacacaggtgctgggggattctgcaagcctttcgcaggttcccaggactcagctcccacccgcctcttggtgctataacagggtagtgagggggtgtggtttcagcacaaccaagcttatctcttctgtgagccttttctgggccaccaatagagtcttccataaatactgagcactgactacgtatcaggtctcgtgtgggcacaagggacactgagaggaaatggagtccttgtccttgaaggtctcaccttccagtgtgggggtgacggacacgccttccagtgtgggggtgacggacacgccttccagtgtgggtgttgacagacacaccttccagtgtggggggtgacagagacgccttccagtgtgggggtgacggacacaccttccagtgtgggggggtgacagacacaccttccagtgtggggagtgacagacacactttccagtgtagggggtgacagacacgccttccagtgtggggggtgaccgacacgccttccggtgtagggggtaacagacacacaaacacacttgctgtggtttttgaagatgatcacaacactctcccatctgatctgttcaaatgtgtcaggtcctcatcaagaggtggagttggatttccatccccttgcatctgggcagggctgtgacttgcttgtctccaacagaaagtggcagaagggacattgcgtgactcctgaggctaggtcagaaaagacgacacaacctcccccttaagtgcacgaaggcctcagttcccctcagctgtcccattgtccagaggctgccatgttgtgagggagccccacctagcccacgacacacggagaggacctgagacagcatgagaagagagagctggtgggtgggccccagctgtttcagtcacctggagatccagctctagtcagcacagaagagaccctgagcctaaccacccagctgagcccaccaccgatttcctgacccacagagatactaaaagcactgttgttctgagtcactgagttttggggtgatgtgttatacagctacagataactggaacagcattgtgtcttcccaccctgtacttattttattaattttttttttaaaatagagatgaggtcttaccatgttgcccaggctggtctgagcaacatggtagaaccatgaacttctgagctcaagcaatccaccagcctcggactcccaaagtgctgggattacagatgtgagctaccgcgcctggctgcaccctgtaattctgatcttaccctcttcttacctggaccctcgtacgatttccctgggatctcagtctctagaattcaatcagccttttctttgggatttggttcctgttcatgcctctcgtttacccgttctgtcctctctgccccttttgtttattgagaggcacttgtgagatctatggaggtatgcttgtggcgtgtgtactaaaaattttagtggcagaaaattcatgtgtttgagtagctaaaaatggattttaagggagtttcatactcaggatttgtgtgcatgccaagcagcttatctgaaagtaaatgaaaaagttgaccgggcacggtggcccacgcctgtcatcccagcactttgggaggccaaggcaggtgaactgcttgagttcaggagtttaagattagcctgggcaatgtaacgaaaccccatctctacaaaaaatataaaaattagctgggcatggtggcacttgactgtggtcccagctactcagcaggctgaggtggaggctagtttaagccagggaagtcgaggctgcaaatgagctgtgatcgtgcccttgcacgccagcctgggtgacagagcgagaccttgttttaaaaaaataaaaattaaaaaattgttaaatgctataaaaaatgtttttaaaaagaaaaaagttaataaaaataacaatgaaacaatatcggcaaggagaacaccactaacttcaggtttgagcctctgctctcaactagcaaaacttttctaagctctgtaatatctaccaaccatggacatattagagaatattttgggaaatatatagattttgttttagtaattaaatatttttttacttttttttttttttttttggagacagtttcactcttgttgcccaggctggagtgcaatggtgcgatctcggctcactgcaacctccgcttccagggttcaagcaattctcctgccttagccttcctagtagctgggattacaggcatgtgccaccacgcccggctagttatgtatttttagtagagatggggtttctccatgttggtcaggctggtctcgaactctcgacctcaggtgatccgcccgcctcggcctcccaaagtgctgggattccaggcatgagccaccgcgcctgggcttttttttacatttttttaatttcttttttcttttttttccctctggtgttgaaactaatataattacatattttaatgtgcagtaaaatatcagtaggacaaaaatctgcaattttattgtatttaggtattgcttaggataaagctacagtgaccatctaagtaaacaagttaatatgtttgaggaaaatcaatcaataaaaagtaatactaaggatacacatggaattgacaaaaaactaggaggtggtactttcttgagagaagcttgggaagccctgagctagaagatatttttcttttaatttataaacatttggagagcactcttttttgtaaaaattacctcacttaaactccacaaccaactgcaagaaactgttacactcattttatagaaatggaaaatgtggctgggcgtggtggctcatgtctgtaatcccaacactttgggaggccgaggcgggtggatcatctgaggtcaggagttcaagaccagcctggccaacatggtgaaaccccatctctactaaaaatacaaaaattagccaggtgtggtggcaggcacctgtaatcccagctacttgggaggctgaggcaggagaatctcttgaacttgggaggcggaggttgcagtgagctgagattgtgccactgcactccagcctgggtgacagagcaagactctcaaaaaaaaaaaagaaaaaaataaaatgtagggagcttaagtgacagagacaggaattaagtccaaagcctggctgatggccaaattgatgttgtctacaggatatggtactgatctcccagtggtagctcaggggctgtgacattcctagaacaggcatctaatctgcctccattaatcatggaggacttcctgaaggaagtgacatctgagctgggactttcccttagctcagggacatctttctcccaagcatggcccccactggtgaatgaaacctaattttctttagagagaaccctgttatctgtccagtattccccagaagaggctggataaagcacagatagctgcctgacttgaaagtgtctttcaggactggatcagatccaggagcaaattgagagagagagggagagagagagggagacagagagagagaatcaaaatacaactgaaaagtgtattaggggagaaaaaggggagaaaaagagattatttcttcagactaatatcctgtttggaaacaccaaaaactgatattattgaaaatttcacatgtaaaataaagagcttaaataacaattcaagtctaaagtttggctatcacaatttttctttatttttgtttgtttattgaggtataacttacatatagtgaagtgtacaattcttaaggttacagtttaataaatttttacatatggatagacggatagattcacataactatgacccagataagaagacacaatatttccagtacctcagaagtctccctcttgcccctccaatctgtgcctacctacaggtaaccacttttctaactttttttttgagatggagtctcactctgttgcccaggctggagtgcaatctcagctctctgcaacctctgcctccctcccaggttcaagtgattctcctgactcagcgtcctgagtagctggggttacaggcgcctgccaccatgatcggctaatttttgtattttttagtagagacaaggtttcaccatgttggccaggttggtctggaactcctggcctcaagtgatccacccgcctcagcctcccaaagtgctaggattacaggcatgagccaccgtgcccggcccacttttctaacttctatcaccataaattaattttgactattttagagtttcataaaagttgtatgttacagtatgcagtctcgtttctaatttttttttttttgtttttttgtttttttgagacggagttttgctcctgttgcccaggctggcgtgcaatggcatgatcttggctcactgcaacctctgcctcctgggttcaagcaattctcctgcctcagcctcccagtatcccaagtaactggcattacaggcacccaccaccatgcccggctaatttttttgtgtctttagtagagacggggtttcaccatgttagccacactggtctcgaactcctgacctcaagtaatccacccaccacagcctcccaaaatgctgagattacaggcatgagccactgcgcccggccctgattttcattcaacattatattgataaaagtcatccatgtggttgtatgtatcgatagttcatcctttttattgctgtgcaatattccattgatttatttatccattccttgatttatttatccattctattgttgacggacacttggattatttccaacgtttatctatatgggtaattatgctgtaagtcgttttgcatatgtcttttggtagaaacaatacttttttaaaaacaaatttagtagattataaattccttagtgatgggtaaggtaggagtatgtattactgaacatagagacacttggtagagactcctcacatgcacatctgaatgatgccttgggactaggcagtgatcctttgcccttcttggggccaggcatacctccaatgacttggtaacagcttcaactcttcttccaagaagattgcccacatactcaacatttagcattgggcttctggaatgtggtgatatctaaggttcttccagctttggcctacatgagacggtgagctgggtgaagtgcattttaagggcaagcgctgagctccagcttatgaggaatagccctccaatgtgccaggaacatgttatgtgccctctggaacaaataatatttcacttttccgaaagccagagctttgggatcccagatctagtaagaatcatcttattcatcttcctttcatctccaagccagaaggaggctcgttgaatttacagggatggagttgcaaagggcattaaggaatcctgcatctatgctatcaggacctaccagtcccaagtggctttgatagataaaatgttctgagtgccttaacccagaaaaactgcaactctagaccctggatgttctaaacgacgcaatcagaacatcttcccatattctttggaagaaactctaacactttcctctttctacttctacctaaaacatctgaaagaagggaggcgagagaggagagaattatgcatttaaacaaagacaaggaattgcgaaaatcaccatttttaaagaagtatagatttcataagaacctctgagatgatgataatgcatgataataacatgtaataacaataattataatagtattatgcttctatgagccatataaatattatatgctatacatattgctaagtgttttacaaccttcacctcatttatttccccctaaaagtctatgattttatgtaagaggaaaatgaagctccaagaaaaactttttttttttttttgagatggaatctcgttctgtcacccatgctggagtgcaatggcatgatcttggctcactgcaacagcactatcttggctcactgcaacctccgcctcccaggttcaagcaactctcctgcctcagcctcctgagtagctgggattgcaggcacccgccacctcacccagcttaattttttgtatttttagtagagatggggtttcaccatgttggccaggctggtctcgaactcctgacctcaagtgatccacctgcctcaacctgccagtgttgggattacaggcatgagccagcacacccagcccaagaaagactttttggacactatctcagggtaagggagtagcaggattgggatttacacctggatctgactctcaagctcatgctcattccactacagaaaatgacctgtttgttcaggtcttcctattaactgagatcttccatcttccaggaatgatgcagtacattccaagaaagatgtgttatggaagtgacatcagatctgaatcctgaagtcaaagtttcatttagtagaaatcaaggtaagatgaggaagtgttgggagactggactatgaagtatgaagagtctgtatcagaggctggcaaactatagttgaccatttgtttttataaataaagttctattggaacatagctagctccccttgcttatgtattgtctctggtggctttctcactacagtggcaaagttgagtaattgcgacagggaccatatggctaacaaagacaaaaatagttactatcttgctcttgacagaaaaagttttcctactcttgatctaggtcacactaaagcttttagtcataaatgctatcctagggctgggcgcggtggctcatgcctgtaatcccagcactttgggaggccgaggcaggtggatcacttgaggtcaagagttcaaggccagcctggcagacatggtgaaaccccgtatctactacaaatacaaaaattagccaggtgtggtggcaggcgcctgtaatcccagctactcgggaggctgaggcaggagaactgcttgaacctgggaggcggaggttgcagtgagctgagatcacaccactgcactccagcccgggtgacagagtgagactccatctcaaaaataaataaataaattaaataaatgcttatcctgtatgtaatgttgagccatggaaggatttggagtaggggagacacatgggcttatttcagaattacaaaaaaaccattctcagatccatcctagcacagggcactcccatgataaaggcatcaacaacacaattccaaaccatcttcacttctcaatctttcaccttgaataccatttcaacaaatattaattgagcatctagtatgcacctatactctatgtaagtggttaaagctgtaagcaagcagtaaggcttgaaacttaaagctggtggaaagtaaactgaggaagtgagctttctctttgagagatccaatggaaggaagactatgtacagaaggacagcagccagaggttgccttagaacacaaacagagctgaacttcttgaatcaagcaggttttttgggttccagtggcagaaacggactttggctagcttaaaagagaaatcactggaaggaactggcaaaggggtggagttcaaaggattaaagtgaaggctggagagtgggtttgggaaagagtgaagcctgggaaaccaagagatttctgtatcatgagccactcaacactctcacctgaaaagcattaaatctgcttcttccactcttgctttactcaattcgagatttaaagtgccaggtaagcagtctgattagcctggcttaggacaaaggttggttggctttagtgtaaaaataaggatctggtgcaaggagctttgagggaccctgcttgcttttcattatgagaaaatgggcacgtgcattaactatcccaccaggaccacatacagtggagcagaggtaattcttccaaaggaaatcagggtatagagacttagcagctaaacaagttcacaaatgtcaatcatacctgtatagattcaaatcctacctcttccaattattggctttgttgactttgggcaaagttatctcatttgcaaagagaaattataatactacccagctcttaaaattatgagctaatagatatgaagtgcttagaaccacgtctggcacatcataatcacccaattaagcttaactgctgagagtattatgattattactgcatgcttgctaaaaatagcaccaagtgatagagcccacggtgagatctaggccctcattccaaagctcccgctctttctgccaagccaagctgcctttgcagatccaacctcagttaaatgagatgataatgtgtgtgaagttgttggggcaggtgcccaaagaggatgctcaattactgtccaagactttcttcctctctccccaaagaagtgagtaggcttaggctttgctttctgcttgggagatgcccccacttttttttttttttttttttttgagatggagtctcactctgtcactgaggctggagagcagtggcgcgatctcggtgcctggttcaagcaattcttctgcctcagcctcccgagtagctaggactacaggcacctgccaccatgcccggctaattttttgtaattttagtagagacggggtttcaccatgttacccaggatggtctcgatctcctgacctcgtgatccacctgccttggcctcccaaagtgctgggattacaggcgtgagccacggtgcctggccggagatgcccatatttaatagagaaccaagtgggtgtaagagggcccagggaaagcagacaaagaggaatgttcctggtttgtgcttactatcattctcacggcggagcccactcaggtttgttgacaatctggcccctgcctaccactctaacctctcctccctccacattcccatgagcttaccctgctccatccacaatgatcttctttctgcgtgtcaaattccttctgcttttttctgcctcggggtctttgcacaagctgttccctctgtctaagctactcttaccccagatcttcattaggatctaaactcaaatgtgaccatctcagtgaggtctctcctgacaactctagctacggcagcatctcaaccccatcggtctctaacacatggccctatttcagtttctttgcagcaatgaccagtacatgaaattatatatgtgtttgtcaatattgttgtttgtcttcctacaccagactataaactccacagggttagagaaagtgcatccccaacaccgagactgcttggttcacagagggtgcttttacacatatggctctgtcagaactgtcatagcaaccctgttaggtatatagtctattaaggctgagaggcgcttagtatcatgatttagagcagcactgtccaatatatgtagctatttagatttaccacgtagctatttagatttacatgcttcataatgaaataaaatgaaaacttcatttccttagttgcattagcgtcacctcaagtgctcagcagccgcacgtggctagtggccaccattctgggtagcacggatacaggacattcctatcactgcagaaagttctactggacagggctggtttagagcattcactgcagattcatatacttagcttcgaatcccagtcctgccaattactagtggtgtgattctgagtggaccttatgcttttagatctcacttttttcatctataaaatgacgctaataacagttcccatctcatagtgttgtaggagttattataggcaaaggctcttagaagagcatctgggatgtagtcagtgctagaaaaagtatcgactgttgctatgacacctccatttttactccctgagaaactgaggtccaaagaaaagaaatccttgtcctagtgcacacagccaggaggtggagggagctgaggtttgatcccgcacctctatgatttcagagcctggctaaatccgatgacacttttcaggtcccttctgggaaaaatccctgaaacttctgacccattgctcccttatctgtttagtgggggacagaagactccaagggctcctctatctaggatagatgtgaaggaactgactggagagccagccagagcccaggacatgggttgtctattctaggacctagtcagtggcttgggactccttgggggttgggaagccaggctgcccaggacacagaagcattggtgtggctgagccagtcatgccagctgcagccgagaccccttgtgtgggcgctgcccctgtgggtgtaatggcccctgcggcagggacagaatgctcatccctcccacctgctcaagctctgggactgccccaggaactgtacagaggggttgaactatttccacttgtttccctgtagaagcctcagatgctgctgctgctgctgctggtttaatttttaaatttagttacttttaatactttttaaatttagttacttttaatatgcacagtccctatgcttgtactgttttctttgttttgttttggtaacatgggatttttaattgctatttttagagcttttaacacatttttctacatttaaaacttttttaattgaggtaaaattcatatgatataaaattaaccattttaagtgtacaattcagtggcctttagtgcattctcgatgttgttcaaccgtcacccacatctagttttaaaacactttccttacccctcaccccatctcactaagcagccattcctctttccctccccattcctagtccccgacaaccactatctactttctgtctctaaggatttacttgttctggatattacgtatcaatggaatcatacactaggtagtcttttgtgtctggctgcttttactttgcataatattttcaaggttcacccatgttctagcatgtatcagtacttgatttctttttacagttgaataatatcctattatatggctataccacactttacccattaatctattgatggacattcgaatcatttccatattttgactctagtgaatagtgtcgctgtgaacattcgtgtgtgaatatttgtgtaattacctgttttccgtgctttcgggtacatacctaggagtggactttcagggttatacggtagccctatatttaactttttgagaaactgccaaactatcttctacaggggctataccaatttacatttccaccagcaatgtataagagctccaatttctccacatcccctcaatatactttaaaacattcacaattatatggcataataatataataattaatgataataattgttgctatcattaataggaggaaaccgaggctcagggatatagtcaattgagcaagtttatgcatctgtgaggcaggcagaataattgtccctgaagatacccacatctgactcctggaacctgggagtgtgttactctcagatgtgataaaaataagactgttaatcagctgaccttgtggggagattatcctggattactggggtaggtccaatgtaatcacaaaggatcttgtaagtgaaagagggagggaaatgggtaacagagggagacggaatgatgaaaacagagaatcagagcaatgtacggtgagaaagacttgaccggccatcgctggcctgaaaatgggagagggttggagagagatttgaagacgccatgctgttggttaggaagatgaaagaggccgaccaggagtcaggaatgtgggcagcctgtagaagctgcagaaggcaaggaaacaaattcctcctagagccggcagaaggaatgtagctttaccaaggcttttcactctatcaacccatttcagacttctcaattccagaactgtatgataataaatctatgtcgtcttaagtcacaaattttatggtaatttgttatggtagcaagaagaaactcaggccagccgtagtgtggtggggcagggattggcatccacactggattgactcaatgtctgtgattctaactgattggctgtctgtgactataacaaccaggttttttgccgtctccaggtccagcaccacttccctgctccacatagacatgagtggatctcacaaacatcacgctgggtgaaaaaaaaaaaaaagatcccagcactatgggaggccgaggtgggtggatcacgaggtcaggagttcgagaccagcctggccaacatggtgaaaccctgtctctactaaaaatacaaaaattagccaggtgtggtggcgcacgcctgtaatcccagctactcaggaggctgaggcaggagaatcgtttgaacccaggaggcggaggcttgcagtgagttgaaatcgtgccattgcaatccagcctgggcgacagggtgagaccccgtctcaataaataaataaataaatacatacatagctagcaagttgtgcaagaaagattcagtgaaacaccatttagaataaatgtaaaaacacacaaaataatattacatacgtgtactggagccagcttatgagggtcaattgttaacgttttcagttttctacatttaaaacatttttaaattgaggtaaaattcctcattttagctgcttgcctaacatagcccaatactcaaaactaaattgtataaacttgaacataaataagttataataaaaatagagtaataagcactaaaagctcatcacttcctagttgtggctccccaaacatggtggcggtggtggttggtgtggggtgggtggggcaggtgctactgtgtaattgatagggaccagagatgttgctaaatatcccacaaagcggaagacagcccccaccacaaaaacgatctagtcctaaatgtcagctgtgccaatggtgagaaatcctgatcttccctaaagcatgagttcctcatgagcaaggccagtatctgactcatctctgtccccagatcacagtctggcagagcagataatgctaaagaatattaatgatgttctacatcccaggcatttgttgcatttaaaccctagtgttatgagttagggactgtgattatatttgataaagcaaagaaacagctgtgctggtaatgaggctgctaaggaaggatggaaaatcgaaacgtaggactaatcagagaaatccaaatatgctcccccaaccaatcacaatggcctctaattaaccactgccagcttccttatgccaacggcctccaaccaggcactcttgaagccttccctttctttcactataagctttcccactaccctgcctgcctttgagtctgtgccaaacacaaatggtgtcagtggcctcccttattacagcaagctctgaattaatagcctttgcttgttttcattgggtggtctttacttccgcatagcaccggatgtgaaaagccttccacatgttttacgccttgtttcttctgctcattataacaaatcctgtagtatcacgttttcccggtgatgagttgccaggaccatgtgctcacaaaggaggggagctctgaaatatggcaaatggccaacaagaactctctcctccagcctagtctgaaggatcgctgaggtatcccctaatgtacatgagatggtccagcttgtactagggattgaaacatagatagcaccagagatggcggcaggagagagtcccctgcaagagtggacatccctccacacctggaactctttccttccaggacactacacacaaccctctgtttctatcaggcttgaaggaagtaccatagaaaccttcagagcttagatagaccagtggtctctacactctgcctttattccaggagtccagagggatactgggtcaagttcatattcccactgacagctaaagttcttgactgtcaaagcaatttctaagaattaccagtggaaacagttagttccctgtggctgctatgaaaaattattacaaacttaatggctacaacagtacaaatttactatcatacaggtgtgatatgatagtatcacattagcctggaaatatcattatcccaactttatagatcaagaaaatgaagcacagagtggttaagtaacttgctcagggtacatagctagtaagtgctagaggtaagtataaacgtagacatctttggaaaggaatatacacaaaaatgtaaaaacaatacttacttctgagtagaaatacgatagatgttgtttgcttgctttgttgtttttctgaaatttacagtacgtctaggacaggggtccacaaacgttttctataaagggccggacagtaaatattttaggccttttggcccagatggtctctgtcacaactacaaagctcagtcttgcagcctgaaagctgctgtagacaatacatagtgaaatggcatggctgtgttccaataacactttattcatggacactgaaattcacattctatataatcttcatgtcatgaaatattttcttttgttttttccctccaaccattaaaaaaggtaacaattactcttagctcataggccctacaaaaacaggaggagggcaggatttggccagcagatcataggatgacaagcatcacactcagcatgaaactgttctaaaatgttgctttaagatgaaaaagcagatacagttctttggtcagcagttggtggcgtgggcacaggtctggagacctgccagcctccaggcaggctagagggcaggtgtgggcagttagttttgtccctggagcctgggaagacggtgggtgaccagagagtcctgtctatcctaggaggagaacattcagcccaaatcccagccccatcatgcacagatcagagccatttctgaaaatgtcgctgctgattctgcttttcctgggattggcagaagcctgtactcctcgtgaaggtaatgcttccagccatgccttgtgtcctctatgtattttcttacaacttgggaggctcttgtgggctggattcagagagaagctcctgaagtctaacagacttcttcttgcttcccatttagacattcacatttcccttgatggacacagtggggtgaatgagtctaggttgctagcccctgcccttggagatacacttgtgtctgcatcctggtttctatcactgattctgtgactttggggagacactgcgtctgcaaaccttgctgtcctcatctgaccaacggggctcacaagaatccccagttcatgggactgttgcatgtcattgacgagcttacgttgtgcagtgcctggaagtcaacattaccatagttagataattctagtgagactccagacttttgcgacgtaaagacaccaaagagtatattgggaagaggacttgggtcttgccataactctgagttcccatttcctcattcgatccacaaatgtttattcctggttctttccacgggcttgatgctgggaatatagtgatgaaaatagttctgtcttcatggaattctcatgctaaacacacacattctagtgtggggattcggagatggcctctctagaaaagtcacatttgaggtaaggaataggagctggccagctgaagagttaggagagactattccaggcagagacttgaatatgcaaaggtcctggggcagaaggcactgagtccctccatcagagagaggccggtgtgtcaggaacgtggtaggcagaaggaggggcatggtggtgagactgttacaagtaagaagagacaggaggcaggaaacagaacagacgggggcatgtgagtcacaggaaaaatgttggatgttatcctcagggaaaaggaagctgtgaaagggttttcagcaaaggagtgtcatatttaggagcgtgtgtgtgcatgtatgtgtgtttctgtgtgtttaaacaatgtgtcttgccctcaggaaagaatggattaggtgggaatcagattaggggcaaacacacaagttagaaaacgttttggtcatcagggtgaagatggggataagtagaaggttacgaggcactgaggaaacagctcacaggattgagtgatgggtcagatgctggtggttggggatagagaagcatgcagaaaggctctctttatacatacatgtatttgcaactggggaattgaggctgcccttaactgagatgagaaaactctgtagaggtcgggcgcggtggctcacacctgtaatcccagcactttgggaagccaaggcagctggattatttgaggtcagaagctcaagaccagcctggccaacatggcgaaaccccatctctactaaaaatacaaaaattatccaggcatggtagtaggggcctgtaatcccagctactcaggaagctgaggcaggaaaatcgcttgaactcaggaggtggaggttgcagtgagccgagatcctgccattgcactccagcctgggaaacagagcaagactctgtttcaaaaagaaaaaaagaaaaaaaaaaaaactctgtagaggaacacgttttttaaaaaatttattttgaaattattttagacttgaggaaaagtcacaaaaattaagtttctgaatattcttcacccagttatctcagctgttaacatcttacctaaccatagcacaatgactaaaagcaagacccaacaccagaacaaaactattaaagaaattacagacctcattcaaattttactaatgtttctactaatagaaaaactattctatttgaggatccaatccaggatcccaccttgtattttcaattaagttttttgttttgttttgttttgttttgtttcagaaaatccagctcttgctcaaccatgttgcattttgttatcccatctcctttggtcttgtgatttgtccttaggatgtgtgattgaacctcctcaatctttgtctttcacgaccctgaaacatttgaagagctctgatcagttgttttgcagaatttctctcaatttgggtttgtctgaagctttctcatgattggattgagactatgcatttagggcaggaataccacagaagtggtctcacacccttccccgggaattatatcagggaccacatgatgttgatgtgtcttattacccatggtgtaaactttagtccctcggctaaggtggtgtctgccaggtttctccactgttaagttactattttccccctttgtaattaataaatacgctgggggagaaattttgaggctatgcgaataccctgttctcctccaatttttgcccattaattttagcatccatctgtggatcttgctgcagaaatgattgctacagtgcttctccaatggtgattttctattccccttattcatctacatatattcaatggcctttctctgtaaggaaaagctgacttttcttctccatttatttattcaagtactgtatttatttatatcagcgtgaactcagggatatttatcgtattggttgggtgcagtggctcaagcctttaatcccagcacttcgggaggccaacgcaagaggatcacttgaggccaggagtttgagaccagcctgggcaacatagtgagactcatctctacaaaaaatagtaagaataaataaaaagtattgcattaacagattattttttgatggataggagtgtgatgaccacagattcttttttgaacaggctaagcttgaagcacctgtaagatgtttgggacatccatagatagcaagttctgtgagaacagagtttggggtgtctagtgtactcttataccagaacttctcttcccaatcagccttgcaaatacctacagagcaggggctgaatctgatttatctgcgtctccaacaccaaacatgggccaatgcccagagcatgtaccatgtgaatgttggttggatggatgatgaacgaatggacttatcgatggatggatgggctgatagatgggcccgagtagctttattgatagcagtgagtgggtcagctgatctccagggacacttctatctctggtcttcttggttattgcactgatctgagtctaatgctaatttctctctctgctccctgctcccgttgtgaactggctggctgatgcttttgtctccagttgcaactaaagaaaaaagtaagaaccgtggaacccccaagtctgtattttcatagctacctctcctaaaattcttttcgatcttgcaacctctctggcaattctggggaagggtggcacttggatctggtgcacagacctgccatggggtctggacatgactcagaaaagcaaacctattgtttgcttacagtgatgctcacaactaaaagagcagccctccttcactcctttgtctggggaagagaggcctattcggaaaatgaagagcatttatcagggaagagagacttcgggcagatctccattagaataacaccttggcttatgtttaacaccagctggtggtttgcaaacttcatggtcttagggccactgaacacgcgaaaaaaattattaaggatctaaagagctctttttttttttttccagtgagggttatttttatttatttatttatttttgagacgagcctcgctctgtcgcccaggctggagtgtagtggtgcgatctgggttcactgcaacctctgcctcctgggttcaagcgattctcctgcctcagcctcccgagtagctgggactacaggctgcgcgccaccatgcccggctaattttgtattttcagtatagacggggtttcaccatgttggtcaggctggtctcgaactcctgacctcaggtgatccgcccacctcggcctcccaaagtgctgggattacaggtgtgagccactgtgcccggccaaaggttatctttattgatatttaccttattgtaaattcaaggatttttaacttaaaaatatttatatttacaaatattataaatatttacaaatacaaatacttatatttacaaaaactatttctatttacaaataagcacataaaaagatgctcaacctcattagccatcagaaaaatggaagccaaagccacagtgaggtatcacttcacactaactaacgtggagaaatcagaaccctcatatgctgctggtgggaatgtgaaatgatacagctgctttggaaaacagtctggctgttcctcaaaatgttaaacactgagttactcagcaattccgctctaggtatgtgcccaagataaatgaaacgtaagtccacacaaaaacccatgcacaaatgttcacagcagcactattcctaagagctagcaagtgaaggtaatcctagcatgcatccattaatgaatggagaaacagagtgtggtctatgcatacaatggaatattattcacccataaaaagaaacaaagttctgatgcattcaacatcgtgtgtgagccttgaaaacattattctcagtgaaagatgccagtgataaaagatcacatattacctgattccgtttaccgtatatgaaatattcaggataggcaaatccatagagacacaatggacattagtgatttccagggggtgaggggtgggggaatttagagacaatgactaaggggttcagggtttattttggggtgattaaagcctctaaaactggtgtagtgatggtcgtacaagtctgagtatcctacaaaccactgaaatgggtgaattgcatggtatgtgaattatatctcagtaaagctattattcaaatatctattactgcattaaaaaaataaggataatagagactcagaaggaaggagggtggcagggaggtgagggatgaaaactaccttttgggtacaatgtacattacaaagatgctggtgcactaaaatcctagacttcaccactgcacaattcatccatgtcaccaaaaaccacttgtacccctaaagctactgaaattaaaaatatttgaaaaataaggataataaatatacatactgacataaataaaatgttttagtgaaatggctgtttccaaaccaaaaaagtttagtaagaaaggtattattttacatttttgcaaatctctttgatgtctagtttaatagaaaacagctgaattctcatttctgcttcagtctgtcacaatgtgctattttttttttttttagctttatgtgtttgtttattttggagacgtagtcttgctctgtcgcccaggctggaatacagtggcacggtctcggctcgccatgacatctgcctcctgggttcaagcaattatcttgcctcagcatccgaagtagcctcccaagtagctgggactataggtgcatgccaccatgcctggctaatttttgtatatttaggagagacaaggtttcaccatgttggccaggctggttttgaactcctgacctcaagtgatctgcccacctcggtctcccaaagtgctgggattacaggcgtgagccgccccgcccagccacaatgtgctattttggttgaagcaaatgaaaatctaatctcacacagataaggagttggaaaagggaagatcatgcagacccgttttaggcagagttctccagagagacagaaccatgaagatatacatatagatacatatatagataaagatattgatagagatatttgagaacaaatttcttaggggaattagctcactcagttgtggggtctgcaagctgcagaaccaggagggccagtagtgtggctcagtccaagtctgaaggcctcagaaccaaggaagctgatggatggtctaactaactctcagtctgaggccaatggcctgggagctcagggagctgttggttcaagtcctagaatcccaaaagctggagtacctggagttctgacatccaaagccaggagaagggcatcccagctgcagaagggagagcaagaattgacccttactccacctcttggcttcagctgggcctccatccaactggatggtgctcacccaccgtgagggtggatcttccctacctagtcttccaactcacaccccaatatcctccagaaacaccttcacagacacacctggggcagcccaaacattctaatcaaatgccaaaccactcaggcttccctttcagcagaagacggatggactcagtgcctactgaagcattgagaataaacgtcttactgctatatgggtgccttagtcaagctgacaccccaaatcaaccatcacatcccctgaaaggatctcagggaccacctcccacccccaccaagtagtctttggatgatacttcgagaatttctgctccaagtcacatggaagggaaaaagatctcttttttttccacccctactagactgcaagactgtaagttcctagagggcagggactgtactttactcaatctgtttattcctatagcctagcaaaattcctagcgctcagtaggactaaataaatggaaagagccttgcaaaatggaaaggactgtgagaacataatttaatgctattatttcaggttgaaaggagataaaaggatccaatattaattaagcatttagcatgtactgagaatttaaaatacgtcatgcaatttaattttcaaaatcgtaagtgtcccatatggggtctgaggtttccaaagctctgaatcctcacactggaccatcatcatgagaatcacatgggaaactttaaaaatatttaatccccacaccagacttggtgagctaaaatgcctgcagataacattttgggttttttatacctaaaaagctagcctatgttagttccttcctatcttcaaaagctgaaccttctaaacctaaacaaatgcaaacatctcatgatccacactgtttttgtttcaatttaaaatattatgctgttttaattaaaatgttttatgttaaattattttattaatatttcaattaacaaaacagtatttacataaactttaattacatttaaattactaattaattattcaatttaaaacatcatgttattttcatttaaaataagatttccagggttcagaattaaagaagttctcaaggttatactggaaaaaactccttcccaacctattcactcatttcccttccccgaaagaatctgatattaattatttcttccagatccttccagagatattttatgcaagtagaaacaaatgtgtatttatatattcaaagtcctcttgtttctatttttacaaaaaagacagcgtattatacacactgttctgtatgcaccttacttttttcacctaataatacttccagaagatgactctgtgtcagttcataaggagcatcctcaacctcttatttatacgtttttggctgaataatatttcttgtatggaagtccacaatttgtttgaccagtcacatactaatggccactcaggttgttttcagtagtttgctcttttaaataatccttcaaagaaaaattcagcttacatgaaattagacatataggatatatatcaatgtagatctacatatttatatctgtaggattatacatggaaatatgtagaattatatctatatatagatatatatttctttatcatctagatataaccactgtcgtagtctgttttgggctgccataacagaatacctgagactggataatttataatgaatagaaatttattggctcatgtttctggaggctgagaagtccaagattgaggggttggcatcttgtgagagccttcctgttgtgtcatcctatgatcaaaggacagagagagagacagaaacagagacagagagctcagagcttcaagcccttttataaccagcatttatctattcatgaaagttgagcccttgtgacctaaatacctcccattaggccccacctcccaacactgctgcatttgggattaagtttccaacacatgctgtttggggtacacactcaaaccataacacatacacatttgacccttgaacaatgtgagagttaggggcaccaacctccagtgcagttgaaaattcacatataacttttgacttccccaaaacttaactacgaatagcctactgttgaccagaagacttactaataacataaacagtagattaacatatattttgtatgttacatatattacatgctgattcttacaataagggaagctagagaaaagaaaatgttattaagaaagagaaaatatgtttactcttcattaagtggaagtggatcattatcaaggtcttcatccttgtcatcttcacaatgagtaggctgaccagaagaaggaaggggaggggttggtctttctgtctcaggggtggcagaggcagaagaaaatgcacatctaagtggataagtgtaaccatgtagttcaaacctgtattgttcaagggtcaacggtgtgtgtatgtacacatatacatttacatatttatataaatatatatctgtaagattaatttctgaaactgcaaagttaaagaagggtttctaacactcgtgccactacaatgctatcgctgtattgatctttgtcaaatttatgtgacaaactacataaaaatagcgtcccatataaagatcgcactccatataacaacaggcaaataaatgttccatgaaggaataaagaaatgcatgtaaaaattaacagagatggatgatgttaatattaattccactctcttccttgaattttccatgttgattcactggctcctggctctgctgccccttccagtcaactgtaagtcatatctccttctccctacataaatggggagcccgcccttcaacctagagaaggaagggaatgaaagagagaggcaaaactgctgacgatcacattcaacctggggcagattcagatgtcctcaattcaaacatgacctcttcacccagaatctgcagattgcccggggtgggaacggtgcaactggatggactttgaggaggccaacaagcctctgtcattaggtctaaaactgggtgtgctgtcagagagaaagagaacctgtgtggtgttctgggaaatagctttgatcagattttcagtaggatcaatgacctaccacaatctaggggcctttgctctagaatgtacacctgggttagattgtgtgtatttattggtgggttttagatgagaaaaatatggtacagggtgggtaagacgtcttcctttcccagaattaacatccagtctccggttgagaagtggagatgacacttggttattatggagaccttccttatgctagaaattcagctggagaagggagggtctggattccccaggccactggtacccctgaagtttctgacttcagggtaaatgtgcctccaaaggggtccaatgcacttagaatgaattgcagctccccattctggttccctaacctatctcaggacctatggggtgcaatgaggtaccaaggatgacttaattcctttcatattctctctgaaccttcattggcaatatggttcccactggctaccatcggtcctgtccttcctgctgcttgtctgccaacagtgctgaaaggtaagcttctcattccatctctttccctttggggtctgtttgcctttgtccaaaagggatcattgctgctgaacttcgacttacgtttcttctctggtctgttcacagcttagcttctaatagcggaactagtaaaaccaagtgtggaattgtcctttgatgaacaacaacaacaacaaaagcccttttacttgtctcccctcaaagccacttgtccagaaactgagcactctttcatggtccgcacatggctcaaggaaagctattaggtctgagagctcaattcaggtctacctgacatcgataataatatttggttagacacaatgacttacatctttgctttctgaggtcaggtagtaaaagccaccatcatcgctgcctatttaataattcctagagatagcaatctggaacaagttaggtggaatgagaccatggctttgtcactgagtttgcaagactctggggcagaaggctaggtcaggaagtgagatgatgacttgcagaaaggggacaaggcccacattaggcacctttgcattcggagcctaattctgctccttcctaggtggggcaatcttagagaagtcacttcacctctctgtgcctactttgcaaggttaagtgaacttacggttgcaaaacattttcaactccataaatccagactttaccacctctttctgattccacgtccctgctcccactgcacacacacacgtacacacccttatgtatgaatccaatactattatcatcattattattattacgtacttcatattactatttctaactttactaaatgttaccttgagccaggagctaggctaagtactcaatctgcattatcttccttctttattgacacagatccaaacaggaaacaatatctccattttaaagagcacagagagttcattcatcatcccaaggccacccacttagtaaaatgtatagcctggatatcagccattcaatgcccacatcaatattcccaacaacgttaggcattaactaccagacgattttcagtgataccgagaaaggtgttgcgagctccataaatacagcactttccactagcaaacccagtgggattcttcaatacgtagcaagcctcgccccagttaacgttcccgttttgcagatgaggaaatggagacttctagaagaagtcagagagatctgagtttgagttcctgctttttcactcaccagctgcacaggtctctgcaaatcacgtaattccttggaggttcacccgtcctcaccagcaacatagggacaatatctgatctcaaagggctggtgtggggtaaatagaaggacagagcttggctcctctttctagaggcaataaaggatcatcttttcttctgttcctagcatgaatgaagaacggttcatgattactgtcccaacctctttctccactttggacgctcttccctgcatcaaatgcacgagggtcctcaataatctcacagcgttctgaatcttagtccctgactgctcaccatgcatgaccccttgtggattctacttcccaatctgttcccagcccccagcatctgacctcgtttttggttttctaattatggcttcgtctttgtgacctcttggggacaacattctggaccacgcatgtaaccttggccaccatgctgactctcctggatgggctgccatcagggatcataggtaagtaccttgccacttcacaatgcccccagactgtgcactttggcgggaaattttgggctttgctctagaatgtacaactgggttagattgtgtgtattcattggtgggttttagatgataaaaatatggtgcaaggattttgtgcaagaatttctgagtatctagtctgtgcctggactcatgcttgggtgatgggagcccagaagtggatctgatatgctcattctttataaactcaaagtctggtgggaaacagagataagtaaacagaaattagattagagacaagtgatgcttgctgtaatttttttttttttttttttttgagacagtcttgctctgtcactcaggctggagtgcagtggcacaattgtaggtcactgcagcctctgcctcccgggttcatgccattctccaacctcagcctcctgagtagctgggattacaggcacccaccaccatgtctgcctaatttttgtatttttagtagaaatgggtttggccatgttgtccaggctggtcttgaactcctgacctcaggtgatccacccacctcagcccccaaagtgctaggattacaggcctgagccactgcgcctggccttgctatgattgatagaggtaggaaaggggattaagtgggaataatgaggcatcatgactgaggcattatagccacacttcctgaagaagagtttgttacatctgttgaactgggagaaatccattaattaggcatatttctttctgctgcatttgcacatcatgtgttatgtcttcttcctcaggtctcatgagcagactgtcaccggatggtaagtgtcaggattgtatcttttaaacctggtctttctcttgtccgcaaggtaatgtagacttattgagtcatttatgcttttaggtagagtctaaagaacacttcaggtattatccaagcacatgttttgtttgaactttgatgtaatgaaaatctttattgctatataaggttacagctagaattttgcctaataattattatgctgtggagttttttaagttttataaatagcatatgcacatgggaaaatatcgaggaaacataaaatgaaagtcaaaatcattctcttcaccacattcccggctctgctctctagaagcaagcaccatttctagtctcacgtgtattctccccagaaatagtcatacacatgtatgtacatccttaactcttcaagttaaaagtactatgtgttttagtgatataactttacctctttcaaatacctgagaaatgcttcgtgtgtactcccataatttaatgagcctctggttcatgtacatttagttttttttctaatatatatgtttttagttgtttcctttcaccccattgactgggattcctaacatattttgatttgttttgtttgttttaatttttaaattattattattatttttgtatttttagtagagacagaatttcactatgtcggccaggctggtctcgaactcctgacctcgtgatccgcccgccttggcctcccaaagtgctgggattacaggcatgagccatcacgcccagcccagttttgttttattttgttttgatgttattataaacagcgctataatggaaatccttatccagtcattgcttttttatttttgcaaattcctatctgttaagttcctaaaagggaaatggctgggtcaaagggtatctgccttttaaatctggacagatgtttaacaaatttgcatcttcatatacagcctgtggggatgcttgtttccccacaccttcagcagcatgggatattatctaactttttatttatttatttagagacggagtctcgctctgttgcccaggctggagtgcagtggtgagatctcagctcattgcaacctccgcctcccgggttcaagcgattctcctgcctcagcctcccgagtagctgggactacaggcgcccaccaccatgctcggctaatttttgtattattagtagagatggggtttcaccatgttggccaggctggtcttgaactcctgaccttgtgatcctcctgcctcggcctcccaaagtgctggaattacaggtgtgagccccgcacctgacccaaactttttatttttgataatgtggtggccaaaaaacactgccccccatatttttttcacagacggactgaaccccaacaggtgttcttgctgcatctatgcaccgccagaacccccacacctcccattcttcaaatggacgtacagctttctccttaagtcaataaacttgaaaaagttgctttataccgcttgagtaagtggtcagcctcataaggaggagacaactgtgaagataaatatcatgaaaacaaaacgagattaaattataactagacactgttttctgccaaggctctttgtgtgaaggttgttcccgctgttcggtggaaataaacactagcaagtgttatgagttaaagatgcgttagtgccattttgagaatttctctctggttgaaagagaattggagagagaaaacctttctcaccatgtggtacccaaggagttcaagctgaatctgtgtccacgtgagatctgctcggcgtcactaagcactcatctctcactgctagagatgcccggcagagcgaatgctagtggggcttcccaatacatccatatctggaatttccacctggctccactatttaccagcacacaccacccaggacaagtctgttttcttcccggtaaaccaggattcacagcacgcactgcacagtgtggttgtgagattatgataaaatgccagaaacactcagatattagggagctggtgaaagtggatttgactccttcccacccccaccattccatggattctggagtctaaagtcttccttgtggtttctgttactcctgtgatgacagtttccgagttttgtccatcttaggtggtgaaaccaccatgcactttctctgttttcccatcaacctggaagtagaactctcctccttgcccatcgacctggaagtagaactctcctccgggggttcccccaagaaatgtgttgtgggaaacattttacggaaacctatgactgagttttgatggagaatgtcaggaacagtcagtccagcctcgagcacatggttcctcaccttaccaactctgctcacctctccttttcttcccttcccgcctctcctccctcccacattgcctgcggagctacacagtcttctccttttaacaagcacaataattcagttctcccccactcccatccccccaagtccacctaacccataaatatcagccctctgtgcaccaggagcttcctccttggaatgcagccggactttataaaaagcaaaatgttcttattccacatgtgaagtgcctgccacgaaaccaagtaccaatcgaatgtagccactgtcaggtataataacggcagggggttgaggcagatgtggaggaagtcacagactcatggggctagaaatcatctgagtcattaaacaggtggggaaactgagggctggaaggaggcagagcatcagaggcaaggtggccactaacagtagattcattcagcaccttaaatcagccaatgaatttccaagtatccctttgcatggattcttttaatccttataagccctctaagaggtgtaaatgccacaaaagctacagtgaccagctcgtcccaggacacttccagtgttagctctgaaactctcgcatcctgggaaccccttcagttctgggcagaccaggagcgtgggtctctcatttatgattccacttttctgatgaggagactgaggcacaaggagatggagtgagttgctgatggtcacgaggctggtgtggcagagccaagaagggagcacaggcccaaatgggtccatggtgtccgctgttcttaggatgaaggctgaggcccttaagctgacccacaggggtctgcctcactgagctccagatactctccagccacgtcttgtaccatgatcacctaccatcatgcccctgaggtgggctccttcaagcccccggcagctgcaggctccatccagcccaggaagacgcccacatcgttccctctgtctgcgacactttcctgcctcctcttccaaatttcttcacccagctaacccctgctcatcttccaggtctcagacacaacatcacttccctcaagatgcctcccctggtgtccccgcaaggttagcaaccatcacccccttataggttcccatggaacccagcaggtctacccagaatactcatcccaacgataccccacttttgatgcttttgctgtctgcttctctctgactagtctgtgagctccctgagcagctgggtctggcctgccttgctttccactgcaccctccataccttgcgtgatgcccagcacacaggagatgcctcataaacatttgttagaaggcgtgactgagtgcttaagtctgtgtcttcacccgtaaaatgagtgaattgggttgcctcatctccagtagcatttccacctctgctctcctctgactggtcagggatgcttagtcagtggtgtctgagacccgtgtcttaatgttgatttctctctctactctgcccctccgttgcaacctgggctgcctacattctagcctccagataggacagaagaagaaagtaagtactgtgacagtttttgtctctgaaattagattctcataaccaccgctgggccttcaaactcctttaagaaaatgccagggaagggttggtccaggccccagtgtttagccattcgcctggcatcaggagcatcatcagtacagattctgccaaagaatctaagctatgctgtgctggtaaatgtctaacaaccacctctgcaaggggagagtgggaaagggagccctggtttgtagcgactaccacttcccatggtgtaaatactctgaccatgcctgatttcaggatgctaagggtctgagagctgcattggacaattcctaaattttagtaattgtctcttgtaagctagcttcagcacctcactaagtgtaagctatgtctttttttatttggtgtagaaattgctccaatgcgagggagcttaccccattcattcctccaaaggaaaagtgatagtctggaggagagaaaggggccaggccctttacagaggggaggggaaatttcaaggaagaaagatggtggagcagtctcttcggaagacagacgtatttatactctagttcgggtaagacggagagagacccctcttcccatgagtactgatcctcgaggccaaagacttgtccatcttttagtacatgtcctagaaaactgtatggcacatagttggaccacacaaatgtttctcttgtgtgtggtggtctgtttgtttgtttttgggtttttttgagatgggttctcactttgttgcccaggttggagtgcagtagtgcaatcatagcttactgcaacttagaccccccaggctcaagcaatcctcctgcctcagcctcctgagtagctgagactacaggtgcacaccaccatacccagctaatattttacatttttgtagagacagggtctcaccatgttgctcaggctgatcttgaactcttgggctcaagcaatcttcccatctcagcctgccaaagtgctgggattacaggcaggagccaccacttctgaccctcacaaatgtttcttgtacctctaattcatgttatttttgctcattagaaggagttgaagaaaacgaatactggagaacctgcctctattatataactgaattctcccaagagcactggtcaaatggaacccaagttataaagagtggtttccccaaactggctaattatctgaaactttttcaaaaagacagatttctttgttctacctggaccttctgcatgagaataccaaggggtgggtcccaggaatctgtcctttcaaaaggtttctcaggtgcttctgatggtttggctcagatggtttgagaactactgagataaagtaggactcagcagaaaggcccactgcttgtttttataaataaagttttactgacacacaatcacacccattcatttaggtattatttgtagttgtctttgtgctctaatggcagagctgcatagttgtgactggggccatgtggcctgcaaagcctacactatttactgtctgaccctttagaggtcagacatttattgacctctgagctagagcagtgcttctcagggtctttgtttaaaattagggcctaggaccctacttcatatctaaagaaggaggatgtctgtgatggaactctaagctcttgagtttgcttcccaaatggtgattctttgggttggacacggtggctcatgcctataatcccagcactttgggaggctgtggtgggaggaaggcttgagcccaggagtttaagatcagcctgggcaacataggaagacccccttctctatgaaatataaatacataaacagtttaaaatagttttacgatattgaatggaggaataattgaatgtcctatactgctgattctattctcttgctcactcttctccacactgactccccgaatgctggttctgctacttcctccagtaaaaagtaagttatttttcctttcctatgggtcacttggaagttttcaggtgctgggaagaagaggcaactatccaaagaagggaatctttggatagttcttctcaatgtagaacacaagttgagagggaccctccatctgctgctcccctctctgaaggggtttcagggtgggctgcaagccccagattgtgtggagagccgtgagggtgtgtctgggatacggtgggtctggggctacatgcaggactgagtatgtgagcccttggcatatcacgtccccgagctcacaggaccgttgccccagaagacaagaaagcattgagttgtacatatttgttgggagggccattgagaagagaaccaaagaggggcaccttgctccttcctcaagctccctcctgaccctcgggggagaaatgagagagaaccctggagactcaaagggatgctctagtatcttcctaatctctggaagatgaatccccacggaaactgaatacctggggcttctgtccacctggattaatgcgtctctaaaggagtaaagtctcaaagaagcatctcgagtcacccaccctgggccccagcctatcgcattaatctggaagacactttatttctcttttttgggaagatctgttttgagaaccacagggtgggaggagctaggaagaaggcgttattaatttcttccttttcctctcctctccttccttccttcctccactgctgcccaacaatgcccactggatcttctgctcctggcatctcatctcaacagcactgaaacctaagagtcttgtttcacatttgaccccttctgttttgctcctgttctcatctctgccaagggaggtccactcttagccatggatcaactctcagcttttgaccatcttttttttttaaactcaagaactgggaaaaaatagctatattaccatcatcttcaaatagatgggatgtctcatggaaaccaatccctcctcgaatcaggcattcatgtaatgccatgatgaggatggtgatgacagtgatggaaatttacaaagagctttctaggtgccaggcgcgaggcaccagagcagcacttttcaatgtgttatgtgtagttattccccacaacttcttcacaaggcaagtattattcatctgcacttgactgaggtataaaggttaggtaactagatcaagactgggcatcccagtggtgacggtgggttacggatcctgggctgcgtgactcagctgcttaaccacggtgctgtgcttcctcccactgctgtgtggctcagacttattttccccaagaacatctctgaccatttcatcatgctgttccctgaaaaagtcactgtttgccacatgtgggtaacatacatcttttaaaaagtcttgaaattgtagtaaaatatacaaaacatgaaatttaccattgtaacttgttttcattttttagagacaggatcttgctctgttgtccaggctggagcacagtggtgcagacctcctgggctcaagcgatccttctttcttagcctcctgaggaactgggactacaggtgtgcatcatcacacctagctaattatttttggtttttttgtctgtttttactttttttttttttacttttttgttttgctttgttgccaaggctggtcttcaattccggggctcaagcaatcctcctacctcagcctcccaaagcactgggatcacaggcacgagccactgcacccaccttaaccactttaaagtgtgcgatttagtggcccttggtacacacacaatggtgtgcaaccatcaccactgactccagaactttataatcactgccccaccaaaaaaaaagtacccattaaacagtcagtccccattctccctctgacctcagccccggcaaccaccatttcactttctgtctctgcaagtttgaggattctaggtacctcatagaagtagaatcgtacacgatgtggtcttttgtgtctggcttcatcactcagcacagtgtcctcaaggttcagccacattgtggcctgtgacagtgcttcactccttttcatggctgagcaatactccattgcatggatagactgcattttttaatccaatcatccactgattgaattttgggttgattctacctttcggctgaggacacactcttcttttggtccacattcaaagccatctaaaccccagttctgagacaccatcctgtccatgccccacacccacctccaaaccccacttctatgcagcttgagcctcagtgaaacccaagacatcctgatctgaaaaaacaaattgaaaaatggtatcctgcagctcaagagcacgttctgggtaccaggcatggttgttaagtgcttgactcatgacagtccccaagtcatcgtccttgttttacaactgaaaacactgtggtaagagagggagagtcgcttgctcatggtcacacagccagtcaggtgcagagaataacttaagcccagtctggatcccaaacggtgctattaaacaatgcaaactcaaaagtgttcaaagcggctcagactaacgaggtccctgcctcatccctacactggaagtattatcattataattgtatgttgtatatattgtaaggaagataaaattatgctaagaaagggaaagaggaactggcagagagtgtgcactgtgggcgccggtcctgactgcaccactttctagttccgtgggcttcggaccctcgcctcctgaagggctcaggcccctggtcggtacaatgcacataatagttccagcctcatatggttgtgaggagtaaacaggatcatgcacttggcaggatgattcccaattggggagatttcgcccctcaggggacacctggcaatgcctagagatatttttggttgtgaggactcagggaggtggtaggggaggctaacggcatctaatggggggagtctcgagatgttgctacacatcctacaatgcacaggacaccccacccccacaacaaaaaaactatccagccccaaatgtcactcgtctggaggttgagaaaccccccgctgaataaaatgtctggcacgggataagagctcagcaagggtctgtgaggaccacctcatttacctttgttctgaacactcccatgtctgcaggaggcccctctgccttgctcctttcgctccttttcccaggcccttctccagcctccgtcctcatgctgcactgacagcactttgcaaactgaaagcagacccagcaggaaaatcccaaacacctgcctaagggcccaccaggtgccaagcagacccagccctgctccagtaacgagcaaaagccaaacccagcaggaaaatcccaaacacctgcctaagggcccaccaggtgccaagctctgtactgggcgattcacgtgggctctttctcccggaccctcacattaacccaggatgcaagtggttcggtggagacagcctgagttttaaggcaaagaggcctgggtgggaactctactcccatcatctataatgtgggcgtaacttacccaaactcccttagattctattttcctacctgattaatggagataatattttttgcttgtttgagaattcagtgacataaggcagggatcaatcagcatttttttttctgttttctgtaaagcgctaaatagtaaacatcttaggctttcagggccaggtggtctctgctgccactcactactcaatgctgcctttgtggcctgaaagcagccacagacaacacacagtgaatgggcatggctgtgtgccaataaaactttatttacaaaagcagtagacaacacattgtgaatgggcatggctctgttccaataaaacttcatctacaaaagcaagtgtcaggatgtccacccaccgatgaatgggtaaataaaatgtgtctattcatacaatggaatgttattcagccacaaagaaagtgctgacacaggacacaacataaacgcgccttgaaaacacagtgctcagtcaaagaagccagacacaaaagcacatagggtatgactctgtctctacgacatgtccacagcaggcaagtccacagatagggaaagcagcttagtggttgcctaggaccgcgggagaggggggtgagcccagagagatggggagtgactgctcaggggcaccaggtttggaggcaatggccaacgggtacacggtttctttttcaggtgatgaaaacgttctaaaattgtttgtggtgatggatgcacagctttgtgaatgtcctaaaaactactgtcttgtacacttgatgggtgagtcataagttatgtgaattatattaatataccagtcaagttgttattaaaaaacaaagttcagaaaacaacaacgggtggtgggatggaatgtgccacccctggatgagtatgtaggtgcctacattagagtgacacaaaatacatggaaaaaaggcctggcatggtagctcacacctgtaatcccagcactttgggaggctgatgcgggcggatcacctcaggtcaggagttctagaccagcctggccaacgtggtgaaacctccgtttctactaaaaatacaaaaattagccgggtgtggttgcgggtgcctgtgctcccagctactcaggaggctgaggcaggagaatcgcttgaacccgggaggcagaagttgcagtgagccgagatcgtcccactgcaccccagtctgggcaacagagcaagactccgtctaaaaaacaaaaaacaaaacaaaacaaaaacaaacagaagagatgggaatggcgtggcggcttccttcccagcctaaccttgctgcggtgcaaatcctgcaagtcactgcacgtccctccaacccacacgaagcagcctctgactgttctgcgctgttcactgtggcatgtcctgactactcagcacgacccacccagggctccgctctcctgtgctcccatcgctctgtcttctgatgttgtgatttttccctacatgtggcctcctcttccacggctcctgggaactccatactctgggcctgtctgctcccctgacctgtcttgcttcctggaccccatctccttctggatggacatcatcagagatcctaggtgacacctcactccatgcctgccccgggactctgtaggaagctggtttgggaggaatgctttttagggctgggcagggtggtggaaagctgaaagatggatctgacaagctcacaccctcacgtcaactcacagtctagtggaggtggggagatggaaaagtaacaggcagttaaactacaacaggaatctgtgtggcacaggggggaggtggcagtggggacagtgtgcaagaggacgatgcgggcaatccagcagggcttctcggaggaggagtggcttggggcgagcctgctggacctgctggtctggaagtgtttatcatgctgtcccttctgactcgcgttgtatgcccctgtcctccttaggcttgctgagcctccaagtactgcatggtaagtctggtgactgctatttcgtgttcactcctgtgcacagaaatatacaggtactggttttttctatggtggggggtcccttaaatatcatcagaccctacactctttatccgtatcatcatctgcatcataaatgtttaacatgtttttatttgtccaacagatattaactgatgttagctctcctgtaccaaatgttattctaggtgttagagatgcagcagaggataaaacagacagaagtctgtgaccaagtgaaacttgtattccaatcagaggagaaaaaacaaagagcagtagttataggtctgctgaaggctattatgtcctatggagacaatagagtaatggggatggaaacgcagtgcgggaaacttaagttttttggctgggcatggtggctcatgcctgtaatcccagcactttgggaggccgacgtgggtggatcacctgaggtcagaagttcgagaccagcctggccaacatggtgaaactccgtctctactaaaatacaaacaattattttgaaacaaattttgtaaacatagaaaaaattagctgggcatggtggtgtgcacctgtaatcctagctactcgggaggttgaggcaggaaaatcacttgaacctgggaagcagtggttgcagtgagccgagatcatgccattgcactccagcctgggtgacaagagcaaaactctgtctcaaaaaaaaaaagtttttaaagggcgatcagggaacatgacatgtgagcaaaggcttgaagaagaagggcaggtgagccagagataactgggggaaaggcattccaggaagagagaacagtatatgcaaaggccctgaggcagctgagtccctgggatccagggacacagggagactaactttattctcttctctcctcattcgaggcacctggaagcactatttagagtttggtctccacccacttcataattcacctgatggtttcttttcttttcctttcttttctcctcctcttcctcttcctccctccctctctccctccctttcttcctttcctcttcctcttcctccctccctctctccctccctttcttcctttcctcttcctccttctcttcctgcttctttttctcctccatctcttcatttttagaagaaacaagtggctgcaaggaggaaggtaagtgcttggggtcgtaccattcctcatctataagacagtgtg

SEQ ID NO: 908 - DNA, 6804 bp, Homo sapiens
tttcactatccaaaacaaccagttacatgctgatccactttcaatcttcctgttaccttcctaaccatctgtttttttccaggcatcatttgcatttatattgcatatgtcttttgtactccttttcattcaacatttgaaccaaaggatttttccatcatatatgaggagttttgacttaaattgctacagaggtcatttggtgttgcacatcgtgaggtgccaattcccaaatctcttctctatttggaattgaagccactgatttggcatagtctcagaggagagtcagtccttggcatgaatgcacaactctcagtccgtcaactgaggcttttaacattctgatacaggatgtactcaccatcaccacaccttgaaaaccaaccatccaagattattcagttggccatttttcctttttgttttttattttcaaaaccactctttactttgaatacataataatgatattttgataaaacaataccagcagaatatatcaacaagagactctttaccaatcccaagttagacgggagcaagcaggacagaacttataaataagtattgcctacatgcaggaagaaaatgctgtttgggagccagttagtggacagaaagattctgagccacacacatttgggatgaaatcaccataagaacagagagccctgatttacccccatgatccaacagaaacaacttctgtcagacagcagaaagcctctggtgctccttgggcaatggtatcacaagagaactgctgaggcaaaaatgctgtctctatctgtccttactatcatcaagaatgtgagctacactcagttctcactgaaaacacctatacttcaaaaaatagtctgtaccattttctgagaagttatcttatgccagagctatgttcaaaccttcacccacatccctctgtgttttatagagaaggtggctagaaggacagaggtgaagcagctgaccaccagcttctgattttactccttctctagttactcccaaaacccacattttttccccaaacctacaaagtgtgtctttaaaaagcagtacagtaatgtcttctaaggtgtcacaatttttttattagataacaatgtgtttagtaatagtccatcattattcttaataatatgtttagtaatagtcatcattattctgtaagccaacttacttggaatagctactccctgtcctctctgaaccacagccattgctacaagatgggagaagtctgggagacaggatgtgatacatatgtgtgtgcatgtggctagaatgggcagctgccatgcatgagtttatttgttcattcattcaacaaacagtaagtgggcatcttctgcatacctggcactgtcctccgaagatcagtgaaggctgatgtctgtgtggttcataattggcagtaccttatcaagggcaggtgtcccagccatgttgctgaagaacacgcctcctcaaaacttagcagaggttaacacattcatgttgctcaccaatctgcaatgtgcacagggtgtgatgagtctgtttgcttccacatcatatcagccgggacagctcgaaggctggggatgaaatcacctgacagctggccccctcaccccatggctggccccctcacccgcctggtggttgaaaaaagctggatactggctgaggctgtcttgagcacctgcacgtgacctctccatgtggctgctcggcctcctcactgcacggtggtggctccatgattgagtatgcaagtgtccaggcagatgctataccacctcttaggattttgccttggaggttccacagcctcacttcctggtagttgtggtcccacccagattcaaagggaggagtgtgagcatcatgccatgcacagagcagggcgtgggataaaagctggtgcagccagcttaggagaatccaatctgccacagcagctcagaggctttcctgcaggccccatggtacagagttggctgctcctcagctgtgctgttgaaagatgtcagagtagtttagtaagaggagagctgacatgtggttctggacttagctggggagacaagaaatgctggtgtcacataacagttagggcaaattgtcctttgtgcctggggtatgtgtggctgttggggaccaggaggctgcacacccctttctctcaagcctttacacagctcagatgggaggctaagacctcagactctggagaaagaccaggccatttgctagttagtgggtgtaggtccctgaccttagccccagaaaacatctgcagaggctgagcctcttcactaatgctttggacacaatgccatttataattaaaactgattcatggtgatttttgtttctctactcacttaaccaaaaagagtgtagtgtgaccataaagtctgaaaagagatactattatttatcatctactataatatagtatcaataaaccatgcattgtgtggttccaggcttggtggccaccctgattattctcataacaacctttaaattagtgtccctgctttgtggatgtagaaactaagagaggaaaagattagccatcgccccagggtcatgtacagaccaccaggattcaacctcacttccgttaagtgttaaacttgtggtctgttcaatgagctagctgacaacagaaagaacattattataaaaaaagaaaatgcattgtctctccccatcaggaaaggctcccatgcccccaatgtgggaaccatctggccggtgtggtgctcactactgaggagttgtttaaatcgctcaaactttccacacttcactggggagggactcagtgaagtctttgatgtcacttatgctgtgtggggtccccagagatgaatttgactgtgaaccctatatgatgtctcaccaatctcttcctattgcacctgctattggcattcttctccccagactgcatagtatccctcactggaaacattcagggctcctcatctaaaagaagacccactatgccacccgcctttttccaaactgggaccaaagtgtctccctgaaaattcacaggtgctagtaatatggtcattgaaagctgttttctatgaaagtttagagacatgctaaacagcattcattttgaaggcaaggactcaatagatgaaaattcccatctgggtaccaaaagctctgcttttaaggtacccaatcatgagtattctgaagctcattaccatccatgaaggaagagggtatggaaaataactaagttctaaatgtctattcttcccattgtcactctagcattgcaaacaccctctcattggctgcctatctcctccacccacacccatattttaggtcaaagagtcccttctgtgaatcagagcaatgtatttctcatcttttctctttttcatgccaatcttgagcaagtcacagagctgactttgtgaaaccagctggcaattgttcgccatgaaaaccaatcatacactaacgctgagtgcctcaatcgcagtgaacgtggcagggcaccctcgtaatcaggccctgcatcaatacgcctggtgcctgtgggcagctcttgttctgtgtgggaaggcaggggcctcttccatctgctaggagctaaagtaatgactgtgtgcactgacacagcctcggctgcctctgtgtccatatgctgtgtattcatggcacgttaatgaagaaatcttctgtcttgcctggactaatgggggctggtgagaggcgtggaacacaagggaagctggggaaggtgttctatccaggaggtactggctgaccagagaagagagcattagggggtgatgccagagtccctacacttgagcccatttcgctaccagagcagctgtgcaatcttgggtgagtgaattgagctgatcctccagtccacaactacaaatgcagctttcaatagtcacttcctctcaaggaatttataaacatgaaagggatcacacgtgtgtgggatggtttgggaaagcagttgtaattagaagtgtgatgcaaacataatgtcaataacggctggcttaccgtttgccgaccaggtacatttgggagccattttaactgctgtatggcaggtaaactgcttctttacttggaggaacaaagctatacttgctcaacatacagcaatctttctagagcatgaggcctggatgtgatagaacttcctagaaagttccatctgtttcctttgtcacatactgaagtctatgcttgtaagaagagcaagtacaggaacctaaattccacactgcagtatgggtgctacactgggcagttaagtgctgtattaagctgccaaaatgttcatcagtagccttggctgtttccttttgattccgttttctaagcacctaattcagtcctcatgcccattgcgctgtctctgttacagcaatttccacaaaaccttgaaatcattttttgctggtctctcttttcccgtagactttccaggcctttcaggtagaatgagctgttgattgccagcgggtcagaaccctgtgagtgacaactgcaaccgtttacccttgctgcataacaaactaccacaaatcaagtagctcaaaacaacatgcatttaatagttcccatttctgttggtcagaggttgggcagatggctggattttctgcttggggtcttgcaaggtgtcagccggcctgtctgggaggaatctgcctccagggtcattgagttctcagctgaattcagccttgcagctccaggactgagctgttttccagctgatcccagtgaccactcttggcttctagagaccacgcccagcttcctgccatgtgggccatccatctccagtggagaaccccacccctgctgaattcacttcaagctacaacctgaccttcctggctgtgacctgcagacagattgaaagggttcctgtggccaggtcaggcctgctgggtaatctccccatcttacaaccaactcacctgagaccttcattacttctgcggaattccttcatggcccaacctcaattcatgtttcattaagtgactgagggaagatgagcaggactcttggtgccaacttagaattccatcagccacagcacacaaagtcacttcaagaagtatttgtaaagtgaagaaaaggcatcaagtcacatttttccctatgagaaacttagactgtaaggcatgtctttgcagtagcccaggatttccaaatgcaccccaggctaaggctgcctccactgaaatcacagttcccctttcaaatgcagattcctagacccaggggattctagtggcaagcaggctatctgccttctagcaggctactccttgggggcgtgtttccctctacagctcatctggaaatgactggaagcagcctttgcacctggagaccttgctagatgggcaatgaaaggcagtatttagaaaggaggctcccaggagggatcctcaagcccccagcaggcagcctgggcctggggctaccacagattaaggatgccgcccaaggaaacaaaggatccagggagagaaatgcagaaattagtaatcatccagaagaggagtaacaacagttgatacttacataataccttgctaataagcatgagcaactactcgtagaaaggcagcatgttccatctgtatcatagcattgtgagttaactgaagggggtcctagagttaccagtggacacagcatttagccagtcagcaaacattgctgagccaggtttggagagatgctcctgccctccacagctcacgactccccacagagacaggcgggtatacaaatgacagaggctaagggtccatatgtactgtcaccaaaccaaactcaggtcctcttgccctgtgcagcaaaaccaaacactgacatcaggactgcagcaacagaaacccaggcatttatggcagaacaccacgcaaggagaatcaggcagctcaggcttgagaccaaagctgcccttgcagttaagtgtttttaaaggaggggaggcagaggtcacaggccaagtcatcaatcaatgaccaaaaaaggcagaacatctccaagtgggggtccacaggttgtaggtagagttaaagattttctgatttgcgataggttaaggaaggaacatttgtctagactgggggtcagcagaaaagagtgttagctctggcctgtgggcatgacctccaggctcctcaagaagaaactgagagcaaggaaaggcaggcagacctcactcctcagtcccccttatatggggtccacgtaccagcaggtccatttgttggggggtgtggttttctgaaaaacaactcagggtcatatgttaacatggtatcccctgtgactttaacttccttggctattgttttaagctactgttgccttcttgcttatcaagttgctcatttacttgtcagagctagctgggtgtctggaatttcccttgaaggcactcaagattttcctttatttccgcacttaggagctgggggatggccccccctaagaggggtccctgctgtgtctcggcactgacggcaatgtgtacaaagcaacaagtggttctgctgcatccaaaggaaacctggaaaagtgtaaaggccaggttacatttgagcccaggttttccatttctttagccatgttggccacatcttcactgggtggccagtgtttcaacagccaaagtggacatcaccgcccacatctgagacccctgcccccaggggggctggtccgtactcagctacctaataggaccggaggctgggcttcctgggg

SEQ ID NO: 909 - DNA, 8878 bp, Homo sapiens
tttcactatccaaaacaaccagttacatgctgatccactttcaatcttcctgttaccttcctaaccatctgtttttttccaggcatcatttgcatttatattgcatatgtcttttgtactccttttcattcaacatttgaaccaaaggatttttccatcatatatgaggagttttgacttaaattgctacagaggtcatttggtgttgcacatcgtgaggtgccaattcccaaatctcttctctatttggaattgaagccactgatttggcatagtctcagaggagagtcagtccttggcatgaatgcacaactctcagtccgtcaactgaggcttttaacattctgatacaggatgtactcaccatcaccacaccttgaaaaccaaccatccaagattattcagttggccatttttcctttttgttttttattttcaaaaccactctttactttgaatacataataatgatattttgataaaacaataccagcagaatatatcaacaagagactctttaccaatcccaagttagacgggagcaagcaggacagaacttataaataagtattgcctacatgcaggaagaaaatgctgtttgggagccagttagtggacagaaagattctgagccacacacatttgggatgaaatcaccataagaacagagagccctgatttacccccatgatccaacagaaacaacttctgtcagacagcagaaagcctctggtgctccttgggcaatggtatcacaagagaactgctgaggcaaaaatgctgtctctatctgtccttactatcatcaagaatgtgagctacactcagttctcactgaaaacacctatacttcaaaaaatagtctgtaccattttctgagaagttatcttatgccagagctatgttcaaaccttcacccacatccctctgtgttttatagagaaggtggctagaaggacagaggtgaagcagctgaccaccagcttctgattttactccttctctagttactcccaaaacccacattttttccccaaacctacaaagtgtgtctttaaaaagcagtacagtaatgtcttctaaggtgtcacaatttttttattagataacaatgtgtttagtaatagtccatcattattcttaataatatgtttagtaatagtcatcattattctgtaagccaacttacttggaatagctactccctgtcctctctgaaccacagccattgctacaagatgggagaagtctgggagacaggatgtgatacatatgtgtgtgcatgtggctagaatgggcagctgccatgcatgagtttatttgttcattcattcaacaaacagtaagtgggcatcttctgcatacctggcactgtcctccgaagatcagtgaaggctgatgtctgtgtggttcataattggcagtaccttatcaagggcaggtgtcccagccatgttgctgaagaacacgcctcctcaaaacttagcagaggttaacacattcatgttgctcaccaatctgcaatgtgcacagggtgtgatgagtctgtttgcttccacatcatatcagccgggacagctcgaaggctggggatgaaatcacctgacagctggccccctcaccccatggctggccccctcacccgcctggtggttgaaaaaagctggatactggctgaggctgtcttgagcacctgcacgtgacctctccatgtggctgctcggcctcctcactgcacggtggtggctccatgattgagtatgcaagtgtccaggcagatgctataccacctcttaggattttgccttggaggttccacagcctcacttcctggtagttgtggtcccacccagattcaaagggaggagtgtgagcatcatgccatgcacagagcagggcgtgggataaaagctggtgcagccagcttaggagaatccaatctgccacagcagctcagaggctttcctgcaggccccatggtacagagttggctgctcctcagctgtgctgttgaaagatgtcagagtagtttagtaagaggagagctgacatgtggttctggacttagctggggagacaagaaatgctggtgtcacataacagttagggcaaattgtcctttgtgcctggggtatgtgtggctgttggggaccaggaggctgcacacccctttctctcaagcctttacacagctcagatgggaggctaagacctcagactctggagaaagaccaggccatttgctagttagtgggtgtaggtccctgaccttagccccagaaaacatctgcagaggctgagcctcttcactaatgctttggacacaatgccatttataattaaaactgattcatggtgatttttgtttctctactcacttaaccaaaaagagtgtagtgtgaccataaagtctgaaaagagatactattatttatcatctactataatatagtatcaataaaccatgcattgtgtggttccaggcttggtggccaccctgattattctcataacaacctttaaattagtgtccctgctttgtggatgtagaaactaagagaggaaaagattagccatcgccccagggtcatgtacagaccaccaggattcaacctcacttccgttaagtgttaaacttgtggtctgttcaatgagctagctgacaacagaaagaacattattataaaaaaagaaaatgcattgtctctccccatcaggaaaggctcccatgcccccaatgtgggaaccatctggccggtgtggtgctcactactgaggagttgtttaaatcgctcaaactttccacacttcactggggagggactcagtgaagtctttgatgtcacttatgctgtgtggggtccccagagatgaatttgactgtgaaccctatatgatgtctcaccaatctcttcctattgcacctgctattggcattcttctccccagactgcatagtatccctcactggaaacattcagggctcctcatctaaaagaagacccactatgccacccgcctttttccaaactgggaccaaagtgtctccctgaaaattcacaggtgctagtaatatggtcattgaaagctgttttctatgaaagtttagagacatgctaaacagcattcattttgaaggcaaggactcaatagatgaaaattcccatctgggtaccaaaagctctgcttttaaggtacccaatcatgagtattctgaagctcattaccatccatgaaggaagagggtatggaaaataactaagttctaaatgtctattcttcccattgtcactctagcattgcaaacaccctctcattggctgcctatctcctccacccacacccatattttaggtcaaagagtcccttctgtgaatcagagcaatgtatttctcatcttttctctttttcatgccaatcttgagcaagtcacagagctgactttgtgaaaccagctggcaattgttcgccatgaaaaccaatcatacactaacgctgagtgcctcaatcgcagtgaacgtggcagggcaccctcgtaatcaggccctgcatcaatacgcctggtgcctgtgggcagctcttgttctgtgtgggaaggcaggggcctcttccatctgctaggagctaaagtaatgactgtgtgcactgacacagcctcggctgcctctgtgtccatatgctgtgtattcatggcacgttaatgaagaaatcttctgtcttgcctggactaatgggggctggtgagaggcgtggaacacaagggaagctggggaaggtgttctatccaggaggtactggctgaccagagaagagagcattagggggtgatgccagagtccctacacttgagcccatttcgctaccagagcagctgtgcaatcttgggtgagtgaattgagctgatcctccagtccacaactacaaatgcagctttcaatagtcacttcctctcaaggaatttataaacatgaaagggatcacacgtgtgtgggatggtttgggaaagcagttgtaattagaagtgtgatgcaaacataatgtcaataacggctggcttaccgtttgccgaccaggtacatttgggagccattttaactgctgtatggcaggtaaactgcttctttacttggaggaacaaagctatacttgctcaacatacagcaatctttctagagcatgaggcctggatgtgatagaacttcctagaaagttccatctgtttcctttgtcacatactgaagtctatgcttgtaagaagagcaagtacaggaacctaaattccacactgcagtatgggtgctacactgggcagttaagtgctgtattaagctgccaaaatgttcatcagtagccttggctgtttccttttgattccgttttctaagcacctaattcagtcctcatgcccattgcgctgtctctgttacagcaatttccacaaaaccttgaaatcattttttgctggtctctcttttcccgtagactttccaggcctttcaggtagaatgagctgttgattgccagcgggtcagaaccctgtgagtgacaactgcaaccgtttacccttgctgcataacaaactaccacaaatcaagtagctcaaaacaacatgcatttaatagttcccatttctgttggtcagaggttgggcagatggctggattttctgcttggggtcttgcaaggtgtcagccggcctgtctgggaggaatctgcctccagggtcattgagttctcagctgaattcagccttgcagctccaggactgagctgttttccagctgatcccagtgaccactcttggcttctagagaccacgcccagcttcctgccatgtgggccatccatctccagtggagaaccccacccctgctgaattcacttcaagctacaacctgaccttcctggctgtgacctgcagacagattgaaagggttcctgtggccaggtcaggcctgctgggtaatctccccatcttacaaccaactcacctgagaccttcattacttctgcggaattccttcatggcccaacctcaattcatgtttcattaagtgactgagggaagatgagcaggactcttggtgccaacttagaattccatcagccacagcacacaaagtcacttcaagaagtatttgtaaagtgaagaaaaggcatcaagtcacatttttccctatgagaaacttagactgtaaggcatgtctttgcagtagcccaggatttccaaatgcaccccaggctaaggctgcctccactgaaatcacagttcccctttcaaatgcagattcctagacccaggggattctagtggcaagcaggctatctgccttctagcaggctactccttgggggcgtgtttccctctacagctcatctggaaatgactggaagcagcctttgcacctggagaccttgctagatgggcaatgaaaggcagtatttagaaaggaggctcccaggagggatcctcaagcccccagcaggcagcctgggcctggggctaccacagattaaggatgccgcccaaggaaacaaaggatccagggagagaaatgcagaaattagtaatcatccagaagaggagtaacaacagttgatacttacataataccttgctaataagcatgagcaactactcgtagaaaggcagcatgttccatctgtatcatagcattgtgagttaactgaagggggtcctagagttaccagtggacacagcatttagccagtcagcaaacattgctgagccaggtttggagagatgctcctgccctccacagctcacgactccccacagagacaggcgggtatacaaatgacagaggctaagggtccatatgtactgtcaccaaaccaaactcaggtcctcttgccctgtgcagcaaaaccaaacactgacatcaggactgcagcaacagaaacccaggcatttatggcagaacaccacgcaaggagaatcaggcagctcaggcttgagaccaaagctgcccttgcagttaagtgtttttaaaggaggggaggcagaggtcacaggccaagtcatcaatcaatgaccaaaaaaggcagaacatctccaagtgggggtccacaggttgtaggtagagttaaagattttctgatttgcgataggttaaggaaggaacatttgtctagactgggggtcagcagaaaagagtgttagctctggcctgtgggcatgacctccaggctcctcaagaagaaactgagagcaaggaaaggcaggcagacctcactcctcagtcccccttatatggggtccacgtaccagcaggtccatttgttggggggtgtggttttctgaaaaacaactcagggtcatatgttaacatggtatcccctgtgactttaacttccttggctattgttttaagctactgttgccttcttgcttatcaagttgctcatttacttgtcagagctagctgggtgtctggaatttcccttgaaggcactcaagattttcctttatttccgcacttaggagctgggggatggccccccctaagaggggtccctgctgtgtctcggcactgacggcaatgtgtacaaagcaacaagtggttctgctgcatccaaaggaaacctggaaaagtgtaaaggccaggttacatttgagcccaggttttccatttctttagccatgttggccacatcttcactgggtggccagtgtttcaacagccaaagtggacatcaccgcccacatctgagacccctgcccccaggggggctggtccgtactcagctacctaataggaccggaggctgggcttcctggggctgaggtcctgttaggtaggtcattactaataattcttgcccactcaaaggacttaatatacacctagtgagctgaaatattactgacacaaactcatatcttactctgattgctagtggcccccttccctcttcctacccactcccaagaatgtagccagactgggtgttcctcatctgggctgggtgtgaaagggggaggatttcttctcctgagctgaagcagcagtttccaggcacccaaaagacaaccaccccttctttttgttttctagaagaccactgcagtgtagaccagacaggagggaagtttagagctccccaagactggaaagatggctgtagcatgtggggctcagattgggcacctgctcttcagggctgcctccagcactgacaaagtggacagtagagctatcaaggaccccggcatagactttaactacatggtctgcatgctctagtgcagtcctacccaaggcaagttcaagagctccttcaagcggagggcaggaagcctgtgattaaggacctgtctccatcctctatgagcagcccccctcccaactccccatcccccgcctgcggcatgcaacggtaatgagcagcggagactactagagctgtcagtgccttagagaagctgggctcccttgaatggtggagccgcagggtcagcgtgtttgccacttctgtgaagtctgtgtttgtcgtgggagtcaggaatgagagcagagctgccaccagactcagcaacacctcctgcaccatgagccacttgtcctccctgccctcgagcaactttagcaatgttggcatcatggagaggctcgggacgacagtctacaccatcctgccctccagaagactttgtggctaactgtggcaaggtggacatggagctgctcaaatgccaaggcagcaggcaaggccctccctgaactgagtgggatgctcactggcacagctttctgtgcccccactgagctgacctgcctgtctggagaaatataccaaacacagtgacaccaagaaggtggcccagtgggtgtcagagacccctactaagactcttgcttccctaagaacaggttgttttctgggacttgaatggtggcacacacccactcccccagccttggtcttgggctggcactgctctcaatgatccctttatccagcccattccctcgcatgataatgcatttggccacagcagcctctttgtggacctcacagttctcatggcctccaggatgcaagagccctggaccaccagccccaggagtggtatgaaaggaagagagaggccttcagccactgagagtcctggcctctagcggctccacttcccaacaattgatggtctcccattctgcactaggctctctcatcaggcccctgaggcagtggtggggcttccagagccctgccgtgccctgcaccatcagtgctgtctgtgctgacctctctagcctgcgcagcgggaaagcagtgaagcagcatactccgatgtcgaggagggagtgggcacgcacttgagagtaactgcgagctgcccctggcgtcacatcacattgtcaagttcatgttttcagctgcagtgaaaaagaaggaacttcttgcagggaactcaactaaattgtctttaaatgactaaaccctagggaggacaactgctatttggtcatgcattttccatgtggatttccatacactgtgactcccaagaggggattttctgccacatgtattgttggtctttttattttgggttttgctctatctggaaggattaacaagaacaacattaagtcccacacgaatccctttgcccctgtagcaagaatgaccttgaggaggccagcccttcctagctcaggaagcggctttgtgggagatgagtctcaattgccaggaccccccagggccaggtgtcctccactcaggcaggctgcctctcctccttgtcccagcagccctcacattcacttcctgtctttccatccaagctgctgcccttgacttcagccctcctctcacctcttaccccaaacctctcatctccactctt

SEQ ID NO: 910 - DNA, 261809 bp, Homo sapiens
cactcctctcataatacaaagtatgtaatctgtcatgcagaacctgtgacacactgccaggcaaggagcatgagtctctggctcttgctccacgcgtgcagaaaaggcagttctaaaatctctgtgtgtacattaatgcccatgatggcaagtggcatggtgttagggaaaaatgcaccatgtgtgtttgcgtggcctaatggctgtgtattctaggggacgtggggacactgggtattttttggcaaggcctctttatgttccatcattcttttgtgacaaccaggacaaagaacatgattcctgctgatcaacgataaagctgaggcctacaggggtgaggcagcttgcctgagctagtgttccctgcacctacctggatgtacttcatgaagcggtggcacttcccacagcgtgagaggggcttgcctgtggccgccaggggcgagaaagacacctccatcaactcatccatgcctgcgggcaagcagagtgcaggagtcatctccctcccagtccccagcaaaaggctccgcaacacgtggtcaagggtctgagtgtgaaagggtccctataggcggtggtttctactgtcctggcagcacggcagggcagcagccctgtgcgtcagaggcacgtgttcctggccatgtgtggtgttaatgcacctgctctttcaacccagccaggaggtgtcactgacctggcctacggaggcctgaagcccagatctgggagctggtcccacgtggggacctgggtccccaggtactggccttgctgacagagagacacccctctggtgaggggcaggccagaggcagactctaccagcaatggagtcgacaaagtagtggaacttcctcttgaacacgtccagggtgtggcccaggacctggcggtagtcggccttgccctgggcgatcaggttcagctgcttctccactgcactgcggatggtggggagcaccagctctgcatctgcaagtgggcagggggcagatattgccctgagcactcgcacccagggccatgccaccccttcccaggcagggatactgccctgttcacccctcccgctctggcccgtcctcctggcctctgccctacccaccagtccacagcctcagatggtaccaggctggctcttatgaccccagacctttcctgatttcccacctggaaatgtcaggcagagtggccagggatgtcctgtggctagaaccacatcacacatgagctccaggccgcccttgggccagttttgtgctcctccctctccccttggcccctggggaacctccagggaacagggctgaggcaacttcgcctccctttttggttccctcacacatctgttcagccttcaaacacactgagctcctgctctgggcaggtcctgggggtcctggggcagcaccccttcagcgggtgttgagggagtgtgtgtggggctgggggatcactgtagggcaggggcctgtctggagcgggcagcagagccaacatccagggagaagccagggagcctcggtgggccctgggggcaggactgaggaactcaccaatcttatagtagccgtgcaccaggacgatgccgaggttggtgggcttgagccggcgcccgctctccaccgtgacatagttgcgctggcagatgttgttgatatgcacagggatgctggcatccgtgcctgcaatgtacaaggccccagggttcctggcctgccttggacatgccccactgaaccatgtgctgtatcacctgtcacggggcccctggtgctcaggccctctcactgctcccggtcacaggagggagggctgtgccctgagctccccctgcactgtgctgggcaccaactgcatgcatttcatgttctgccttgagaacacaagggcagccctccctgtacagggcgcctactcctgctttatggcagagacaacaggctcggaggttaaggaactctccaaggtcacagtgcttattctgcgcctggaaaatgtgacttctatggcttctcctgcctgggtcctgtggcacccacctgctcccggagccagagccccactccaccagaacacggaggtgcttacaagctcactgcagagctgccctcccctaaacctggacaattctgtccacttcctgtctcccacctcctccctctctgcaaggcccgtcacgatccccaggggaggctcccagtccccaggattccactctcccacccagaggaagtttcctggcagaggggcgcagcggaggctgaggcgttttgactatggcgggtgccagtcagaggggcagaaaggaggctggggctccctgcatgctcaccagcatggacaggtgacacacaccttcccaaagtagctcggagagaatctcacatgggaagaaactggcctctgggggctaaggagcctgccgagggcccatggctcttggcacgaggccagctctgcacccggtgtggcaggctgtgggtggcgtgtgccactaccaccccgagtctgccgggcgccatgacgcgtggtgtgggctcctctgtggcggctctggtcaggcccttttgacacactcctgggggctcagtcacagggccaccctgaccactctcctgttcagaaggtaacaccagagccctcttcactgtcacaaacttgtattggtgattgggtctggctcactggctagcatagggctgccaggagccagtgtcccatcaatgcgagagggcagaggacacgggggagcagagcccacactccacagtgggctgagggctatttcaggaccctggcaggtgccctggacccctgagaggagcaagcccagagctctgctctcctgccaagatcgccatggtcaccaggaccccagcctgggaagagacactccctgagagtccacctatatgaccactgctggagcagagcctggacacagtggctgtgacatcccacaggtctccagagcctgtcagccaggggtagtgccccagggaacaggcagtgcccagcggcgcgagtgccacctggggagaaggctccggcagtgaggctggcccccaacatgtgagacatctcacagctccaggcctggggacttgtgaggccaccactcctgtgaggagtgtgcactggtgactacacttttgctttgataaactccctgggctgcccatttttgcgtggaaacttcctggtcaccctttggggagccctgtgcctgggacaggcatttctgttctctcccagggaagcagctcctgtgagatctcatttccctgtcacctgatttcaggacagcccaggctggctgtgtggactcaggggactgccaatatgatttctatgagtcacctggcatctgggccaatcttcagccttgtgggcgttagtcggtgtgtgcacaccccacagtgcacgagggcacatctgggccttcacagggaaggccaggtcctgaatggaggcctcaggaggggatgcccgctgtggacctgcctggctggccacacactgggtcaccagtttccagataccagcccatggaggggtgctgggctgggcacacagggctggcggggcagctttgtgagtagactcgaagcctgagtactggagacggagccggctctggggcctgggcaggcgcacccaccgatgccatgcttctccatgagcgtgatgagctcggcctccgtcaggtagtcgggtgggttcgtctgcttctccagcatcttcacctcgcccacagggaaggcatcaccccgctggcaagtgggcaggctctcctccaggggcacgctctgccagggcatgacctccgtgaagcctggagagatatgcgccgccactcagggtccccagcctgggtggccggggcctcagaccctgggcctcccatccccagacacgatgtagaatgtttgtctgcccatgaaggcacagaggaggaaggctgggcccgtggtgtgacctggtgagaggacggtcttcccggagcaggtgaagagctcgggcccaattctgaaggagatggtgctctgcaggtacttgcagtcatggctgaccgtggcgatgaagtgtctggtgatgtactcatagagccgccacgcgtcaccccctgcaacaggccagggctagtcagttgggagccagctgggggctctggccgtgaggagcccccagtactctcgctcgagcagcaagctcctgcttacagagccgctgtgcaggacacactgcaaatcctggggaaggaggaaagaaaatgtgcaggaaggccgggcgtggtggctcatgcctgtaatcctagcactctgggaggctaaggtggatggatcacttgaggtcaggagtttgagaccagcctggccaacatggtgaaaccccgtctctactaaaaatacaaagaaattagctgggtgtggtggtgggagcctgtaatcccagctactcggggggctgaggcagggtgaactgcttgaacctgggaggcagaggttgcagtgagccgagatcgggccactgcactccagcctgggtgacagaacaagactctgtctcaaaaaaagaaaaaaaaaaagcaaatgcggaggaagggaacacaagcctccatgcctcagtggtttctttctggctgcggctcccaccatcctgcacaacctcctgtccctgcttctggcgggactgctcttcaggcattggcctgtctttccattgtctcgtgacatgacaccattgcttcaaactcagactgtccacaggtggctcctgtctctacctgcactgctctcccttcctcatttgccttctcctggcactcggaccactggtaccaccttaggccagctgggaggtaggaggtgtgctgccccctcccccacaccgccactctctaccctggtttcattcatgtcccctgtggcgtctgcccccttgcctccctgcaacagcacctgctgctacctcttcactcctgtcctggtcccatagcaatggagctcatcttccaggtggccccccatccccacagccagggcaggcagaggctgaaggagcccccacattgccaacagggcctgcaaccttcactgtcgcagctcgcccttccctccctggaagcacaccgggtatgggatgagagcggtacctaattcggcctctgtggcagacttcatgggggtgatggggggatggtcgccggcgtcatggcctttccgcgggcggttgataccttctgctaacaaccgcttcacctgagggagagaagacagagcagagtctgtggctgggctcggctgcctgcctgggtttggctgacgtaccagacctggtcccaaggcctcagtgacacacacacatgctgaggccggcccggctccactcaccgtgtcggcccagtaggggtggttggcctgctgccgcagagagcccttcaggtcaaagttctcagggtagtgggtggtctctgtccgtgggtagctgatgtagccttgcgtgtagagccgctcagccgtctgcatggcgtgctgcggccccatgcctgcgagagacaggaggttctcagagggccaggtacgtggggatggccagctgcctgccctggcctatgcactcaggctcccccattgtggccggcccctcctggagggtgacggtggctctgagcaggcacagctggagtgcaaagctgctggccgggtgggcacctatgccacacagtcttgtatgaggctgaatcccgcacccgtaaggctgaatcctacacccaggatgggcctgatgggaaacgccactcactctaccccacggtgcatcctcatggggctcatggccatggggatgacacatggccttcagagcaccactccccatgcattgtccatggagccataaccatacctcggggttggctgacgacagagttagcacgcagccccattttgagcccttgggtgtttctgtcctcacagcactttggggccactcaggggggctcgtcctgctactccctgaccagcagaggcaggcgcttagctagcaaccactcccagcattgctgccctctgaggacgctggagccaccactcagtgtccactgagaggacactgcccatagttccctgcgggggtggggggcaccaatgcctaggggctgacagctgccagagaccaccagctttccagcccaaccccctcctcgttactaaggagaaaagactgaggagatgaggctgaggggcgacgttcacactggttccctgaaggtgacatctggctggggcctctcccctcaccagggatagctgctcagggactctaacatcaggaggtcccctcaggtggtgaccaactttaccacctttacaacctaaggataagtgaaatcctcctgaggctcagatccccttgaagccttgggcaccatcctgcaaccctgggcactcgctgctccaggctgaacctgcctcaggaagccttctggtgacttgagagaaatgtccctacatacccagagaagagctggccacacgcagcatctccacagtgttcagggccaggggcctctgcttggccttttctttcctgcttgtggcctccacctggaagacaggacagtcaatgatttggggaaggaggaagacaccaccatagagggaatcaagatgtgtggacgaagggtctggtttcattcatctggtctccctgtttctccaattcattcttcccaacagtctaaagacttgattgaatatttattcaggaccaggaaaggaaaaagaatgaaaattcttttttaaaaaaaaattttggctgggtgtggtggctcacgcctgtaatcccagtactttgggaggctgaggcgggtggatcacctgaggtcaggagttcgagaccagcttgaccaagatggtgaaaccccgtctctactaaaaatacaaacattagctgggcatggtggaacgtgcctgtaatccaagctactcgtgacgctgaggcagaattgcttgaacctgggaggtgaaggttgcagtgagctgagaccacgccattgtaatccagcctgggtgacagagcaagactccatctcaaaacaaacaaacaaacaaacaaaaaaccaaattttgttttttttaagagacagggtcctgctctgtcgcccaggctggagtgcagtggcaccatcagagcttactgtagccctgaactcctgggacaagtgatcctcctgcctcagcctcctgtgtagctgaaaccacaggcacacaccatcatgtctgaccaattttttttttcaatttcttgtacagacagggtcttgctatgttgcccaggctagtcttaaatgaactcctggcctcaagtaatcctctcgcctcagcttctcaaagtgctaggattacaggcacgtgccaccatgcccgtctactttttaaattatttttttcagagacagggtctccctgtgttgtccaggctggtctcaaactcctggcctcaagtgattgaatattcttttctggagaattttctagggaaagagaaaacctggaagattgaggaggagtcagaagggctgcagatggaaatcctacagaagccagcatcagccaagctacagggatggcaagtggggcccgtcccaggggaagtaccactccttgttgtggggagggctgctgcctgcacctgctagtattgctacctcttctgatttttcaagagaagctagaaggcagaattttagtatgaaatctcgtaatttttaagtgctggtaactattctggaatttgtgtaaacaccatgcaggttagtggagtgcatctatgagctgtgctttgttggggtcctgccactctctacctctgctgaacacttgtcggaagagacaactctttgttttgcctatggcaaaaacaatccaaacaactcaaccccaggccctggcccttgccaatcccacgtaggctggtcagggcagtgccttctgcattccagacagacagatgtgggtgctaacagaggccagttgttatgtgaagctgggctccccagcgtgaggcctggaggtggcaacagtgtctctgcaggaatgtgatcaatgctgacagcctggagcagctttagaagtttcagatgcctgagacgatagcatggcgggcaacagggcactcaaggaaggccagagaaggacaaggagaaggcggctaaggaggccaggctgtgtctcgacggatctggtagctgtcatgcctgtagcatgtttacttcaatagccacagatgtgtccccaacccatgcagccaggtcacctcaccgttttcctaacagccaagcagcatgtcctttcaattcatagaagccctgagtaagaaacataatcccataaaagcacgcaagctgattgcaattggaatctcaagactttcccctgctagctgtgaccttgggcaagttcatcagtgtgcaccaaggtccctctacagttgttagtttgaatctctgtgtgaaatggagtcctgccacacggaggtaatgcctagcgggtcacgtggaaaggggagagtggaaggggtccgacaaggtcacaggtgtggacagtgcctggtatggagcgggcatgcagtacactgtgactattgcactgggcagaaatatcttaggagtatatgagggagtaaccattcagctttccaaaaagatgtctgtgtttcagaaagggggagaaagacgtggactaggatcacaggctgttcctccagcgggaggcatccaagggccaccctcacccaaggcaactgtgatagatgtgggtggagcaggcacacctgggcttccttctccagctttgtcatgtttaaaaacatctgtgcgatctcccggtcaaacactcttactcggtcccagtccaaaaggagagatctgtctttgtcagtgttaacctgcaggaaaaaggataaagggtgaacgcacaagaaaaagtctccaggtgagcccaacgccaggaagaaccaggacagatgaagctggtccttgtctgggagccaaatagccctggctgtaatggctcacagctgtacctgttcaggtgggcagatacgcaagctgacatctggccctctccaccacttgccccaaaaccaggcagccagtctcaggaaggtggcccaaagctgaggctgatgtgtccctaagaagcacctgagcccctacttctcacaccacccctgcctatccccagtgcctggccagtggtaggtatggccaccgccagggtcccaagccccgtgtcagccacagcagctccaagacagtgtctcactgtgttgctaggctggagtgcagtggcacgatcgtagctcactgtagccttggactcctggcctcaagcaatcctcttgcctcagcctcccaggttgttgggattacagacatcagtcactgtgcctagctgtattaagtcttacagtgagcttctgtggaggcttttatttgaagaaagggttctaggaattttaaaaagtttgaaagccaatggtctcagtccagtgcttggacctgaccactgaagccactgattcctgtggggtgacctcaccctgcactgccagagctgaactcattcccacttatccagattcagcatatacaggcccagtctcttcccactgcccccatgaaggctggggtccctcagccctaggcaccacagaccacttccaggtacagccgtccacacttctgccctcagcccggggcctgccggctgatgatgatggaagactctcagaatccatgccccaaacccagaaagccccagcatgaatagagaaaggcaaggaaccttggcctgcagcacccagtaggtctctggtttgaaggactggattttatcatgtctctccacacagaatcccagggttggagtctgacacggcccaaaggagatgagagagctgtctaaatcaccgtatttcccctggaaatatttagtctgaaacctggagggagtggaaagatattttggtcactgattcactcaagacactattatggccacccatgtgagtccagcccaaggccaggggtggtgcatgaaggaggtggcatcaggtggtgtccccacttagaagccagtgggagcagagtgggcatagccttagggaggattcatgtgtgtacatgggtgacagagccagtgagagaggagacagaggtttctactgtctcaggccagggagccttctattctattccatctactgcacactctcctcaggacccccagagcacagacaaacacactttatcaagcagggcatatgtgatctctgtcagctaaataaacaattttctttaggtctcttttgtttttgtagagacagggtcttgctgtattgcccagcaggagtgcattaatggggattcacagatcattgcagccttgaactcctgggctcaagtgatcctcccacctcagcctcccaagtaactgggactacaggctcacaccaccacacccagctaattaaaacaaaatgtttggacaggcacagtggctcatacctgtaatcccagcattttgggaagctgaggtgggcggatcacctgaggtcaggagttcgagaccagcctggccaacatggtgaaaccccgtctctactaaaagtataaaaattagccgggagtggtggcaggagcctgtaatcccagctagttgggaggctgaggcatgagaatcacttgaacccaggaggcagaggttgcagtgagctgagattgtgccactgcactccagcctggatgacagagtaagactctgtctcaaaaaacaaacaaacaaaaaaataaataaatttttgtttagcctgggcgcagtggctcacatgtgtaatcccagcactttgggaagccaaggtgggcagattgcttgagctcaggagtttgagaccagcctgggcaatacagtaaaaccctgtctctacaaaatgcataaaaattagccaggcatagtggtgcacacctgtagcacctgtagtggaaggctcaggtaggaggatctcttgagcctgggaggcagaggttgcagtgagctgagattgtaccactgcattccagcctaggcaacagaacaagactctgtctcaaaaaaataattttttttttttttttttttgtagagatggggtcttgttatgctgcccaggctggtctcaaactgccaacctcaagcaatcctcctatcctggtctcccaaagtgcagggattacaggtgttagccactgtgcctggccttcttcagggttggtgaaatcccctgttgctcatcctggctcgaggaggcctaggggccccggagggggaccagtagaggcaggtctctggctgagggagagtgagggtgtgcccaggactctgcgggtgtggccagcacctggtgaatgcacagccgattcgcaggtccagctcctggcgagcatccactgagagcgcctcgttgtggtcaggctcgcctaggcaggccatggcattacagatgtctgtgtccgtgatggagctaaacctggcccggaacacggtcttctcgccaccatgggccttgttcatgacgggcagaacagcatcaagaacctgggggtggggagtggccagctgtgacccacctcccagatccctgccacagctccccaccccactgtgaagcctggttccttccaggaaagaacacgtgtgctcggctccctctcctgcccctgccagaccctcctctatcccctttcctgcacctgccagaccctcctctatccccctgcctttccagaagccctgagcactccacaacaccccaccacatggcttcctttactcccatctagaaacatactcgaacactcccttcttactcccgccctctcttctaatcctctgctttcatccccaccaaatcaggaaatgctactgccaagtacatgagggacctcttagtccccaaacccatcccatgtgacacgattccctgccttctaggagggagggtttggaggggtgggtggaaattttaagaggctgaagaaaagacagggaaggaaaaaagaatgaaggggaaaggaaatgggcaagagcaggaaggccacgggtggtcctagcttgtggtgggggcagctcgggctaaagcacagcaggggtcctggagccgagactcactaggaaggccgtgcagtgggactagggtcgccgccggagcctggccacgcagcttccttactgggaataagtggcttcatttctgaagggagaaagccccatgagctgcccccattctccattcccagatgcaaaggcccccagggaggagccgccctgcaggggaggagagggtatctgggaagagacagagtgtgatcgcatttgctgagggtgctgtactgcaacgccaggtgcctcagctctgtctcactgaccagctcttgagccacgggtgagagctgggggtacaggagcacgggggcgacccatagaacaacagtctgaagggcaccaagtgagaccagcagtcatggccactgtgagggcaccatggccggggcaagcatggggcatggggtgtgcacagggagcagctgccacctgcttctctgcagggctcccagggttggctggaggcaggaggcatcctggatgaggcaggagatgagcagagcgaggcctgcaaaaggagctcagtgctgaggtcgggaatcaaccagcatcaacccaaggtccctgagaagtcacgctgggcacaagatgctgaacaccaagctgccccaagacaatcccattctgaaacctgcatccacccagacaatttggcccctcctatgttcactcataccgttgaggcctcagcaagcggaggaacaactgaccacctttaatagagcctatgcagttaaaagtatctgtggagtttcagaataaagggaggggagaggtgtttttaaaccggtacagtttactccctcctttggccccaggagtgatgtgactgactgctggtgtcagtttggggctggtgtcagaaaggccaaaagtgaggaacaaagtgagcctcacactcacctcaaagcagatgttctccccctccttgtcgcagtccagccacagcacgatgtagtcgcagcctctgccctccacctgccacacagcacaggttcacacgtacctgctgcagacccggtctgtgccacccgcccccagtgctcccatccaggacagggcttggtcccaggccctgaacctcagttaggaggactggtacctgggctgggtaaggagctggctgtgttgaggctggctcagccaacagaaaagaattgagtttataattgatgttttttggaccaaaaaaaaaagtataaatgcaacatgatcttataccccaaaactgcccagaagaagggttaaaatgaaataaccctaaatgataacagcagtcgtcttgggtaatatgattatgcataatttttctgtctttctacttatctgcactttctaattttccataatctgtatgcatttgttttaaaattaaggagaaaaaccccccgaccaaacaagctattttaaaagcagaaggcctgctctccaggactgagggttggcaatggcaactgccttgtgtgttgggggtgcctgcaggtgcctcgtgggccagcagggggcactcacagaaaaagctagcaaaggcccccctgtccaagggggattaggactcaagcaagggtgggcaaagacatggcagctgtggagggtggggagccccggtgtgctcatgcccaggccagccccacgcacctgcaggaacttcaccatgttcagcttggggttagcttctttcttctccgtgggagcttggctgaacagttctgcggggtccactttgtcccatttgttgtattttcctacaaaccagtcacagtgacattgagtcacaggagctcagcctccgagaccatcataaccccaggaggatgttggcctcatcccacaaatgaggaggggaaagcttggagaacaatttgcccagggtcatcctgatgatcagaggcagagccaggatgtgggttcaggcctttggtaaccccctcccatccagcctcctttctgctcggctgctgagcggacccaccacaccccggccaaccacaggagccaagcaagctctcggggggctgccactctggcctcacttccgggactttccctgtggctgggagcaccattcctgggctgggtctctttgcctgagcactggaccccacaatggtgccttcattgacacttccaacctgagtttctggaactttgtccttccacccagcactctgtgggggcacacatgtgtgcagtcgttcctgttaaaggaccatctttttgagcctcatgcccagcacattcacctactcatctacagagacccggttcttgcatgctcagctgtctggctttcttttaggccccatttctttttttttctgagacaggggtctcgctctatcacccaggatgaagtacagtgatacgatcacggctaactgcagtctcgacctcccagcctcagtccatcttcccacctcagcctcccaagactacaggtgcgcaccaccatgccagctgatttaaaaagaattttgtttttttttttttttgtagagacaggggtctcactatgttgtccagactagtcttgaactcctgggctcaagcgatcctccccaggccccatttcttgcatcctgggagaatggggtcagacagagccaaattcaaatcccggctccccacctgccagttggagataaaacttggggtccaaatgctcagccacacaactcagtcaccatcattgtcatcactgtcatcaatgagcagcaagaacaagggctgaggctttgctgtgtgtcgggccctgtgctgagtgctttgccctcactgtcacactgaatccttagccttgggaagcagatggcattgctgtgagacccatttcactatgagaagtgtaaactcagaggccgtcattgcccacatccccagccagtgagccggcagagcagggggaaaagcctggatcagactcttgccaaccacatggccccaaacctacacccagcaggtcactaatactggcgcttccaaggtaattgataacagtaacaatataggaatgacaacgacagccaccaaatgaccgacagatgacggtcaacttggcaacagcagcagccttctcttaaatgcctgcacaggtcaagcccttcctaagataggtgctgccactttgtctacataggaaggcacacagggaatgcagcgactaaggggtgccgctatgatggggacccagggctgagttccagagcctgggttctgggcaccgcaccagggaccctctcattgctacttcatgatctgctggccttatgactcatggagttgggacaaacttccctgcctagaggcatctcctggcttcaactggaccctggccagtgccatgcagaactcccttcagtaggatggagggtagaggggcttacccaggaaatccagggtcatcacgtgaccacagacagacgtcatcttgaagcgcactggctggccagcaaaggtcccagtgtactcgtggactgagcaggccccgttcagccctttgtgtgaggacaggctccctggggatgaggaagcacaaagtgactggctgcttcagctgagctgaagaccctgtggagaccccagcccggatgccacctcccagagggccagagtcctccttccccagagtggtgagtgacgacattccgcagactggtgcgggtagttgggcactgagaggtgggacggcgctcagggaaaacagcatctgccaacaacctagcacagagcactctcgatgcagagccccaggctgccgggagccaggagcaggcaggggtgggctctttctctgtatttatgttttcactcttcaattccatttttgcctcacttcattgaaacgttattcatcgtttactaaaacagactccagatctactctcggttaccagggaccttctaattatcgaattctcaccctctccactgaccatactcagctgtactttctcagcttctgggcaccgggcaccacttttggggcaccgtcccctgcggaccatgccttctcagctgaacgagggtctcttcccctctcaactgctggaccaaggggaggccaggtaggtgcctgtcatttctgggtacccagcatctaaaactcttcctatttggagggaattcaaagatagggggaaacagcaccctaccaaccaccccagtggccagagttgggggtgagtggcagacattccctctcgagctccctggtgtctcagtagtgcctgtggccatagctcagtccattggctactctggagtgacgtgaggtccacaggacagtgggagtatccaggggtgacaatgcctggggcatagcctcatcagaccttgactggggtgtagtcctggctgcgtctccttccttccagggctggtttctactacctgtacctaatagccccaccaggcccagcatatggataatgactgtccttcaatttcattgtaaattgtgccttgtgccttatgggaaccccagctttggcacattgccaggagtggaagcaaatgcaccccactgtgacatactgagatgcttcattaccacctgccgacccgaaccaaatctaccccagccagggtggaatcacattaggaaaaaatgtcctgtaacacataaacgaccgtgcttacagaccaaagcagggctggtctctcctacctctagagaggattttggcaattgactgtgccaaggacggcttttcagcaaccatgagcacagtcttcattttgtctcggtccttcacactccagtttcggggcactggcaatgaaaaagtttagactccactcttccgcagcacagcactattaccaatgctgactcctaaagagaagaaaagacactcaggatagcaatgctgtcaatagaacctacaccactacaaggaaaatcactttaacaaagaaaaaacaagaccaacctgaggcaagaagaagaaaaattagggaattagggaaacttgaagacatctgagattaaaaacaagaaaaaactaccaggtcagctgaagtggctgagatgatcctgggaatgtggctccatttgggggaaggtgaagtggccccagtgatctcaggtcaattttattcctaaatccatgctaggaagatgctggggcctggggatctggagtgatgggtcaggccaggtggatgcctggccctcctctctggactggctcttccacctacaggtggactcacctggaaagaggaactatcgtggccgagagcagcacctcccgctcagcaaagcacttggacgccccaggacactttacaaaatgcagatgcccaggctgggccccccaggtccttctgatccatgatgggcctgagaccctctggctagtcggtccagccccaagcagacatcaggactctgtcacatctatctcccacctattccactccaccttttgctttgcaggtcatgctctggccaaattaaatcaaatatcatcatcgaagcaaacacgcacttgaagcctctgtgcctgcgcttccctgcctgagagaaagctccgccaggcctggaggatgcagctggatggcccacaggcccagctcaagtctcccaacaccactggcagggtaagtcagccctcctgtgcccacagctcttgggctaggtctccattccaacccactcacatcatgccatcatcagcgactacttcacccccaaaataggacacgatgggctttgtgtctgaatcactgttggtctttgcaacagctttctgtgcctgacacatgacattcaatacctgctagccaagtaaaagaaaaccacatgaaccctttttgttttttcagtcattataaatgtagcactgatgtttataaacatagcaccgtattaaaaaagaaaaaaaagactcgtattgagacaactgggaaatctgctgtgaaaaaaaataaagttagactcctgcttcctaaatcccactaaaaccgattccagatctagcaaaggtttgagtagaaacaatgaaaccagaaaatattaggaaaaacatgtgcttttaaaataaatctcacaagccaggtgtggtagcacatgcctatagtgtcagccactcaggaggctgaggcaagaggatcgcttgcttgaggccaggaattcaaggctgttgtgtgccatgactgcacctgtggatagaacagccacttcactccagcctaggtgacagcaagaccctgtctcaaaaaaagtaaaagcaaaataaaataatctcagcataaagaaaaactaccacctagatgggcacagtggctcacgcctgtatcccagcactttgggaggctgaggtgggtggaccacttgaggtcaggagttcaagaccagcctggccaacatggcaaaaccccatctctaataaaaatacaaaaattagctgggtgtggtggtgggtgcctataatcccagctgcttgggaggctgaggcatgagaatcgctcgaactcaggaagtggaggttgcagtgagccgagatcatgctattgcactccagcttgtacaacagagcgagactccatctcaaacaaaaaaaaaaaaaaaaaaaaaagggaaaaccaccacgtaagtacctttgtggtatcacatcatgtccaacaacactcgcagaagaaactcagaactacaatgagcttgtgcttatcacatagggagagactcaaagtcgttgcacacacagcagatgagggcatggggaagttaaatgggaacaacctctatgtgcagcaattcagggatccctctcaaagtccgagtgcacatcccagcaattccactccttggaatgaacttaatagtccagttatttattgagtacctactgcatgcttggcctagtccaggatgcagggaatacagcacaaagcaacaccaggtcctgccctcccagaactcatgctgtagtatgggagcaggggagggacagggcagggctgggtgacacctgggagaagagtccaggcagaaggagcagggaaggtgaggtccttggggaggatatggctgggcaggggggctcatggggctgagggagggagcaggggtgtagaatgtgggtctgctctaggggtgctgggaggcagcagagggtttgcataggtgtgggataatctgacttcaagtgttaaagggacctctctggctgccacatagaagaggatgaatgggccctgggtagcagtggtggaggatgcgagggaagtcagaatccaggcagacctgggatggcgggacatgggagggggaggggaaggtgagtcaagaatgacctgaggcagagctgggcatgggctcacacctgccatgggctcacacctataatcctagtgctttgggaggcgaaggcaagaggaccacttgaggccaggagtttgagaagagcctgattaacacaatgagacctcatctttacaaaaaagcaaaaggaacaacccatggctttggcttaggcatgacaggaagggactggcagtctgatgtgggacttcaggtgtgttaaacgggacctgcccattggacagcctgggtggcctggaggaggtggcagcaatgtggaaggagcccaggctgggggtcgggagatgaggagctagcagggtgagtcaggaggggtaaggtcctgaaagccacaggaaagagcacttcagggcagttatcaccatgtgggggacactgacaggccaggcgagatggcagctgagacctgactgtagggtctggcaaacagagccctgggtaatcctgatggggccatgtggtgagtgacagatgaaagctgcatggggtgagctcaacaaaacctgggagatgggagaaggctggtgcactgtcccctcttgtttcaggatggtggctgtgccagcatgttctccgctgatgggactgctctggcgagaaggaaaagagaagctgcgtgccggaggggaaggaactgctgcagtgatggccttgggagggtgaggggcaagagaggcagccggtcagcatccaggcgatgcagagctgccacaaggctgcacttctcttggtggaggaggaggcatggtacggctgtccactgagggaggacaggtggtgatgctgcgggcaggcccacagcagaggaagcactggatttagttagatgggagagtccaggtgagtaggagggagagggagtgggtcagggttcgaggggagagattacaaggacagaacctgactctgagttgggtgaagagggaggtgagggttggggagggtccacagagggtgtgctctgtggggtccaggaagtgaggcacaagagcaggaagtgggagtcaaagaagcaactcccagagggtgggaggctcaaacaggaattacagaggggcctgggtggtggcatgctgacccagggagggcaagggctgtgagacaggtagagagtgaagtcacctggggagactcacaggagtcagtggtgggccctgacaagactgtccatgtggactctgagtccccaggaggtaggacagggcagcgctggagtggcctcaggctgggcacggtggtgcctgtgatgaaccacatcactggggagttctctgcagcattatcaatcatgataaaaggttagaaacaagctggtgtctgtcaacagggaggtggttaaataaaagcatggcattctctggccgggcgcggtggctcacgcctgtaatcccagcactttgggaggccaaggtgggcagatcacgaggtcaggagatcaagaccatcctgactaacgtggtgaaaccccgtctctactaaaaatactaaaaattagctgggcatggtggcaggcgcctgtagtcccagctactcgggaggctgaggcaggagaatggtgtgaacccgggaagcggagaatggtgtgaacccgggaagcggagcttgcagtgagccgagattgcgccactgcactccagcctgggcgacagagtgagactccatctccaaaaaaaaaaaaaaaaaaaaaaagcatggcattctctacagtagagcacctggcagcattacaaaggaaagcatctgcttggtacatactaacgtggatcagatcactgaaataaatcatgctaagaaagctgggcatgtaacggtgtgtagagagcactgccatctgtgatcacacatatgtgtgcacacgtgtgcacttgattatgaagaggcgatatgtctggatggaacgcaaaacaaacagtccaagcaatcacctggagtgggtgttagggcctggaggtcagggctgggggtgcctcctcaccacattcccttttgcaccttttacatttagcgcctggacacaggtgactgagggacaagaactaagacaagggactttacaataaaaccagaaaaataaaggagggttgtaaagggcattgttcagaaaggatgccaaaggaactccctcactaaaggggcttctgctgctcatcatgctgtgcaggggaagaggtccaaggtcggccttgggctgtcaaccttgttccccacttaagagatcacaggactacagtgaaatcagtaatcttgaccagaaagctgtcccaaataaaatgacaatttgcttttttcctcaaaataagtaagtggatgttccccttaaatgtacaaccatcccacagtgaaagagccgaggccttgtggaatgacgacactgtctgcagatgagctctctggcccatgacagctccagctgcatctcccaaggctctgctgcgcacccacctttcctccctgtgcgccagcaggcttcggcctaggccacttttcccccttagtctacttgctctgacccctgcccctcccctcctgaagactgcatctggcgtcagcagtctgtctctcccacaattgtcaggttcattgccatatttctggcacccagcatgcactaaatgcctgctgagggaatgaatgaacaaccaaggtgattatgactggcctctgctctccgttctggggaagttttgattctaccaaaatcagaggcccagaagtgaggtttaaaagagatttagggactccccttctctcaccctgggaagccagaggccaaaagggaaaactcgcagcagaggggcattgttctgtgagggtctgagtttcccatctcttccaaagtaggaaattttgtcctaaaatgtttcctcagattttctcatgtctatgccacagagtagtcagcaattatgtatgacataatgaggacacaccagggaccaggcagtcctgccagcatcctaggcagggatgctaataggtgctgccattttattggcctagactgggactgtggggtcagagagaccagagctccagtggctggacttggttgttctagaacccgtgccccaagcctgatcctgtcctgcctctgtgagcactctgatggaacagcagcccagctttgcttccttgtagcactcatcactacacttggtacagcttccatctacttattcagctcttgtcttacagctcctagaaagtaagtaagcagcaggagaacacgggttttgctttgtgcattctcacggtaaatagacagtgagcaaatactttgcgaggctgaggcaggtggatcacccgaggtcagcagttcaagaccagcctggccaacatggtgaagcctggtctctactaaaaatacaaaaattagctgggcgtggtggcgcatgcctgtaatcccagctactcaggaggctgaggcaggagaatcacttgaacccgggggcggaggttgcagtgagctgagatcgcgccactgcactccagcctgggtgacagagtgagactctgcctgcaacaaaacaaacaaaaaaagaaacaagcagatgtggcctgggagtaggcctagcagtggtctgaatagcattaaaattcctaggatttaccacctcagtaactttaccaaatgcttctagaatcaggaaaagagggaaacaaccatttcttaagctcctcctttgtagtaggcacaccatagctatcaacactattcaatctcgccagcaaccccataaggcaggtgttgtaattttttaaaactgtgagtaaatggaggttcagaacaagtcacactagtgtcaggtgaccttggcaaaagaatcccaggactggctggccatcaagcccaagttaggctggcctctcaggtcctgtttcaaaaggtgagaagataaaaaggcaagactaggaacatcttacctttcacttctgcgagaaattattgcccctggattccagctaatttgttcacaaaagtaccctacttcatttacagataacaggtcagagaacctgggtgccctcaaaacccagccagggcctagggggcggcgagtggaagctgcctgggtgtgtaccgcaccgatctgggccccggtggctgcacagcttccctgagcctcagtttccctacctgtgagactggtacagcagatctcaccctaaagagctgtgggagggttcgaagaagaaaagtattaaccacagcgcctgctccctgcaggcacatggcgggcccatctccacctccctgaacccccacagcaagccccgcgggagagtatcacccccgccagggaagaggcaacaagaatgcagagcccggcccgggcgctctcccgagctcgcgggtcctccgccggccaacgttcaggaaacaagccagaaaaatgcgtgcgcttcccgcctttctgagccgccgggcgagggtcccgcagcccgccgctcacccacagccgcaccgcggatccagctccggtccttgttcccggggcggctaccgacaacccctatttccgggtccagccgcttctggcgtccccgcgtccggtgtgccagcgtctgccctccggctccggcgggtcggcgttcttaggttccgtggctcgcggattccgggagcaccccagggagtggcacttgcacgccgcggaccgcagggatccccaagccctgcacccagattcttccccgccacggagagacaatcatgacaattatcattacaatgattatgaaaactggcatgaaaacatttatgctgttaataattaaaataataaaaatgtaccgatgtgtgtatagcaggcttcttttcgatgctgtaaaaaaatctgtggaatgaatgaatgatctgtgtaaaatatatttggaagatgaattctaaaattaagttatttatttatttatttatttatttattttgagacagagttttactcttgtcgcccaggctggagtgcagtggtgtgatctcggctcactgaaacctccgcctcccaggttcaagcaattcgcctgcctcagcctcctaaatagctgggattacaggcgtgcgccaccacgcccagctaatttatatgtgtatgtatatatatgtgtgtgtatacatatatatatattttttttttttttttttttgaggcggagtctcactctgttgcccaggctgaagtgcagtggcgcaatctcggctcactgcaacctccgcctcccgggttcaagcgatgatctcgcctcagcctcccaagtagctgggactataggcgcttgccaccacgcgggctaattttttgtatttttttagtagagacggggcttcaccgtgttagccaggatggtctcgatctcctgacctcgtgatccgcccgccttggcctcccaaagatttctatatttttagtagagacgggggtttcaccgtgttaaccaggctagtcttgaactcctgaccttaggtggtccgcctccctcggcctcccaaaatgctgggattacaggtgtgactcttcacgctcggccaactaatttatttgttagagcattaggattatggaaggtttaaaatacgttttatgatcttattttaaataacatacacacattgcccttgttccttgtagattttcccaacctgctgttttttttttttttttttaaagacagggtttcactctgtcacccaggctggagcgcagtagcgagatcacagctcactgcagcctcgatctcctggcgtcaggcgatgctctcacctcagcctccccagtagctgggaccacaggtgccagccaccaagcccagccaattaatttttttttttttggtagagatggggtctagggggagggtctcactatgttgcccagattggtctcaaactcctggcctcaagtgatcctcctgcctcggcctcccaaagtgctgggattacaggggtgagccactgtcccgggccccaacctgcctttattggaatgatctgtgtaaagtatatctggaagatgaattctaaaattaagttatttatttatctaatttattttgataaataataagtagtctggatagaggctctggaaaaagaaaagttctataggcaaattaaggtttggaaatgtcacaaattatgagtcacggtgagacttcactttcaaagcagaactcctgattccaaacccacaccttggtaggttcttcgtctccaaaatggcaactccatcttcctggttgctcagggacagagcctgggagcatcctggaccacccacaaatcctgccattactgtctttacaatacagatgctcctcaacttcagatggaactacatccacataaacccatcttaagttgaaaatattgtgactcgaaagtacgtttttgacttatggtattttcaacttactatgggcttacccagatgtagccccatcatgagtcaagaagcgtgcagaatgcatactggttttgtagttgaaaaatcctgtaggtggaaattgtcctaaatcgaagactgtatatcggagatcccctcaagtctccctgcctccctgccaccaccctgatccgagctcctcctctccctccaggtctccaccttgccgccctgcagtgtgttctccacataccagccagggctaagattggctctgttgggtgctaccagttggctgaaagagaaacccagaggccctcagctcattccatcaatccagttccagagttcattgtatggagccctaggaaggacctgaggcctgggccagcaggaggcgctgagtggtcagctctgaaggccagggcgtcgggaagtgttcttggtcagagcagagaaactgcagttgccttgtgctttcttcccggagagccctgcagctgaccctctgccagagctttgggtcaggctttctgactgacccttaggttgacaaatgacccagattcagaggaacccttcaacttggaggtgtctccctattgggactccccccaaccccagctccactctgaccagggagatggtggcctaggatcgactcagcgagaggggccgttcttctttccccatggctggggagaaactgactcccctaaagagtagcagcagacttgcctgcagaggcctcctctaaggagtgtgcagaggccatgagagaaactcaggtgcccagacaccgccatgggacttcaggaagcagagccctggggtgtttccaccatggtcttgacttttctcctcttccttaccctcctcacttactgggcaggtgcctggttatggtggatgggataactgagggctcctggacctctcttctctctggttcggcataggctggtccatgattttgataatactattaatagttaacatcatgcagtgcttacttactctgttctaggcactgttctgttactgacacaatcctcattacaacactaggaattagatattattattatccttattttacacataaagaagcaggacacataggccaggcgcggtggctcacgcctgtgatcccagcactttgggaggctgaggcgggcggatcacctgaggtcgggagttagagaccagcctgaccaacatggagaaaccccgtctctactaaaactacaaaaaattaggtgggcatggtggcgcacatctgtagttccagctactcgggaggctgaggcaggagaatcgcttgaacccaggaggcggaggttgcagtgagccaagatcatgccattgcattccagcctgggcaacaaaagcaaaactccatctcaaaaaaaaaaaaaaaaaaaaaaaagaaccagcaggacacaatgatggaagtggcagagcaacctagttccagaagccactttttttttttttgacggggtctcactctgttgcccaaagttctgggatttatgggcatgagctaccgtgcacagccttaaagattacttttttttttttgagaggagtcttgctctgtcgccaggctggagtgcagtgacacgatcttggctcactgcaacctccaccccctgggttcaagcgatcctcctgcctcagcctcccgagtagctgggactacaggcacacaccaccaagcccagctaattttttaaatttttaaatatttttttatttttagtagagatgggtttcaccatgttggccaggatggtcttgatttcttgaccttgtgatccacctgccttggcctcccaaagtgctgggattacaggcgtgagccaccgcgcctggccaagattactttttgaagtttgaataaaagggcaatgaaacctgcgctgaagaacaggaaattgactggctgtgtgctgaggccatccttctcccctgtctgggagggggacttctgtcactctgctgtccccagaagtgggtggagcttaaaacgtcacagaagcccaagtcatttgcagggtacatggagaaacagctcttggcagcctgtcctatgacctgaactcaacatgtcttttttttttctttgagacggagtctcgctctgtcacccaggctggaatgcaatggcgcgacctcggctcactgcaacctcccctcccgggttcaagcaattctcctacctcagcctcctgagtagctgggactacaggtgtgcgccaccacgcccagttaattttttaaatttttagtagacatggggtttcaccatgttggccaggttggtcttaaactcctgacctcgtgatccgcccaccttggcttcccaaagtgctgggattacaggcgtgagccaccatgccagacatcaccatatctttatactcctttcttcacaaaagaaacaactgaagaacaaccagaaggtgccagcatattctgtgaacaccagcaaaaaacccacgtaaataaatggtggcaaaagtgaactctttacacaggagaagctacctccctgcctcgcctaaaatgtcaaaggatatcatagtgacaaacatgaagccgatatccataataaattttattttgcccagtgacataaaaggcaagtcagattactgttggaatgatgaattgtgttgatttcaattctttataatattttcttattttaagaagaaattcttgtagtggtaattttgggatatgactaaatgaatgtgcctttcatgtggaagaataaacaaacaagaatattgggccaggcataatggctcatgcctggaatcccagcactttcagaggccaaggtgaggggatcacttgaggtcaggagtttgagaccagcctaacatagtgagaccctgtctaaaaaaaaaaaaaaaaaaaaaagattagctgggcatggtggcatatgctactcaggaggctgaagcgagagggtggcctgttcccaggaggttgaggctacagtgagctatgattgcaccactgcactccagcctggatgacagagtgagaccttgccttaaaaaaaaagtcaaggaggatgaggagagaatggggagataaaaatgttaccagctagtacaaagccacaggagcccaagacaggcccatgagatagatggaaatgagagaaggaacatctctgagagctcgccgcaatagccatgttggaaaacatctgtccactcatatcttcctttattctcacactcatccagtattttttgggtacctactaatttccaggcattgtggatacgatggtgaatgaaacggaaaaaaagtctgctctcttgggccttactttctagtgatctgtgataattatctcagaaaatgtatatcaaacacacagcacagtgtatgacagtcaacagtcaagggctggccaccactactttgataatcatgttggtttcatgtttgcagtgaccaagagtcaggggttaactgaaagacccaaacacgtatccattactcagataactttctctgtgctccaagctgactttgccaaatagtacaagcaacacccctaatgctgcagggtgcacagtgtctctgtagtgatggcgtgagtggtttctgggggtgcaggcgccacctgcttcctcggttgtttctggggagctggcacatgctgcctttgtgtgtggaagtgggtgtggtgcaggccgaggcaggaggatgctttggaagcagggaatatctgggaaagcagttgatctggccctggcccagagatccctacccaccacagtcctgcttctacagggcaacagcaggcaacccattcttttcctctaatcctactgaaatgtttggctttctccctccctcccttctttttccactctccctctcctctttcctgcatttcctctcttgactgaggcctgcgtggggcttgctggtgcatcgtgcacctactgcttcttcctagggatcccctggagatgactgtccactcaccaccaagatggggaaggacttattgaaaaagacccacatgaccaccactctcccgaagattttccatggatcatttccctgaatgctcccaccaagcctcccagccaggttcctctgaccactctactttgctatgggaactcagaagtgtcccttcttttccaagagggtttactagatgccaggcactgttctcagcatgtaacccttctaaataagtaacttattcaacacacacgtaatggtgtgaggtaaggactatgattaactttgtgattcaaaattcttaaattcatagatgaagaaactgaggcacaaaatagtggatgcaaatcacagtcagctctcctaaccccaacccagaggttgagttttgaccctcggcctggactgcaggaaaccttcaagcaagctctcaagtgggtgcagcaggaggaaggtcttatgatcttggggaaatttggtccagatacttccaggagcaagcatcctcccatatctgactaaagagcaatactgactcaggcaagaagaaagtgagtggtcagggtaaggaggaaagcgaggctgaggtcatggcagcacctgtgccctgacactgctggaaagacatgtcaccagaaggtacctacaggaagcaatgggatttcattcatgcaatctgatcttacgctctgatagtgtcatgtggagcagctgcagttacatgcctgcgtggctgcatcggagagaggcgcattgtgtggatcagaggcaattagccagtcagggtttggggaggcatctgattttttcagcacagcaaggaacggcacagtacatcgagcccccagtgcatttctcggtatctcgatcttcctctacttgcgcttttctgttcctctgcctggaggttttgcctccattctagtctctgctctaacacagaccttgtgtgtactttatcgcaaacagttccctttccacccctcagcagcgggccccactccctttgttttgccctttctcaatctgaagacgtgtcatttacctgccagcttgcttatctgcatggagcccatgctccactagggcacgaacttggagttatttctgctgcatcctctgcccttgcaaaagtacctgtcacctgggaggcacttagcaagtacttgttacctaaatggacaatgtgaaaaatcaccatgctccactcgcaggccaggctgctggagatgactgtatggcctctggactggccctctgagcgtgaccgatacacagaggaaggtgggtgcacaaggactgtgctattctgtaggaatcctatgaggaatctgctgggcactatcacaacctggagtcagggtagttcaggaggcgctgaggctgctgcaagatggctcatgagagcaggcaagctccctcgcctggatggaagcagcactcagcaagcaaggcactgaggacccttccgctaagtgaggctttcttacctatctctggttccagggtttacatgggtggaaccaggatgcctacaacagagcttcagcaaggacaggcaaacaaacagaaactgacaagtggactagcagaatggactgaaggctgctctgtaaacttctcccacccagcagtaatactctggctttctatggccctgtgtgtcagtttggtccaggcctttctatgaagcccctgtacatatcttggtcactcataagttcccctgcgtctgccttctgtctccatctacatcagccttgactatattccacccacatggtgctgggggcctgggcctgtgaacctctgacctgtcctctcctgccagactcaggcccagctctcagctgctgctgttgccgggcccctcccagggtgcctgactccagatctctgccacagattcaggactggactcaaaggtctcctctctgaggtgccttccctgacctgctttggcagccactcctgattcttctgactttgccctgttgtagggacttcctaaacggttgtgacccatgctctccatgtatgcccggtctgaggacagcagcgcctggcccaagcacacgctcgatggtgatcagctgactgatggccgcgtgctctgggtttggtgccaggcatgtgcctccttccagtctcccaacagcccccagagctgttcagacctccagtgcacagctcatgtccaaaggtggggaagtcagctaaggacccacttcattctacccagaagcataagacaaagagaaactgagtgagtggccagaagagggagtgttcgccagggagggctggacctctggggtctctggtgatctggcggtagagccacctggataacgtgtgccgattgaatgaacaggtgaaacaggccaggctttcgactggggaaggggagcgagaggaatgaagaaagcgccagatagttcccatggaagtttattttatgttccttgcaaacaacatgtggcctcagctgtgattccagctgccctctctgacttctgttccctgagcctggctcctgttcttcattcaaactgcaccagctgcataagcaaagacagtggaggggctccactgcatgtcagcctgctgcatggcttgcagctgcttctgtatctcggcctgcaactggcacagcttgtcctcgttcacaggaccccggcagacgccatgcaggtagatgcagcagtcaactgggatgggatagagtacctgcttcagctccatcagccccatggtgtgctccagcaggctcaggaggcaggcactggagatggggttgtcggagaggctcagggaactgaggtgggagcagcggcacagggcgggcaggagggcactgaggtgggcatccttcagccagcagtgtttcaggtctaggtgctgcagtgtccctgagactgccctcagcagggtacccaagggcccagggatcatgtaggacaagtcgttgacgctcagatccagcttcttcaggcaggtggtatgatggctccgggacaagtaggtgatgtcagtgtccagaagcttgcagttgcagatctccagggaatgtagtgggacccacagacagctgaggagagaagggtggctctgtgaggggagggcccaggcaccccacccggaacacctatttgtccatggaggaggctagtcctatggccaccccctcatcagggaagccatttaccagcagggtcaggagcatgtcctttggtgtcccaaggcctggctctctctcaacagacctaccaggtcctccacgaacccttctaactctaagtttctcttcggtgaaagggagatgcacattatccatacctaataagactgctgagaggagccatttgaaagcgcttatctgatgagaagtaaccataggctgaggccattattcctcaggtttgggtttggggaagctgctgctcaggcttccatttaagccagggctgggggtcctgaatgccctatcttgaaatttctaggagacgtgcacagagtggatactgattgtccttcagggctctgtacccacctgtctggggcagtatgagctcagaagaagaggcataacctgtgctgtgtcaggatcttttcttggggaccagcataacattcagcagtgcctgaaaatgtttgttgagtaaataaacatattattaggaaaggcgcaatggctcacacctgtaatcccagcactttgggaagccgcagtgggtggatcacctgaggtctggagttcaagaccagtctggccaacgtggtgaaaccccatctctactaaaaatggaaaaattagccaggcatggtggcccatgcctgtaatcctagctacttgggaggctgaggcaggagaatcacttgaacctgggaggcagagattccagtaagccgagatcatgccactgcactccagcctgggtgacagatactctgtctcaaaaacaaaaaattaaaaaattaaatgaaattcatggaagaccactgttttggactaagctcctgcactagacctcaaaagaccagagcaaaccagaatgcagtcactcgtgctaagtgccaggtaatcaaactgaacttcgaaactggtcagttttccaaaaaacaggagattcacaccaaccaatcagaaggggcccaggatgataaggaagtgccctctgttttaaccccataaggaaagtaaccgtcaactgaccaatctgctttttgttttggcttttttcatcacttttatgcttataaagccagtctcttctgctcagctcatcagagctcttattctattttatagaatgggaggctgccccaatttgtgaatcacaaacctaagccaattagaaggccaggcatggtggctcatgcctttaatcttagtgctttgggaggctgaggtgggaggatggcttgaagccaggagctcaagaccagcctgggcagcaaagcaagaccttgtctctccaaaaaagtttttaaaaaattcgcaaggtgtagtggtgcgcatctgtagtcttagccgcttaggaggctgaggcgggagggtagcttgagcacaggagtttgagactgcagtgagatgtaatcgtgccactgcactctagcctgggtgacaaaatgatgccctgtctctaaagagtaaaaaaaagccaattagatctttaaactaaatttgttgtaatttttttttgagacggggtctcactctgttgcccatgctggagtgcagtggcacaatcatggctcactacagcctcaaactcctgggctcaagcaatcctcctgcctcggcctcctgagtagctgggactaaagatgcactatgcccagctaatttttctttttgtttttgttttgtttttgagatggagtcttgctctgttgcccaagctggagtgcagtggtgcaatcttggctcactataacctccaccttctgggttcaagagattctcctgccttagcctcccgagcagctaggattacagacacatgccaccatgtccggctaatttttgtatttttaatagagatggggtttcgccatgttggccaggctggtctcaaactcttaacctcaagtgatccgcctgcctctgcctcccaaagtgctgggattacaggcatgagccaccgtgcttggccttaatttttgtatatttatttgtagaaatggggtctcactttgttgcccaggctggtttccaacttggcctcaagtgagcttcccacttcagcctcccaaagtggattttattttttatagcaacatgcatctttccccatcaaatatgtttccaaagcagatcccagccatcagctgcatctgaaccctcagttcccaggctgtgcccacaattccatgagcatctaagaataagccccatttcctgtcttgttcccctgacctgacctcacttgggagtattcagaggactcttccgacgcccctgcctacccattcacctgagtatgtaatgtagtttgcctacgaggtaggagtgagacaggtgcagcttccggaggtggcccagcatggtgagctgggagaagaagtagctggagggccgcctgacccatgaggagaaggcccacttgtagtagaagagcttgaagctgcgcaggttgaagatccttcccagctgtatggcagataggtttggctctgccaataccaagaagtctctacaccagtaaaacacctccagctcctggatgaaatccagcctgagtgtcttcaggatcctcagcagactgtcgacggccatcttctcaatgtgcaacttcctacagcagagatgcagggccccgtggctctgttccactttcgtcaggaggtcggagaggaacttatctaacttgaagaagcctcataggaaaagatcaatgtgtatttccactgcttcccatggctgctttcatccttttttcatgttctttgctggcttgggcctggccgtggcctggggcgtctctgccttgactgctgatggtaaccaaaatgggaacttggtcaaggcttcagaagcccctttaccacagtaaaagacttgctcagagtccagggtgaaatccagcatcctcagttctgacttcctgcggggagaggggtgtgatgagatgctggggagcccaggtaagatgagtggcagcagccctgggctgctccccaggccccagcaccagcccgcctcgcctctcctctgcaataggcttttcctccctcactcaggctccttgtcagcccctattcctcatacagcttgtaccaccacccctagaaagtaaaaagccctctccttaaagccttctagctgtaccatcaaccacttaactcagaaacatatagtttccccacttgtccctctagccaatttaacgctcccctcccctggacctcagctcaccctccttctggctctgaactgaggtcttgctcccagcatcccccttacctgggacaagccctgtgggcagaaaaggcctccagcccatccaccacagcttgcaggctgtcttggttgggccactgcactatcagagagcccagatggagaaaccggaagggccaggcctgcaccaaggccttcagagcctttctgtgccccttggcaaatgcagcagtgagtagtggcgggaaaaggttcactgtgagctgttccaacaccagtggaactgaagcctcattgctcagcaggctgtgggctgcaagttccaagaggctgaggggtgctgggtggttcacctccatggacctggagcagaagaaggtagaaatcctcagaagactaatggctcagcatcactcccaggccaatgtgggagatgcaggcctttcgcatctgtcacagaaccaaatgctggctcctccctccattcaagaccaaaactccacaattcaggtcttgtaagcctgagaccctggagccctaagaccctggggacatgggatccagaaccttaggggtttagatctattccttgctaggctgtagaggcttggaattgacccacactttcctcttctgccttcaccattaacatcatgaacacctaactaaggacactgtcccaaaactccacatcaattctcccaaagcgtatgtagattctgagcagttctcatcacttccagttttaccaagccattatctcttgcccccattactgcagtggccttctaacttgtctctctgcttctgtccttgtgcgccctgtggtcaaagtcagatcatgacattcctttgctcaaaactctagtggcttcattttcactgtgaatacaacccaccctgcagctgccctcagagtctagcatccgggcatctcagggcccacctcctgtcactcccctcactattcactctgcaccagcaacctacactggactccatttctctcctcaaacaccagcaacgccctgcttcagggcctttgcacttcctgttccctctgcctagaagtgtcttctcccaaatatcctcatggctggcccccttacttcattcaggtttctgttaaaatttcacatgagaggccttccctgaccacccaagtagaatagcactcccatcccttaattacagctttatctttcctaatctgatttacagcacttcttatatcaccagttttctgtttctgtctctcttatacacatacacatacgcagacacacacatgcgtgtgcacataaatgcacacagtcgtatattatctgtctcccctctgctaaattataagctccatgaaaaaaggggctgtgtctgctttcattactgctgtagtctgagtgataaacatagttcctgacatacaccagacaagcaggatatattttaaatgcatttcaagagcaagtttgcacaatacacgcttaccacaatcccactgatggagttgagggtaatgtggaatggaggttttttttctatgctctcacagagcatcaggttcaggttagttatggattctttcaactgcccaaattcctcttttttttctgcccagtgaaatgcgggagtgtagccccatcccatcactttccacggtccaccacagagcagggctttgtgcaaggagggggatgttctagacctgcactgtctaatgtgggagccccaagccacatgtggctactgagtacttgaaatgtggctagcatgactaaaggactgaattttaaattaaattaaattctaattaattacaatctaaatagcttcatgtagccagatgctacacttctggacggcagagttctaggatctatgctagtcagagacaagaaacattcattcacagtctcacaagctatgaaatctatttgtatgaggccactacggccttggcaacaaactgggcaaggacagaggacagtataagaaaggacaattattggccaatcatacataggaagctatctagcaaaggcttaaatactagcaaatcaaatcaaacgcctggcacactaaatctataaatatctcttacaaatagtgatcaagaacgattgagcaagaatggttaatgttaggtttattaattattaatgtcaatgcatttgagaaaatcaaagaagaaatagaaggcaaggttctgaacctgatatttagtagtggtgttttataaacattgctttttttttttgagacggagtcttgcctgtcgcctaggctggagtgcagtggcacaatcttggcttactgcaagctccacctcctgggttcacgccattctcctgcctcagtctcccgagtagctgggactacaggtgcccgccaccacgcccggctaattttttgtatttttagtagagacggggtttcaccatgttagccaggatggtcttgatctcctgacctcgtgatccacccgccttggcctcccaaagtgttgggattacaggcgtgagccaccgcgcccagccaacattgcttttaaagttagaaacaagatgaagacggtgtggccaccatgagagtgtgccctgcacctccaactcaggaaatgcacctgaaccaagggccccacccactgcccttaggaatccctggcagccttaaggcccaagtcacaccaccacatgctgctcaccaacaatgactggggacagatcagttcctgggagacaatgtgacagactagttcctgggagacatcactcctctgacaaccacctttggcttcaggactccctgatagctttgctaaatcttcctgagtgcacacgtttccacccaaccttccctccagttctgcttcaccaaacacagcgatgtaggtcagtggggtctccatgccttcccgctcacccctcaatgcccctcatagggggctcccctagtaaaaatccttggatgtttttccatcttggtatctgcttctagcaggactttgatggagtttaggatgtgccttcccaaaatacagcaacttggcatactgaatattttaagctgaaggaatttgagaaatggcatgggcaggcaggattttctgaccttcccctgtagtaggtataagaccctcctgtgagaggtactccccctatacaggaaggaaaggcatatccttatttccaaagatgaacgcttgccaagagggatctgaacacacaggcccgctgttccgccattttattacacttggctcatactctcatacttcttttgtcttatcattatttctccatgactaatcaaaatttttttctctctctatatataaacatatatatataatatatgtgtgtgtgtgtgtgtgtgagagagagagagagagagaaagacagagagacagagagagacagagaaagaaagagagagggaaagagaggagctgtatcatgggtatttttgttgatgtctgaattagaaacaagcatgcacactatcaacattgtttgggaaagttgtagccggtgcagtaagacacataacaatagggttgtctagggcaataaaaagaggcaaacgattatgtacatagtgtaggaaaaaatggtgttgcggctcagaatgtcaccccgaaatacggaactttgaaggtgtctctctgacttttccctgcctttctgtgtgagagctagtcataaaggaattctttgaccttcctttcctgaaagtaggcagtgagacctccaccccatgtgacaggtgtcctgtcctattaccaggaggaaagaaatgctacacagaggggccaagaagaatctgaatgaacaggccttgctaagttctccccagcttattaccattagaccacaggatttttgtccaatcatacttgtacatgactgtccatccttcatcaaacctaagcatacatatatacagatagtcaggtgcagtgacatgcacctgtaatcccaggtacttgggaggctgaggcaggaggactgcttgagcccaggaattcaaggccggtctgggcaatacagtaagatcccagtctctaaaaaaaattttaaattaagaactacagttctccctgggtctttgagtcttcatttctgaaggttcctgtatcacgcaaaactttgatacatttgttatggtgtcctcttgttaatctgcctttttaaaataggggtatcagcaaagacccttgagatgggtgaggaaaagctatgattttttctcctctacagtggaaagcaatggatcctctgtaatgtacccttctgggttatcagatttgagtcctgttcattatctttgagctattttttaactttataagttgtaggtaactgatagacatataaattctgtctggtctggtaatgattttctcctaacttctacctgtggaaaattttgtctccatctgaaattcatctcaacatcccttcatgtcatataaatatgtgctgtcttaactcttctttaacatctgcctggtacttcatattatatgagtaaaataaattctttaatacatgttcatttctatatctgtataaagtcacaattctacttttctgaaaattatcttttaacaattggaagctaaaaaggataaaataggaaacagttaatataattaataggagtatttctgctgatgtgactgcacaagagtgcccagtatttccagcaagaactgagctgtaaatgtataatggcagaagtaatgtagatgtatgaaataaactattcactcacttttttctgtcatctagggatgacaataaatgtgaaaacagtattaagaattaaaaaattaatgtaatggagtaaaattaataaatggaaagatgtaaatggatgaggagagcaaatattgaaaagatataaatattgttatagttaggacattttaaataatgtctaattatgactttaatctagaagaaataacaaaaacaaaactaagagaagactattgaagagatactaatgtgaaattaattcaaactggctgggcgtggtggctcatgcctgtaatccagcactttgggaggctgaggcggctggatcacctgagatcagtttgagaccagtctggccaacatggtgaaaccctgtctctactaaatatacaaaaaagaaaaaattagccatgcatggtggtgcatgcctgtaatcccagttactcgagaggctgagacaggagaatcacttgaactcgggaggcagaggttgcagtgagccaagatccggccactgcattccggtctgggcgagacagtgagaccctgtctcaaagaaaaaaaaaaattcaaacttaaagttactggaaattgaaattattctgagccttgagagaaatgtggctatgtggcctgagtcatgtaatatgcagctgcaacttctacttctctgatttaaatcaactttcttccttattcttgtactatagaaaattaggaagacctaatggcaccggatataggaccccttcagatcactacctcttctcagggagtaacaaagtaatctttcttggaatatagcattctataaccaaccaaatcactgtaatgaatgcactggttttgtatggaaaactctgcaatcctgctaaaatttctctgtctctgcctacataagtgaaaccttaacttcactgctttggaacgctgaccccgttcatctggagttagtgtttcctgggtggctatactcaagctttgtgcgcaaataaactctatatttaatcatgtgttctgatctcactatttaacattaacactaatattaccatatgtttacataaaacaatattatgttgacctgagaacagaaatcaatccgtgaaaacacatagagcaagctctcccaagagctcgtagaattattgaaggatctgattttcattatccacagagcctgaccataggtagcttaggcaaaaagaggaactttctgggagaggattccattgtagcttacctaactgaagaaagctgtctaacaaagtcaaggtcttggcagcaggagaccctgtctaccctctgttccctacccttagagctatgccataaacccagcagcaaaaaaccctccaggatggttccctggctctgtcttctcttgccaaatgtcaaatggctatgagagaggtagatttgtaagatgcaccacctaggaaagaaaaaaaactcctgccaataaaactgatacctatgaaggtaagacccatactgatttttctgagatttcaatctctgacacatccgtaatgaacaatgagtgggactccttggttggtgaatgaatagtgctaaaaggtggagtacagtgttacagtgagaagataattttttggccaataaacatataaaaatgcattcactattactaatcagggagacacaaatcaaaaatacaatgagctattacttcatatccattaggatggctaccatcaaaaaaacaaaatagaaacaaatgtgttggtgaagacacggcgacattgcaacccttgtacgatgctgggaatgcaaaatggtcgaactgctgggaaaacagtatggtggttccccaaaaaactaaaattagatccagccatttcaattctaggaatatacccaaaaagactaaaagcaaggccttgaagatatatttgtacacccatgttcacagcagcattattcataacagccaaaaggtggaagcaacacaaatgtccatcagcagatgaatggataaacaaaacatgatatataaatacaatgggatattaatcagccttaaaaaggaggaaaattctgacacacgctacaacacatacggaccttgagaacattaggctgagtgaaataagccagtcacaaaggacaaatactgtatgaccccacttgtatttccagattgaagattattttaaaatgaagacattttaagatacagcagatgcagaaagaagccatttcagagcttcccttatctggctacaggcagagccttctaagaatgaagttgtcataaatcctctctttaggagagcttcactcccagacagggccacttgcaatgggatgagaaactgtataagcaaacattatcaccaagtgtcataccttccatttattctcctaaaagaccatttatctttcccatggaaaccctttctcccttcaccctttcccctataaagttggtgtataaatccctatctctagttcttcagggagcttctcatttaaatgctgccccacacacatgtaaagaaatcttgtcttttctcctgttaatctgtccattgtttggttacctttttccccctgttaatctgttaatttgctcatttgcagctcccacacactactggacctgagatggcagaggaaaagctttccctcccagcacagttataaaagatatctacaatagtcaaattcataaagacagtaagaatggaggtttccaggagcttgggtgggggagaaatgacacaagacagggaccccctcttaggagcctggaagctcccaaacataaaaaaatttaaaactcttgagttcctccaagggaaattctagatatctagctagtcctaaaaaataaataagtaacttggggctgggtatggtggctcatgcctgtaatcctagcactttgggaggctgaggcaggcagatcacttgaggccaggagttcaagaccagcctggccaacatggtgaaatcccgtctctactaagtggttcatgcctgtagtcccagctactcgggaggctgaggcgtgataatctctggaacccaggaggtggaggttgcagtgaaccaagattgcaccactgctctccagcctgggtgacagagcaaaactccctctcaaaaaacaaatacataaaaataaataaataacttgataaaaaggtatcatgttttgcagggtcttattttaaaaaaaagataatagtagcctaaaataattgccaaggaaattagatctaaagatgttcaattttcctataaaaactaaaaataacatcttaacatatatctctgagttgtctttcagaagcctggaccctcaccaaatgcaactgttggctcatggacctttgataagagagttgaggactgaactttgaccaccattctttgttctaaatttcttcctgagggggccgggtgtagtggctcacagctgtaatcccagcactttgggaagccgaggtgggtggaccatctgaggtcaggagtttgagaccagcctgggaaacacggcaaaaccccatctctataaagagtacaaaaattagccaggcctggtggcatgtgtctgtagctccagctacttgggaggctgaggtgtgaggatcacttgagcctgggaggtgaaggttgcagtgggccaagattgtaccactccattccagcctgggcaacagagtgagccaagattgtaccactccactccagagtgcaccattccacaccagagcctgggcaaaatcaataaataaacacatgttaaagatgttatttaactggttagtgaggaaactgagaaggtgttaaaatcagttctagggagaatccaaaataagatccagaatattgaaatgaatatgcaaatggaggtaaaattggcttccagtagggagagaagccaattgaataggacaaaatgtacatgtctagagacgagaattatgttgcagtgctatcaccagtcttctaaagtagctcaaaacaatgaaagacgagagacaacctggaagggttgtgatccacttcagtggaaaactatcctatccacctaggataggatagaatccatcattcagccagcttattcatcccaagtcatactagattcaagtttgagttctacgagacagactaaaatttacagggctatttcattaccaaattcgaaaacataaattgaaaatgatgtctctaaaaattaaactactgaccaatctcacttacgaatatcaatgcaatggtaccgttaagacagttaattgggaagtcatgaggctaagatgtctccagcaccttgagtttctacctaagccaaccaaaacccaattcaatgtaaaaagtaaaatgaaatttaagcttaaccaatcagaaactgccaactaacctctaactagggacttcccactttaaccaatcaaatatgttttctttgtcttgtttctgtgaatactttatcaaatttcctctgttgccccctttcctacccacccacagtggagcactgaactacttgtggtctggtgctgcctgattcatgaatcaatgaatgctcaaataaagtcattcaaattttattgtgcctaaatttatcttttaacagcatccagcagcacatgaaaataataatggagtatgagtaaatgagaaatattagtaatgcaaagagagtccaatatgagcaaatcaagtcaccatatgtaataaaatttaccaagttaataggacaaaagagggaaaaaagaaacaccttggccgggcgcggtggctcacgcctgtaatcccagcactttgggaggccgagacgggcggatcacgaggtcaggagatcgagaccatcctggctaaaacggtgaaaccccgtctctactaaaaatagtaaaaaattagccgggcgtggtggcgggcacctgtagtcccagctactcgggaggctgaggcaggagaatggcgtgaacccgggaggcggagcttgcagtgagccgagatcgtgccactgcactctagcctgggcgacggagcaagactccgtctcaaaaaaaaaaaaaaaaaaaaaaaagagattgaatgtgtggcgaggcccttcagggcccaggcgtggagccctgtactgggtattcataaaccatttctgcaggctagcctacgttggccctgaaaggcccaggaagctgggagagccagggagagacatgatggagttgtggcagggtgagatgtgccccttcctcctcctaggactggacgcagagaatttgtataaagctctttactaaccggagtcttaattaaaggaaagaattaaggaaagccctaaaggatctatgggagtgggtatctccaccgtggccttggtctcagccattcctcttttttatttttttgggacagggtcttactctgttgctcaggctggagtacagtggcacaatcttggctcactgcaacctctgcctcctgggttcaagcaattctcccacctcagcccccaagtagctgggattacaggcgcgagacaccatgcctggataatctttgtatttcttgtagagatggggtttcaccatgttccccaggttggcttcgaactcctgagctcaagccatccacccgcctcggcctcccagagtgctaggattacaggcgtgaatcactgcgcccagcctcagccattcctctgggggttttcttacagcttaggagttatatggcaacacaagctgcaatctaaagtcataggcttggtggctcatgcctgtaatcccagcactttgggaggctgaggcgggtggatcacctgaggtcaggagttagagactagcctggccaacaaggtgaaaccccgtctctacaaaaaatacaaaaattagtctggtgtggtggcgtgcacctgtaatcccagctactcgaggggctgaggcaggagaatctcttgaacctgggaagcagaggttgcagtgagctgagattgcaccactgcactccagcctgagcaacagagcaagactccctctctaaaaataaagccacacagatctgtgcttaaatcctggctatgtgtgattttggtaagttactcaagttctgtaaacctcctatttttacatctaaaatgcggaaagaaattatatttgttttagagttattgttgcaaaatatatacactacagagcacagagccttgtgcccagtaagtgctcagttgacacatgtgcttttaacattatgtgcattgatgcaaactcttttctactttgctttatctttgtcctagtggcatacggcaccctcttggcaaaccagctaggccaaaacagaaaagattcatcacagactgaaaactcttttattttaggagaggataaataagttggttcacattgtgttacaaagggcaaaataacattggaaggtagattgtcaccatagtttagggcctttaggttcacgaaaggatttccagggaagaggcatcaaaatgaaacaatggagctaaggaggaatgagccccgagaagagaggataaactttccaggcaaatggaatgtgtgagaaggccctgagatgagctggagcatggcaggcttggagaactgaagtcagccctgtttgaactgacttattaatgaaggaatggagagaagtctggatacagaggaaagcaggccagatcttctatggccttgtaagtcacgttaaggagctgtcattcaaattatccttcctgatcatgtagttgtaatgtatgcattagattaataaatatatcttaaaatatagacaacatggaattagcaaattatagctacttcacatggtaatgaggccagctttccatagaataccaggtaaagtgacatctcagttttatacatgatgtggcatgaagaaatgctctactttaagcggttggttgtggctttttcgggagcccccttagagaggatctcggaggtatctggataaaaatctggcttgtagctgttattgctaatttagcttcattcagcaacagttttgaggatgtatatcccacatgccgcactagagaaaaggagagggaatgggagatacaattttgcttcctgagagaacctttccgtcatcttacttcaggtattggcagcaacatctaaaccacggtgatttcacatggacaagacagaaacacagtggttatgagtgcggttttttcatggggtcaagctgcttgggcttgaaactttactcccaacgaagttatttgagtaagttacctaatttatttgacaccccccctttttttttttctgagacagagtttcgctcttattgcccaggctggagtgcaatggcacgatctcagctcaccacaacctccgcctcccgggttcaagcagtgctcccgcctcagcctcccaagtagctgacattacaggcacacaccaccacgcccagctaatttttgtatttttagtagagatggggtttcaccatgttggtcaggctggtctcgaactcctgacctcgtgatccgcctgcctcggcctcccaaagtgctaggattacaggcatgagccaccatgcctggcctatttgacccttaatttcctcatttataaaatgggaacaggagtctcttgatcatgaagtcgttaagaggagttagtaagatatttcacagctagccctaccctaatgcctggcacatagtaagatctcaatatatcctattcattatgattattagtattttgcatcttttaatctttcactttttttttttttgagacagagtctttgttgcccaggttggagtgcagtggtacaatcttggcttactgcaacattcacctcccaggttcaagtgattctcctgcctcagcctcctgagtagctgggattacaggcgtgcgccaccacacccggctaatttttatatttttagtagagttggggatttcaccatgttggccaggctagtctggaactcctgacctcaggtgatctgcccgccttggcctcccaaagtgctgggattacaggggtgagccaccacgcccagccaatctttcacatttttaaaagcctatgatcactagaattttacagctttgcttaagtgagtattataggatcagaaagctgtacttggtaaactttcctggcattaatttaaattctctaacttatttctttaaggtattcttttttaaagcttcttttaatggagacacaaaagtaggaaaaaaatattacagcggatcccatgtactcataattcagcttgaataattattctttgctgattcctttgtatccacacccacaccctccttcctccatatagctccatttgcaaatatttcagcagatggagtataaaatataccatcttatcatgtgtaaaaaaatttaatacttctggccgggcacggtggctcacgcctgtaatcccagcactttgggaggctgaggtgggtggatcacctgaggtcaggagttcaagaccagcctggccaacatggtgaaaccccgtctctactaaaaatacaaaaattagccgggcatggtggcatacccctgtaatcctagctactcgggaggctgaggcaggagaattgcttgagcccaggaggcagaggttgcagtgagccgagatcatgccactgcactccagcctggctgacagagcaagactctttctcaaaaaaaaaaaaaaaaattaatacttctgtaatatcattaaatatccatgctcaaactttgaatcatctcataaattgtctgtttagatcaggatcaaaacaaggaacacattgtgattggagttatctttacaatttttgaattgattttgtcattttaatatgtatagattcagtctttttttttttttttttttttttgagacagagtctcgctctgtcacccaggctggagtgcagtggcacaaactcggctcactgcaacctccgcctcctgggttcaagttattctcctgcttcagcctcctgagtagctgtgattacaggagtgtgccatcactcacacctggctaatttttgtatttttagtagagatggggtttcaccatgctggtcaggctggtctcgaacttctgacttcatgatctttctgcctcagtctcccaaagtgctggggttacaggtgtgagccgccgcacccggctagattcagtcctaacctggctgcagataccatctcttccccttcttctttattttcctttacacgacttgttaatacctgtcatatttgtgtgcctggtgtattgtctctctacctgcccatcataacaaaagcttcataacagctttataagaaaactgtggagggggcaaaaatcagaatgtgcttaatcaatgttctcttctaacataagtgatttttctcttggaactttttcttcttgagatagtgtgggagagaggtgttacatttatttttaatgatgattgttcttttctaagccgaagggatttattcaaagtgataggcatagcaagtcttatgatgagattttttttcaatgataccaatcaaaattctagcctccaaaatcaactctgacaggattagaaaaggaaaatggagacaaacatgtctgtggggtgaggggggctgtttggaactaggatgtgtggcatggaggttttggcttggagcaggaagtagactagtgtgaaagacacaatacattagacaattaaggagaagatattattcagcttattgcagtagagagagcaccccagatccaatggctaaagtgtctcagcacagtggttctaccttagacttttatagccaggggtaaacaagttgcagaaggtgttgttttgcaagtaggggacgtcttggttatctgaacgtcaaatgttttctctgtggtcagtttcagtgggatagactcttctaatctgctaatcaatcaaagaataggaggttggagcatctgggtctaaccttgtgagcaggctcaggcaaaagggactgtttggctttgccaaaggagtcatctttgactcatggaagttgtgagaaagtagatcatgagtcttatgtaagtcatatggggaagagtagttctttgaggtaaactctttccagaaacacaaggattttttgaggggggcagggagcggtctagaaaacaaaaggatgggggtacttcctagccatcactgtgtcctgagagcacagggctcaggtaaagttcaaccttgtcatgaggttgcctattggaggacagaataggtgggggggactgctagagtttcactgccttgggacaaaaagtgcccccagaactcagcgttctgaatcaggtgtattcaggtataaaacctgggatgcagtttaaggcctggcttgtggtgagctgagaaaaagtggagaatggtctcaagggagttgctttctcatccttttacctccaaagcacagaactgagcagttacagtctgatagtctcccccaagactgcttctcttaagaggcagaagttgaagactggtcctgagtatttagtagggtgggcaatgactgttttttctggtgccctccacccaagggttcatccactctgtatcccctcagccagttggagatgacagggtttggtatctggtctttatccatttctttgccgtatataagagcctgctgtagagggaaataagctcagccatttcaaatgcaaaagagcatacaggattaaacatgccaccagaagcaaatacgttagaaaagaggaacacagaacttaaaattagcctaaataagcatattaacaggggtaaagggtgctttaaactaaaatgagaaaataagagaattaagcagaaatatgcatacagaatagctgaatcaattaaaaaaaccactgctatggggaaaatggatagagcaaggaacaaatgagtgcatttgaagaagatgttgagtaaacaagctggaaacgagggtgacaaactgtcccagtctgcctgagactgcggggttttgaagacatgggactgtcagtgctaaaaccaggagagacccgggcaaaccaggacagctggtcacttttgaatagacataaagaatataaaagcaaaactaagagcaatggaggaaaagaagtgcaaacatccagataattgtgatcccagaaggacagggaaatgaaacagagaagaaatacttgaagaaatcatggagatacctttcgtagattaaaaagaaaaagcaaggcttctggtttctggtctgaaatataagaagcttggaagtcatcactccatcctaacaagtagtaagctgaacaaactgaaaaatcagttcttcttagatccgcaagagaagtgaggccacagggcaaactgtttccccccagattgaagatacagatgggcagatacagagaattacaatttaccagagcagaaacccatgagcaggaacctccacaggaatcagtgctgggtagagaaaactgaattgtaatcgatgaattactggaggctcagtgtagatatatctgagagataactccagggggacccagctattgggtgggcctcacttttctgagttttacttcctgaagctctaccagttctcacagtaaatatcagagagaactctcaggctttggtagagagaggaaaaatgattttgaaacattccagataattctgtttttttttcttttttttttgagacggcgtcttgctcggttgcccaggctggagtgcagtggcacgatctgggctcactacaagccccgcctcccgagttcacaccattctcctgcctcagcctcctgagcagctgggactacaggcgcccgccaccatgcctggctatttctctttttttttgtatttttagtagagacagggtttcaccatgttagccaggatggtctcgatctcctgacctcgtgatccgcctgccttggcctcccagagtgttgggattacaggcgtgagccaccgcgcccggccaattctgttctttttaaattattttattattattattattattttgtagagacagggttttgccatgtttcccaggctggtcttgaattcctgatctcaagcagtcctcctgcctcagcctcccagagtgttaggattacaggcatgagccattgcacctggccagttctgttcttttttttaattatttttattattttttaaaaattattattattatactttaagttttagggtacacgtgcaagagagactacagtaagtcctcagtgtcatcactaggttcttggaaactgcaactctaagcaaaatgacatacatatggccatgaataatgtccatttgttcaatgtcatttccttacaatggtgatgaggaaaaaaaagttggttttgcttaaagtcatagtcaatagtttccaagaacctattgatgttaagtgaggacttactgtatttaaccagaacctaacctgttagggttttatcagagcctaatgacctggaagaagagaaaacctcagctccagccagctgtagccatcctttcccacctaactggggagaagaactgggaagcacctgtgaagttcacagtccagaggcacaagctcactaaaagatcaagacctagtcatgaaaatactgactactttcctcccctcacaccttaccatattactaaaagcctatttattacagttctttttatcctatacgtcatgttgggctatcaagaaaaaattacaggctggatgcagtggttcacacctgtaaatcccagcacttgggaggctgaggcgggtggatcactgaggccaggggttcaagatcagcctggctaacatggcaaaacccgtctctactaaaaatacaaaaaattagccgggcatggtggcgcacgcctgtaatcccagctactcgggaggctgaggtaggagaatagcttgaactcaggaggcagaggttgcagtgaactgagattgtgccactgcattccagcctgggtaatacagtgagactgtgtctcaaaaaaaaccaaaccaaaacaaacaaaaccccccgaaatatataagaactcatacaactcaacagcaaaaacagaacaattaagaaatggataggcctggtgcagtggctcacgcctgtaatcccagcacattgggaggccaaggcaggtggatcacaaagtcaggagttcgagaccagcctgggccaacatggtgaaaccccgtccctactaaaaatacaaaaattagctgggcatggtggcgggtgcctgtagttccagctactcgggaggctgaggcaggagaattgcttgaacctgggaggcggaggttgtagtgagctgagatcgcaccgttgcactgcagcctgggcaacaagagcaaaactccatctcaaaaaaaaaaaaaaagtataaaggacctaaatagacatttttcaaaagaagatacgtaaatagtccacagatacatgaaaatatgctcaacatcattaatcatcagagaaatacaaattaaagccacagtgaaatgtcacctcatacctgttaggatggctattataaaaaagtcaaaagataacaagtgttggtgagaacatggagaaaagggaacccttgtacattattactgggaatataaattcatatagcttttatgaaaaaacagtatgaagattcctcaaaaaattaaaagtagaagtaccatatgatccagcaatcatatttttgggtacgtgtccacaggaataaaatcactgtcaagaagaggtatcttcactcccatgttcactgcagtgtaatttattgcagtattgtttacaatagccaagaaacggaaacaacctaagtgttcattgacagacgaatggataaagaacatgtggtatatatacacaatggaatattattcagccctaaagaagaggagaaaaatttggacccaaagagagagggatgacaagcatgtgacgatggaggcaaaggttggagttacattgccacaagccaaggaatgtctgcagagacccaaagggtgtaataggcaaggaaagatcctttgctagagatttcaaaggatgtatggttctttaacacctaatttcacatttctagcctctaggactctgagaacaaattttggttttaagccactcagttgggtacttctctatggcatcactaggacatgaatacactacccaaagtgacttacagattcaatgcaatccctatcaaaatccccatagtgtggctgggtgtggtggctcacgccgataatcccagtattttgggaggctgaggcaggcgatcaccttaggtcaggagtttgagaccagtctggctaacatggcaaaaccttgtctctaccaaaaatacaaaaattagctgggagtggtggtgcacacctgtaatcccagctacttgggaggctgaggcaggagaatcgcttgaacccgggagacagagactacagtgagccaagattgcgccatggcactccagcctgggcaacacagcgagacttcatcttaaaaaaaaaaaaatctctacggtgttaggcaaaagatggaaaaactcatcctaaaattgatatgtaatttcaagggatcctaaatggctgaaacaatcttgaaaaagaacaaaagttgggagaacccaatttcccaatttcaaaacttactgcagactgcgtgcagtggcccatgcctataatcccagcactttgggaagtcgaggtgggaggactgcttgaatccaggcatttgagacagcctatgtaataaaacgagaccgtctttaccaacctccccccaccaccaaaacaaaaaacaatcgggaggctgaggcaggaggatcacttgagctcaggaggaggaggctgcagtgagtcatagtcatgccactgcacgccagcctgggtgacagagcaagaccctgttcccccaaaattaaaaaacttactatgaagctgcagtaatcataaaagtgcagtactcgttaaggtagacacatagaccaatggaatagaatggagagcccagaaataaactctcgcatctatgatcatttgattttcaacaagggtgccaagcctattcaatgggggaaagaacagtcttgtcaacaaagaaactgttgggaaaacaggatatacacatataaaaaaatgaagttggactctttctactgtatacaaaaattaactaaaaatggattgaagacctaaatataaaggttaaaagtacaaaacttttagaagaaaacatagagacaaatcttcatgactttgaatttggcaatggttttttttttaactttttaattttattaaaaaaaaaaatagagaccatgtctcgctatgttacccaagctggtcttgaactcctgggatcaagcaatcctctggtgttggcctcccaacgtgctaggattacaggcatgaaccactgtgtctggtctggcaatgttttttttaaactgatactcaaggcactgcaacacaagaagagataaataagttgaatttcatcaaaatttaaaacttttatgcatcagcagacactatctagaatgtgaaaaggcaacccacagaatgggaaaatgtctgcaaatcataaacctgataagggcttaacatacagaatatataaagaattcctatgactcaacaacaaaaagagaaacacccaattataatatgggcaaaggatctgaatagacatttctccaaagaaaatatacaaatggtaaattaacacatgaaaagatgctcaacatcattagtcattaggaaaatgtcaattaaagccagggaagatagcaattcacacctaccagactatagtcaaaacaaaatggaaataagaggtattgatgaggatgtagagaaaggataacacttgtacattgctggtgggattgttaaatggtgcggaccctgtggtaaacagtttggtggtttctcaaaaggttaaacagaattaccatataacccagcaattctgctcctaggtatatgacaaagaatttgaaatagggactcaaacagatacttgtatgctgatgttcaccacagtacccaccagagccaaacggtagaaacaatccaagttcccatcaacagatgaatgaatgaacaaaatatggtacatacatacctagaaaggaatgaggttcggatacatctgcaacatggatgagtgttgaaaacattatgctaagtgaagtcagccacaaaaggccattgtattagtttcccagggctgccgtaaaaaagtaccactaagtggttggcttggaacgatacaaatgtattgtttcacagttttggtgtccagaagtctgagatgaaggtttcagcagggccaggcactctctgcaggcattaggaaagaaaggatctggtccaggtctctgtcctagctcctggtagctttagatgttccttgctttctacctgtgactttttcacagtcaaacatttccctctgtgagtgcatgtctctatgtccaaatttcccccagtcataatggactagggcctaccctaatgacctcatcttaattttttttttttttttttttgagatggagtcttgcactgtcacccgggctggagtgcagtggtgcgatcttggctcgctacaacctccgcctctcgggttcaagagagtctcctgcctcagcctcccaagtagctgggattacaggtgcccgccaccatgcccagcacccgccaccacgcccaagctaattttttgtatttttagtagagaccgggtttcaccatgttggccaggctggtctcaaactcctgaccttgtgatccacccacctcggcctcccaaagtgctgggattacaggcatgagccactgtgcctggctgacctcatcttaattttattacttctgtaaagtctctatttccagatgaggtcacatcctgaggtattggggattaggacttcattacatctgctttggagattttcaacccataacaaccatttactgagtgatttcccacatacaaaatatttagaataagcaaatttatagagacagaaagtagattagaggttattggaagtgggaaggtgggagaatgagaagttgttgcttatgggtacagagtgtctgtttagggtggtgaaaatgttttggcaattgataatggtgatggttgcagaacattttgaaaagtaacaacatgaaatggtacacttaaaatgatttaaatgactacttttgtttatatatatattttatcacaatgtaaaggtttattaatttccatagaagaacagagaaagttatcaaaaactaccatgcaggaagcaccaagccaagatagttttataggggaatgctactaaactttatcctgaacagggacatctcattctaaatgagatgtgtcggaggcatatctcacaatgtcagggaagggacaaggacacccacgttcatgtattctaattaataccatactggagagcctagtcagggtgctaaggaatgaaaattatattaaagacacaggattagaaatgaataaatacaattgctgttattgcagatgacacggaaaacacaaaagtatccataaattatttaagaattagaaggaagaatagcaatagaagttctcaaggagtgcaggatgggtgaggggcggcatgggaatgagacatgcatttagtatcagtaacgtatgcaacaaaaatattaaaacaattccacttaattagcctgtttccaccttaatcacctgtgttccatcccagttgcttcttctccaggtgacttcacatgaagggccaagggttccatgactctccatttgcagcatcaaaagttttggcccatctttcatcctccacttccctgattccttttttttttttttttttttttgagatggagtctcgctctgttgctcaggctggagtgcagtggcatgatgtctgctcattgcaagctccgcctcctgggttcacaccattctcctgcctcagcctcccgaatagctgggactacaggcgcccaccaccacgcctggctaatttttttgtatgtttttagtagagatggggtttcaccgtgttagccaggatggtgtcgatctcctgatctcgtgatccacctgcctcagcctcccaaagtgctgggattacaggggtgagccaccgcacccggccctattccttcttgctgtgcctctcatttctctgcctgagaggcctctccttatctctcttgatgtctggctgcttctcaaccctcacccatcagtcactggtaacgttcacagacaagcctttgttctctgaccctcactgctccccacgactcaagtagagtagcccccaacccacaaccccagtagccctccgtacgggtcttctgttgttctcacagcacttctctgaaatcagctttcttaatggtttgctgacttgtttagtgttctcaatcccttcggctggtcagagtccagaatgtaaaccaaaaaggaacagacgcagatcttaatcaatttagagggaaaaagaaacacaagtcatagtagaatctgtatcctgtgctttatccaaagagggttttgaggacttcaatatttaaaggggaaagggtaagttagaaaggaaggagaaaaggaagaagcaggagaaaaatcagagttgtggggtaggcaatgaggcaaatggtaacattcttgtgaccactcagtagggacaggctcagaggaagcaattatagatgagtctggatgagctcagtgaatctacagtttacatatgaaaagaaatgagtgggggaagtcaactatgcatgcctcttctgaatggtgaatctacattttacataagatgaagtcaatatgtgaagttgcagctacctctgtgaacacaaggaaggcagtttttgcacaactcggttcccaggtgtaactttacctttggcatagtgaatttggggtcctgatatatattttttcctttgacaagggatgcatttttgcattcctttgaatgcaaaaaattctccaccattgggacttgtagagactaagaattagtagtacttcttctgggcatggtggctcacacctgtaatcccagcactttaggaggggaaggctggccgatcacctgagttcgggagttcgagaccaacctggccaacatgaagaaagtccgtctctactaaaaaaaaaaaacacacacacacacacacacaaaattagccaggcatggtggtgcatgcctgtaatcccaagtactcagaaggctgcggcaggagaatcgcttgaacccgggaggtggaggttgcagtgagccgagatcatgccattgcactccagcctgggcaacaagagataaactcttgtctgaaaaaaaaaaaaatagtggtagttcaagtccatgctggagtcttgggatgcagatattttgatgaccgcaccatgacctggccactctcctcttagttctcctcactctgcacaggtgagggctgacctgccgtggggtgaggactccacagagaccctacccatgcagcagcaacacctgggatatgcccccaaactcctgatcttaggaataacaacttctcctcagggatcttagagattccctggctccaggtcaggcagtttggcctcctctgggctccagcctggggatgaggcttgttatcactatttagtacaggacagcagctttcaacaatggttgcattgtgttggaggcccacaaggaaataaaataaaaacctgggggcttcctctgactttttcaggctcatgaagaagaggccaatgaaatgtgaggagatgtggcctgtgggtttctggtgggtggtggcctgtgggtttctggtgggtggtggcctgtgggtttctggtggatggtggcctgtgggtttctggtgggcagtgttttgtgtttgaaggggctgttatctaaaggggctctttttaagttgggagtactaccaaaactcaataaatccaattaagaatgcttagaattattcattagacacatatttatatgcaacagaattctaaatatttttggggtgtgatactaggcattccatacattgtaaaggacagcgagtctagacgcatctacttggccctgattgagtttcagaagaaactgagaatgctgctggaatagctgagggaatcgtcacttacctgcttttttcccctatctttcaattccatgtagtgaccagggaacaattatgtagattgtctatcattaactgtgtcgattggctccttcctgtcatctctggcacaggaacagtgatcccctaacacaactttcctctttagttttcaggaactgagtctcttaacttgtgcctagatctagagccccatctcctcctgtttccagcagtccttgaactcagctgtttgaggagaattaagggtggccatgagggtacaatggagttaactcccacggagcgcttgtgcttggggaggatctggaccactgaagcctgaccacaagaagtgatatctgctacgatgtctttagggttaatgaaaatgagctataagggatgatggtggaatgttccaggcattgttaacagcatttgtcaataatatttttgaaaagaatatctggttgttgattctatttactaagagagcttgcattgggcctaagtgtggcagatctcagtggggacagggtcagaggaagccactctaggtgagtctgggtgacctaaaggaaggatgtgaatggatcattaagaggtcgcatatgcttgactgcagaggccatggtagtcactgaagtgtcctcctctggcatctgtgagctctgtaggtacagagtggagagtggattaaagggtaaactgaggcaacatctgagactgggagagtagttaggcatcaaagacaatatttcacggagagatgacaatatattttgttagatttgtgacagtggagaagaagggaagttagcaatctacaatccagaaggaaagagtaattggagagaattaaaaattaagtgtgtgccccgtggcaggaaaaggaaggcatctaagatgactcctacgtgtctggttggaagttactatatatataaatataaatatttatatatatagtaaagcagaaaccagtgaagtcatgtgatatttgtaatttgttttaatatcattcagtgagagattagcatgagaggtagaaggaatggttgaggctagtctatgcctgtggagagtttgttgaactagtctctatagtttatgtaacttcaaaaattacctgatacacacacatacacacacacacacactgtcacaggtggaattctgaaagttgccaaaatataagcttccaccctgacttccagttgaatcccatctccccccaacagacagagggggagctggtatggagaccatggaagggacagaaactcaggattcccatgacagagaagtgagtaaggctggaaccccaatcaaggggaggggctgtgagccagtcagaggccagaccaggaatgtgccttagggaagctggggagtgtgagttttatacaaacagcaatgaggagtcagtgcaggattctaatccacggggtgacctgcccaacatgaataaaaacatctctctggatgtttgggaagagagtacctggggaagaaggggattttgtgtgtaggttgttactggatgggcccatgagctgaggatttgggggatcattcacacagttaaagtaaatttggatatggagtatgatgaggaggtgatgatttctaaattttcctgttcaagttttctacatgtctacaaacacattaaaatgtctctcttagcttcataattaaccaaaacaaagaataagcaaatacaggttttttttaaaaaaggtttaaatgtaaacacattatatgacactaagtccaaattctgatataaaatatctggaacaactatttagaaaactacaaactttaaaaaataaacctcacttcataaaataaaaagtgtgtatacactattaactagtgtattaggcctaccaagaccatgactattagtaaatcacatctaagccctatcaaaactctaagagcattgtgtgctgttagaggtaaagcattgtgtgaaatgtttgctgagaattgccatcttttaagaaggccaccaaccttatctcctgggaattttccattcaatgccattccctgaacagcccctacacatgtttgaaaccatcaactgtaacagtgtctgtgatgctgaccagatggcacacgtgggtcattcaactttttccagaatatactctgggggtacaaacaccttaaaaagttacattcacagcagtttgtaccacatagaaaccaagactccttttgggagtgagaaactacaataataaagtacaacatatcaggatcacagaaggtaggattcggatgatggatgtgtgaacagagatgatggatggtgaactacagagacaggctgggctctcaggtctctgggccacggaaggagtgtgtcctgtaaccagcacaggacacagctcagtaagaaccatatactccaaggagctcggggcttggagctgggccctgtgctcactgatggggactcagcagctgtgtcctttctggcctggcagagtcccctgagcagggacctgtgtatggtctcagcaggtgcttcctcccagggccctcccaaggcgggaagtaaaccttcctcctcctcaggctgcagtgtgagctgagctccagctccagggctcagggaggggctgggcagtcccctgatggaaacacacttgcatgagcagcccctcctctgcagagggtggggaagaaaaggatgcctggggcagtccagccccacggtgtggtggggtcaggggctgtgtccaccatggacttgactcctcccctccttgtgatcctgtctcactgtacgtgtcgggacgggcctcaaagaccagcctacatcagaaactttgactgaggcccctgagaaatgttaccctgaactctgccttagtatctggatgtgtcttttcacctgatagagttataaagattttcccagttaaaaacaaaagcaaagctctgccagactcgtgttcgtggctccaaatctgcttcagccactgagcaggagctgagagggaagagagagagaagaacacaagatccatatggggaaggatttctatgagggtgtggcagtgagagcgggtggcaagttgccaaagaggcctaagccacagaagtgggtttcatgtgggactttcggaatgagcaggagggcgatgggtggagggtgagggtcagaagattctaatcagaggtgagaacccaaagatgagttattggtcattcaagtcaaacagtgaaattaccttggcctgtgcctccagtcagtggagcagggaaggggccaggatgtgcttcctgcaggtgttactggaaaggggtcctgattcagatcccaagagagggttcttggatctcatgcaagaaataatttgggaggagtctataaagtggaaacaagtttattaagacagtaaatgaataaaggaatggctactccatagacagggcagcaccaaacactgctggtcggctatttgtatagatagtccttgatcatatgctaaataaggagtggattatttattagcttttcaggaattctttttaaaaatatagaccacataaggtaacttgtggatgttgccatagcatttctaactgtgaggacaaccagaggtcactttcctcaccgtcttggtttcagtaggttttggccggcttctttagcgtatcctgtcttatcagcagggtctttatgacctgtatcttgtgatcccagtctggttgacttcctagctcatcctgtgactaagaatgcctaacctcctggaaatgcaggccagcatgcctaagcctcatttaatcaagcccctattcaacatggagtcactctggttctaacacctctgacttagggtggctgcagagctggaggtgcagattggggcagatcagcctcctgagaaaagcacacagagccactgcggggctgtgaggtgggagagatgaactcacattggcatttgatcagtgactctccagctgtaatgagaatagaatggagaggcctgggacaggaagacaggatgtggttgctcatgccatcctggtgggaagatctaggtgagttactgtggggtaaagaggagagagcagattccttgtcactttatgctgtagaatacattggacatggagagggcttggagcttgtgtgtgagaaaagcagatctatctcggctgactcccaacaaactggctgagaatttagatggaggattattattaaataaaagaggaagactgaaatgaatattgtcatcgtatttttttacccagggttgggataggtggaaatgtgtgtgtgtgtgtgtgtgtgtgtgtgtgtgtttaaatattcactaatttttcaattcaaaaatatttactgcgtgactactaagtaataatattatacaggttttagcgttaccatggagaatcaaattgtcaaggtcacaggcatctttttgttttgtgtggatcactgtgaaagatactatgctaaattttttctgaatcatgcagatgaaagcattaaacacatacacaaacatttacgtttgtgtgtgtgttgtgtgtgtgtgtgtgtgtatgtgtaatctatctcagcatacaatgccactgaaactacacttgcggattaggtcctcggaaaaataatcgtgttaacattcacgatgcaaatagaatggtacctgacacaaagtaagtgctataaaagaatacttgaggctgggcgcggtggcttatgcctgtaatcccagcactttgggaggccgaggccggtggatcacctgaggtcaggagtttgagaccagcttgggcaacacggtgaaaccccgtctctactaaaaatacaaaaattagtcaggtgtggtgatgggtgcctgtaatgccagctactcgggaggcttaggcaggagaatcgcttgaacctgggaggcggaggttcaacaagagcaaagcccattctcaaaaacaaaaaatttgaatggttaaatcacattggactgtgagtaaagggcttagacaaggtgtctcggaacttttgggtcatcttcttgatctttccataaaactctaacccttctattcttaacctcccccattcccaatttcaccctgatgtgcacatcctacctggtgcctagtcatcccggtggcccctctctgggctgtatctagggagagtggtgaccttggtcatcttcctcaggtccaagtatccataagagaagcagacttttctctctttcataatgatggtctcttcttgaataatttccctgtgcattttcattaagggtctcaccccatcaagggtgtgatgaggacagtgatgagggtcacggagcccggcctcccacggggggatgtggggtatgatgagagagagaagcaggtgccctcaggcccatatggaggctggggagggttgttaaccctcctgccctcctggccactgggtgcaggacatgttctctctgaggctcactcacctatggccccaaccacacaaaaatctaaatggggaagaagcagaggatgacttcatgctgaggaggcccatcttgcagcgagaaatgtgctgtggtgagcacctgcagcacaaagagcctggggtgggggtggaggtgcgtgagcgctgcctctgtgtggggatggtgtgcgcaaggcagtgctgaggaccttcaagccagtcaggaatgaacctgggctctgagacagtggagggaagtgtggcctgtccctgagggtctgtgggggtttcaactgggaaaccaggccctggacccctaccctgggccctctgctctgtgctttctggggcccagcagctgggacctcccaggagcagaagaggctcctctagccccaccccacactcaactttccccaagttcaggcccagggatagcagggggaggggtgtgatttgcatgaagggtgctctgtgccctcttaggaggagaggataagagagactctgtgcagttctgctcagctgtgggcttaggaagcagagcctggggcatctccaccatggcctggacccctctcctcctccagcttctcaccctctgctcaggtgactgcctgtggaatgccaaagtgattattggggacacatgggatgacttttctcttatattttaacattgtggggtgggtagtgaacccagactcacctctctgtgcctgcctcctctgttccagggtcctgggcacagtctgcgctgacccaggaagcctcggtgtcagggaccgtgggacagaaggtcaccctctcctgtactggaaacagcaacaacgttggaagttatgctgtgggctggtaccaacagatttctcacggtgctcccaaaactgtgatgtttggaaattctctgccctcagggatccctgaccgcttctctggctcaaagtctgggaccacagcctccctgactatctcgggcctctagcctgaggacgaggctgattattactgttcaacatgggactacagcctcagtgctcacacagtgctgcaggcacatggggaaccgagacaaaaacctgcccttggcctgtcccgaggctgatcactccatacttgcctatgacaaacaaagagggtgcctgtggctgatcgtacagtttaagcaagggaggaagtgagactcagccacaggcccctgcaaagggtcagcgggccttgttcccacattgtctctatttgaaaaagtgagataaatttcacttcgtataaaatgtacaattaaattgtcttattgtgtttacagaattatgcatctatcaccataatctaattttaaaacgttttcatcaccccacaaaaaaacccccacaattagcagccacccttcaccctttctccccagccactggtcattgctaaagactttctgtaaagaacatgcatttaaagacctaagaaactcagtgatgccaaacagctaggtttttcaaatgcccaagcatgtaataatagattactgaaaccaaagataaagacacaattatgaaagcagacagaaagctttataatatatacagaaaatcaacaattcaaacaatgagaggtattttatgagtatacattgaggccaaatggcagtgttatgttcttacaaagtcaaaagaaagaaagaaagaactgttgagtcataatgctatatccaggtaaagattttttttttttaaaaaaggtaaaaaataagactttgtcagatgaagaaaacctgaaagaattcatctaaaaaaaatcaaaacaaatcaactctaagagaaaattttcaggtggaagataaatgataatggaaacattgaacccaaagaatgcaggaagaataaccaataaatatagtagtaaaagaccaaatttttagctctacagttctggaaaatatgcatatcaaaagctaagttatagcatttttgatataatttctacttatgaaaaatattatatatacatatatacacatatatacatatatatacacacacacacacacacacacacacacacacacacacacacatatatatatatacatgaaacttcaaccaaaagaaggaactgtaaggggtctacatgactgggaaaatattaggcctattattaaatctaaatagatcatgaatagttacatgtacatgttgtaatctttacagcaaccaatgtaaaactgtgcagagataccaatataaaatcaatataaaaatcaaaagagcccactaaataatactcaaataatccagaagtagcagaaacagggtggagaggaacaaaagttataaagagaaaaaggaaacttacactaaaattgtaagcttaaatccaaccatgtgaataatttcattaaatgtaaatgaactaagcacatatattaaacacagagtttgtcacactgagaaaaataaaaaacaagagacaagcatgcgattctataataaactctaaatagaagtatatacacaaaagtaaaatgataacacaaataaacacctagttaaaatggcataaagcattacttcaatgttaattgcatcattctgattttctaaattgcatattgtgttgtaagatgccacttttgaggaaaactggttgaagtgtaactaaacctttattacatattttttcaccttaatgtgtatctataattatgtttacagaaaacattaaatgaaagtaaaaggatggaaaagttttatcatgtaatcctgaattaataacacaaacatatagtgtggatatttctttgcgtttcttttttgttgttgtcgttgttttttgaaaaagtctcattctgttgcccagactggagtgcagtggcacaatctcggttcactgcaacctctgcctcccagattcaagtgattctcctgcctcagcctcctgagtagccgggatacaggcgcccgccaccacacccagctaatttttgtatttttagtagagatggggttttgccatgtgggcgaggttggtctcgaacttctgacctcaggtgatgtgttcacctcggcctcccaaagagctggaattacaggcataagccacaacgcctggcctttttttgttttgttttgtttttgagacagtgtctcactctgttgcccaggctggagtgcagtggtgcaatcatggctcactgcagcctcaaactcccaggctcaagcaatcctcccacctcagcttcacaagtagctaagcctacgggcacgcaccaccatgcctggctaattttgcttattttttgtagagacaagatctcactatgttgcccaggctggtctgtaactactgggctcaactgatcctcctgctttggcctcccaaattgctggaattacaggcataagccaccacacctggcccagtatggataattcatgggtaaaaaatgtaatacttgaaaaacaaattagatgttttcttattatttccacatagcagagtactaactgtaggacattgggatgtacttttgaataagaaatgaaggtttaaaaaaagataaaataaaacaaaataagtgcctaaaactgactggtgaggggtttacccaatgcatgagcagtagaaagaatttaattttttgcatccaggatactaaaaagtggaaagatagatttcttttttttcctgttttacttcttttgggttgctctatttgatctaattaaaaagcctattactcctatgctatgctgatggaagagaagtcttctctaacttagtcccagtgagattgcctcctctgggccaacaatgctcatctagaacttggaatttcgataaatccattctgaggtgatgagcagcagcagcaccagaaaagttgatccaggccatctaggaccctccagggaagggctcaggcctgtcaaagaggcctgatagaaactggggcctgcagtcagtcagggacattgaagctctcctgacacggtcccaccagctgggaaaacactcggggtctccctcgggtttgatcagatggcaagttccccattccctgattggcccaaagctttgacctgttggacccggggcctatcaaaggccaggtgtcctctccccattggaaacctccctaggctcaactcttctcttctcattctcctgctggcctgggagcatccaggccaaggggtgaggtggggacagccctacattaagtttttatttcaaggtagaaaatctgtccccttgattgtttgggaaactataaaaagactagggcagctcagggtctaaaatacagcttcagggagtacagagttagagtgcagaaacttcaattccatttactctctagcaatttacctaatatcaaaacatacagttatgttatgtttacaaatatgcacgcacctctattaatatgtgttcataagtacatacacatgcaccattacgtttacacatacatgcatgtaacaccaactgatgtaaaaatcattgttttatgtactcagttttcctttgagtttaccctcttttctctactttttaaaatatttatttctaatttggggagctactaactgagattatttttcatctcactgaaaaacagttttagaatttcctgtagagcagttctgctggtggcaaattccatcgggttttgtctgaaaagtagccattttctcctattttttctgtttattatatagaaagataacttatataaagtaaaattcacaggtcttaattatacagtttgatggtttttacaaatgcagatgctcatgtagccaacagtccgatccattctcacaacatctccattactgcagaatggagacattctgttccagtcaatgtaaattatcccattacacctaccaaatagaacgtgtatgagagacacctttctcctgaggacttttgcaaagtggggtggatcatgtgtcccgctcccactgaaaagggctaaatggaaaactaaagtctgaaataaaataggaggctgccctgacgaggggtcccactttgcccttggacagagaacaggccgtggtcaaggccctggtccgggcagaagcctctgtcaggacccactggcatctggtcacagacacgatggacctgggcctaggcagaagggggtgctgttggtctgctgctgagggctctgtgggtttctcagctgggaaaccaaacacttgaacttggtctccacgcagggttcactggggccagcagctgggctctctctgcacccttggagagcctcaggccaggcccagcccaggtaacccctcccagaaatgtcaccccaccactgggactgacactcaggcacacggagtgatttggttgggcagaggaagaggagcacatttgcatgaagggcccctctctctcctctgggactacagggtgggtaagaaatacctgcaactgtcagcctcagcagagctctggggagtctgcaccatggcttggaccccactcctcttcctcaccctcctcctccactgcacaggtcaggatggccctcagcaccctgacctccagctcactgataccacctcccaaacttatgccaggaatgtccttccctcttttcttgactccagccggtaatgggtgtctgtgttttcagggtctctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactggcattcacacagtgacacaggcagatgaggaagtgggacagaaacctcagcctgctcagggtcttgttatatgacaagttttaaattttcaaatatgttttatatgtacacactccacttggaagcaccgtctggtttaaaatgtttctactctcaatttctcattcaagttttctgaagtctcaggaaaactaaaaacagaaacaaaaatatcatgatgactatgaaatattacctaattttccaaatatgctgaattcagtgcctgtggagctaaccattttctcttgacagaagaaaaatgagccttagaaattgtttccaaatcctgaaagagtcatcattccatgtactcaggacagatttagagagtgctgaccctgccctttgaaagatgttatttgcctcttagtgcccaaataaggaaggataattaggaatcagaagcctacctagggctcccctctctcctctcaaaattgcacttggtgtcatattgccctagaatttatgcctggtgctggcaaatatttttaaatttattttttaatcttttccttttctgcaatcaaatttcttgaggggctgagaagaagaaataggcccagagagaagcaaggcagtctgggtgcaggctctagacagcccagggagaagaaagagggagcagctccctgtgtcctggagggagccctgtccccattgggcttcctgctctgatgtcccctagtggaggctcctcagggagtccagcctcccagaactgccctataaacctcacagtgagctaagcaagtatatccaggaaggagggtctgtggagatgtgagactaaggtgtgttatggcctaaacactgcccatctccatccttcttggggatgacaaagtgaacagtggaggagacaggatacatgggtgcatctggacctcaagcagtaggctgttctgtggtctgtccctaaatcttgtgctggagaccccatacgagagccactccctgaccctgggctggagccctctaccccctgctcacaagaccagcagctgtttccttataggcccccagggagccacagaacagcatcaaccaagaccatcctcttcatgtgtcagcttttcagggagggatcgaagtcatggcccaggaaagggcttggacagcccaggggaggaggctggttggtatgaaggatgccctcctcaccctgagctgctggagggagtacaagggacttggagagcccaggctcagttgatgatcctcaggatgtagagctatgtatgggtctccactgtggtctctcccccgccttctccttcactgcacaggtggctagggctcagtgtcagggctggtgatcaaaagaccaaggtttatgcatgtgtctctgtccactgacccacctctcaccctgtgtctgtcttaatgtccagcgtcctgagcccagcctgtgctgacccagccacctgcagtgcatgcatctgtggggcaggtgggtaccagctcctgcactagaagcagcagcaatgttgggcacgggcatgtgctctggtacaaacatgcctccgagagacccagagctccacatatataaaagcagtcattgacccttaggggcataggcccaatgctgaggctccaggttggagaacatggcctctctgagcatctctggactccaggcagaggaaaaggctgatttttattctcagcttgggacacaagcaccaaggctcaggcagtacttcaggccagtggggaagtgggagaaaaagctgctgcccatccagcaatggagcttctctgtgcagcccccacttcttgggcaagtcagctgattaacgttgcttttcatttgtttagtaaaaatttagattttaaaactcactccagtgaacgcagtgtggagaatgtgtttctgtcctctcaattctaccctcacacccaacccttggcagtaacaaattgtcgtattgtctcatattaagagaaatccctcaataccaagatcaggctgtcctggaaaccaaatccataatgggtcaaaacaggaccagggtcattgtgtctgactcaggatagtcgactcccaaaggtctgtttatccacctcattcactgagaagctactatgcaccagcctcagatccagggattcaaggtacatgatgaacaagagaggaaggggccctgtcctcatggagctgacactgagtggtggaacagataaggcaatcaagtaaaaatgtcaatgcgacaatatgatgtcatcacacagtgaggagagctcagttgggggtagaggagccatcagaaggttgggcaaggaagacacaggatctgactcaagtttatgaagaaaagtccagatgcctcaaagaagatgaacaaggagacagcaagcatgaaggccacggggccagttggggtcattggagagaaaggtcaggtctagcctgtgtttgtaagaggagggactgaagcctgggtgaggagagagggctcaggaatagccttggaaagtggagggagtggatgcgaaacccctgctgagggggcctccatgagcaatgaggctgggggaggccctgagctaatcaccatgatggaaactcagacaacagcctcccagcctctttcaaagttgtcacaggacgcttttctctccaaatggcaaggggggaatcccactatgagttttatttgagatgtctcttctccatgtcctgtcctgtccctaggctaaattcccatgcgcaaacaagatactgctcagtctcaggtatcacattcacacacaaatgctccagaatgagggaatgcactctgaccaacccaccaggaatttttgcctttgagaatactagatcagatcactcacaccatctcccctgacaccatcatgttgaccagtgggttgtctgatcggtttggacagcagaatgcagatgcctgtagttgcagctggggtcagtcacatgctcatctcatggctgggagactttgggtccagacaacaggaaaaaaaggaggtttgcctacgtgatcccacaatgtgcatcactctgtcatccactcccatccttagttcatgttgggttttgtcctgtagatgctgggacctggacaggatcacaagccaggcgatttctggctcacaaagttacagctcaagctccctgatgttgctgacattcttcccacagaccaattttagacagacacactattgccatgcaggcactgacctgagatacaggtagtctcaggagagggaggaagcagatacacatccccatgatggcctccttgtcccagagtgggtaagaaaggcaaggaggccaggaagccacaggagtggccactgcccaccacctgtgcacctgtccctccctcaggtgagaagcagcctgagggtccagcacctgcaccttttcccagtgcccacacacttccaagtggggcctccttctgctcacctcccaaagctactgctttccgggacatctgtgtcattgctgagagtctacttttcatggggcccttgtcccagtggtctgggatcagtgtcagcctgtttaattcagcactgtctctgtcctttcaggacaccaatctagctattaaagctctaattgaattctcctttttttgccctgaaactttagactctccttctcagtgtctctctagaatattttgtctctatccaataagatcaagttatgtcttcaggcctacagccacttctttccccaaattctgcaccttcttttaagttcttattccctcttatggcttattttccactaactagctaatgatgccaaaacatttatctattttacctccttcaggaataaaaaagaaaagcatttatcaatagcccattgtcacaaagaaaggaacagaggagagatatcttctagaaaaatacaggtgaacaaggaaaaagttttaattcctcataggaactactccatgatccaagaaaataaattccagagattcaagagttcactccttagaaacaacagtgtaaatacaaggtagtaaattttcttggttttctcaatgaataacctcaaaagggttagagtatgattataataaaaagattatacattactttcaaaaatgtaagatgaacatgtcaaaaattttaatcgactcatatttctgaaaagaccagtaaaatggtgaataattttaaagaacattttaaaacacacagagtttctattccacgagggcaggacctgtgaggataatttcctgtgttagagaaacactgtcctaaacaacaatagtagaactctctaagctctgaatttatcttctcctgtaagaaaaaatctacaaagtgacaggatccaatttatataaaatatctagcaaagattttggacattcccatctcacacctcctctccaggctctcctcaagtgaaatctactctccttctgcccgtgttctcacctttctgcacgcttccgcctgctgacacatggcttctcctgctttcctttccagtagccctaacagatcaggccctgccagtaagtaagctcctggcctgagggaaccacatcgcatgttactggatttctgaggcacttgccctgccagggtctctctttctgaatcacaatccctgtattcctgggaattctcttctcctggattctgttattcagctctgtgtttctccctccatatctactttgtgaatttctctacatcttcacctgaatcccaggaagcctaaggacatgctgatgcttcctcagttctcatgtcacaccctgttccctcctcctctatgatcccaccaggtcatcctgcatcagaaccctgagtgcggcagaggcttctctggcctccttacccccagtggcagaagggaggaagggaggtcccctgtggcctcccatccttgtgctcccattagggtcagcatgaagcaggaatgaggctgtctatatcatcatggcattcccaacactaaactctgtgcccaggagaaggtaggcactcaataactatttgacaattgaagaactgcctctcaccacactggccacattgtactggactcaggatggggctgaactggaagagtcagctgtgaacctgctcttgtctctgccctcagcctgagagctgaaggggaacctaacagggagagcacccatgggcagggaaggtacattagtagcctcatcctgtttgtgaggctctgctcagccttgggaatccctgtttattcaaggcagagaagaaggaaaacaattaaccaggcctggccaacaggcagcatctacaaggcgatgagttgagggccagatggtcagagttggttctggcatctctcaggcgcctctctccatgttgcccttttttgcgatccaggggtgaggtttcaccccactgagcccccacccatctagatgggctctgctgagagaaaaacccattttctagatgagcccactgaggctcaaggggcacatgtacttggtgatgcaccttcttcctttagagactggtcagcctagaacaccccctctcgagtggccttctggtccctcatctgcccagccccacccagatctccatgaacctgagctgtgtgagagaagagggaagagtaggaggaagggaggagtccaggccatggtgtggatgttgcaggaacccctgggtcttcaaactgaggctggacaccgcaatgttctttttatctccctcaaattttttggtaaaatgtcagtgcttgtctggtccattattcaaacctgattctttttaccaccatcataggcatacatttctgagtcttcatcccagagaacagctcctctctaaaggggaggtgtagggtggctgtgagttctgagtttgcccctggggaggaagcacctgctccaccatgtgcacaggcctgtaagcaagagtccaactttgttgaaataggaaccatttgagtttgcttcaggccttgctgacctcagaagtttcacattgtcccctggtgacctcttcacaatgatgttagtggtgatggaacaatgcaggacagaaggccttccttactttctttcaacaaaaaaatggtgtattatctagcctgacagtaccctagctggagacagtgaaaataatttacattttaaacaaataatgtttgttattttttcaatctcatgagtgtaagataaaagtaatcctatctcaataccaaaacaaacaaacacgaaaaaccagaatctgaggagactgaagtgtgttgattgagagacagtaagaataacttagtccagctcccctgcctggctgtgaaatccaatgatccagtgtcccactctacagacaaacctacaggtttttcacccaatgcagacagaagacatggtattgaattcatgagtccccgctgagagtcacaataggctggtgtggcacaatgcattatgggaggcacagaatgaagggacaacatgtattcagtggattctgctctcttatcagactgagtcactgcacagactgctcacagggtttctccactgcattctgcctcacataaataaacaccaagagccataggatattagtcaattatattttctccttcagtgtcatacttgagatctctatcatatttgaaattggactcagagagcttcaattattttgttgcaatatatattatctttacaaaaattacctagactactgtgtttctgaaaaataaatcttacaatttattttacttccatgatggtattaaacttgaatggttagcatatcagccagtagtgtgtctggggctggacaacagagagtgtttggggtccattcctgaagggtgtgtgtgtgctcagagctggcatcatccacctattctgactcctgccctctgctaagtcctcacagctgtgaacttccaaacccctgggacaacacagctccactcctgctcattcccctgatccccaaaggcacagggccctgatcctgacccaaacacagagtgggatcaaaaagctgagaggttgtcacttgcataggtggatttttttcctcaaagagtataaagagagggagaaagattgggagaagctctgcggtagctgtaggcacagaaggcaggaatcaggccaatctccaccatggactggtcccctctcctcctcatactcctcactcactgtacaggtgactagacacaggcccaggggaggagccctgggaagcccaagggactctgctttctcatcttgtctctagaacagtatcaccacttctgtgtctcttccacttccagggtcctgggccaagtctgtgctgactcaacctccatcagtggcaggggccccaagatagagggtcactatctcctgcactggaagtgccaccagcactgggggtggttttcatgttaatgagtactagcagctcccaggaatggctccatagctcctcatttgtgaaaacagccattggccttcagggttctgtcctggttcacaggcttcgctgagcatttctgggctccagtctggggataaggctgactatttttctttatcttggcacacaagcattaatgctcacacagaactgtaggccaccggggaaggaagacaaagatatgctgtctttccagtgacagagtttccctgtgcagcccccaacccattcaccaaataagtgcttaactgtgattttttttggtggacaaaatgtggagtatgagaagcactgaagcaaacatggtctaaataatgtttcccagtcctctctcaattctacccccatatccaacccttggcaataataaattgtcatactgtcatatattgaaataaatatctatattagtccattctcacattgctataaagaactacctgagacagggtaatttatgaagaaaggctcacagtctttaattgactcacagttctgcaggctgtacaggaagcatgaattggaggcctcaggaaacttacaatcatggaggaaggacgaggggagcaagtacatcttgatatggcagagcaggagagagagagaaggggaaatactacgcacttttaaacaaccagaactcacaagaactcactcatgatagtgaatcttaagaacagcaagaaagaaatctgcccccacgatccaatcacctcctaccagcccctcctcagcatgagatttgggtggggacacagagccaagccatatcaattcctcaataccagggtcaggcttccctgggaaccaagtccatcatggatcaggacaggaccaggaacacagcacccactgtgtctgaccaaagagcctcaactgccagatgtctgtccatccacaccattcaattagcacctactatgtgccagccttaggtctaggggctcaaaaacagggtggacaagacaggaagtgtccctgtcctcatggaccagacaccatctggtggaagagatgagacaattgagtaataatatcaatacaataagatgtcatcacttagtgaggagaggagaggagagctcagtaatggtggtagaggagccatcagagggttggacaaggaagacagaggatctgagctaagtttgtgaagaaaagtccagatgcctcagacaagatggacaaggaggtgggaagcatgatggctgtgggtccaactagggtcactgggggagactgtttatacccagcatatgtttgtggggaggagggactgaagcctgggtgaggggagagggctcaaggctggccttaggacatggacaggatggtattgagtcacgctgcagaaggagccttcatgggcaagggggctgggggaggccctgagctcattattccaatggaaatatcaaactgcctgttagcctttgtcaaaggtatcaaagagactttttcattcaagatggcaagagaggaatctccctcttagacttctttgagatattctttcttcatgaccgtttcttgcccctggatgaatgctcacatgggagcaaattacctcctcagtcccaggatttcaatttgcacacaatccccccagaatgatcgagacctgccatccctgacccactgatcaggaattctggccttcaggacaacttgaccagatcagtcacaccatgtcccctgacaccatcgtggtgactggggtgaactgtcagactggtttgggtaatacatgtcctgtccctggagttgcagaacctgttcagaaagataatggtgtggatggagggaggctaattccagccacatcagaaagcaagaaagacatggagaccacccttgagctggcacagcatccttgggtctcacatgtgtctctagcgactggaaaaggaactcagatttaactaattctattttctcatctgtcactctccctttcactactgactcctgaagccccaacaaaagcagcactatgggattatggtcatggaatagaggccttgctgctgaacttttcttttttattctaaaaagtacaacacagataatgcatattaactaaaaattataaaaatgtatttaaatgatgtgacaatgaatgtataaggggttaataggagaaaataataaacaatgttaaaaaatacaaaataccaatacactataagagttatactatgtcatggattgtataaatcagtattgtaaagatggcagtgtcctaggattaatccatcaaattaatataagtgtaattaaaatttcagtaatattttaggaaactgcttaacttattttaaaactcaaattgaaaattgagataaaaattacctaagattatttaccaaaaatttgtaatggaagtgataccagatattgagttatttgaccaagcaatattagctaaaatcatgcatgattgagatcttgacatttacataattctcttaaaaattagagtagataggactgatgattttttatgtgaccttggaaatatggctaactctgttcataaaattaagtagagtacctaattcatacttttattaaaaaatccaaacagatttaaaatataatttagaaaagaaaaagtttaaaaactttagtttggaaaaatagaaatattatttttatttcatatgagaaagtacttcttaaataaacccaaaagtcaattcataaaagaaaatttgaagtatttggttgcaattatttgaagctttttttttcccaaagaggaccacagttggtaaaaagagagaaggatatgcaagagtggaaagacattggcaaggacaaagtattgctgtttgcatccagaagacaactttgaaatgagcgaagacagaaaaaaaggaaacccagtaaaaatgttcaaaggacacaaacaagccattcacgggtctcaaaatgagagcagataaatgtgacatcaaaatatgttaaattccaccagagacaaagagaagggaataagatcttcaagtagaaattgtggaatgagccaagcatgtctgtgcatggggagctttccaggccttgcaaaaagcaaagagagtaagaaaagagcaagaagggagtgagaagcccttttgtagagaaaccaagaaaagaaagtttagagtgttagagcctgggccagaaagataaaagagagagaagaggtagataatgtgggatttgagtgacctttgattcctgtgggcatacttctgagtaagacatgaagccactgagggtggaaagctgttaaatgatattgcaaatttaaataaaaaaaaaagatgccagtgaggatgtggggaatcccaaactctcactcacagcaggttgtaaaaacaaattcagctattttgagcaaagtccctcagcacgaagataccttaagagggtgagcatctgtcttgcaccaagtccactctgtacagagacacaaggaaatgtttatgagaaggtccttactaggggaaaagtataaaaaacaagctagttgtcaaacacaaggggaatttataacctgcagttagctgatggaatgctaactagttggaagtaataaaataaaagtattattatgagtttcaaaggcaataaatatataaataaaattaaaaagccaagagctaaagaaataaattattttaaaatatgaacatgcactataattttttttaagtttataccatgagctatttgaaagttagactggaagcacattatatacacttatgtaagagcctctgaaaaagatggaaacacatacgaaggttaaaagataatttaaaacaatagagagttatttcagtagctgaagatatgagtgccaataaaatgaatgcgattcaaccctgtgagcattgctttcataaaaaaattaaaacagaaaatgaatattaatagatgacttaagtgaaatcacaatgtatgtggtgatacagctgaaagacaaacgttttgttagtaagaagggcatcgctaagcctgatgagtgctttgtttagaattcccagctaccctggattcctctccaacctcatgaacagcttcagaaaagaggatcaggacaaccgatgctcctctcattgaaatgcccggatgtggcagagaggcaggaaatattttgggtctgaggacagtgaggatcatcactgagatgatcctgcccaaatgaaaaccactcagggcctccaagggagttcagccatcagctcactggactaggtttgggatgcaacactgacctgccccgacccagagtcataatgagccaggccacctccacccactgggtcagctcatctcctctttatcttttctccttctgacctgtgagtacccagatcagggtggacaagtaagagacacatagcaaggtcttatgtgaatacagtgactctaccttacgacgtttttgggagatacaaaggtacttagaggagctcagtttccaaagcagtgctccaggaagctggaaatctgcactatgctctgggctcctctcctccatctccaccctcactattcaggtgagaaagaaccttatgtcgggggatccacacccagctctgctccataccccctcactctctggctcactgggttgtaaacctgctctcatggccctctctgtccccctgcagtgtctgtggcccaggcagggcagactcagcagctctctgtatccaagggcttgggatagacaaccacactcacctgcactggggacagcaacaatgttggcaaagatggagctgtctggccgcagcagcaccagggccatgcccccaaacacctgatcaacaggaaaaacagccaactctcagggatctcagagagattccctggctcccggttaggaacatggcatctctgaccatctctggcctccagaccaaggacaagcctgcctattactgctcagcctgggacagcagcctcagtgctcacacagcgcctcaggggaagtgagacgaaaactcaggagctcccctagcttcactcggtatgcgggggcgtcatagagcactgtttaaactaaaccaaaaatgacaagggctggtttccacgtgacaaagtgtgtgctattcaaaactattaaaaataatatcataagttaaaataactaaatctgcagtattaatgaatatttataggaaacattgttgtgaatatatttgtggctagatacttacatgaacatacacatgcattaatcagtagtaaaaatgaatgcaagggtaaactaaggaaatatttattttcccagattttccttctcttttatttggagatgctggactaaatgctcagaggttccggtggtctgcctttgagtgtgtgttcagcagggtcacctcaagcttatcccaccttcttatgacctgggcccatgcctgtcctctcattagaatcccctttccctctgtcacagagctctctttattccttctacagacccagacttgttcctcacacttagttgaggcttcctgggccccacgtccctgtttgcccccaacacccacacaagacaatgatcccatgtgtgtgctcttgttgtgccctttccttatcctctgacatacctcaggcagtatctggaaagaacaaatgaagtgggagcgttagcttgtagttgaaaatgatttttgatattttggggaaaatatctggtttaaagatagttttccatcgagataaaaatgcatgtgtgacagcaccacatttctaatggcggaccaaagccccccacatctttgccccccacatggctccagggacattgacttgttaatatacaacccaggagagagcactgtgtcctatgcaactgcaatgcagaggcaggtttctgcccgctcctccaatgaagtgagtagcaaccccaaccccatcttcacccatcatttagatgacccccatacaaccacaacatagaaacacattgatcaaagggcctttttctctttgcagagacccctatttgtttatttggcatgtgagattttagacttttaccaacaattaaaatatactttattagaaaagttacacttcttaagaaactctgattcttactgtgaagttaatacctaatgcatcctataagcatagtaagtggaaaattgttctgtaaggagaagattaatcaatgaaataaaatacaagtatttgagagcaatctaataggtaaaagattagaggacataattgtgaatgccaggtgcaatataaaggaaatgtgggccgggcatggtggctcaaccctgtaatcccagcactttgggaggccgaggtgggcggatcacctgaggtcaggagctcgacaccagcctggccaacatggagaaaccccatctctactaaatatacaaaaattagccaggtgtggtggtgcatgcttgtagtcccagctactcaggaggctaagggaggagaatcacttgaacccaggaggcggaggttgcagtgagccaagatcacactattgcactttggcctgggtgacagagtgaggctcagcctaaaataaaataaaataaaataaaacaaaggaaatgtgaatacctagagttgattaaattgtggcccctcaccttcaacactcgaaaagctcagagtgggtagaaaagcttgttgagttatcttctgatgtcattgacaagataaatcagggacaatagaaggaatatgtggaaagaggtgccagaggctagaggggaaagtgtgaagtagccagcagagaggagcctgctggctgactacttgtgttagtagtagcaggtggtgttgacgccatctcccaggggaaaaccctgggaaacaggaaagctaaaagcaggctcaccatcctcatccctaacagaaccactgaagtgagcacaccagagtgtggggttccctcccggctcttcagatgacattgttatttggcaccaagctgatgttagtatgttctttataaatatatattgcacaaagaattgcataaaaccttcaataatttaatgaggactttctcacttaaaaaggtttttatgtctcttctgtggcccccataggtagccggggatccctcactgcatttcagtctgacaactcatcacatggacagagtccaccgtgtgtgactgtgtgtctgtgataataggtggcaaagcttcactgtcatagccgcacctgcttcattgcctggtgcttgcctttctgaaataggaaaataaactcttaccaatgtgtcataattaggttctatttaaaatctcctaccaaagttaagagcagcctgcacaactggtccacaaaatgagaaacctccaatttatttggactcttttctctaccctacccagtgatccaactggtcaccagccatgtggattctctctccaaaacgcttttaaattcaactctcctgtttactttccattctcatgtcttatgtcaaatattcatgtcacttacctagttctgatcagttctctggctccatggacagctcccccaactctgccttcctgaccatctctgggctgcggattggagatgaggctgacttctcctgtcagtctcatgatgaaagctacaatctcacagtgctgcaggcccattgggcagtgacaggaaaactccccagagcaccctcaccctgagtctgccatcagcctctccccaccagcatgggttgctttttcctgtcccctgtttgaatgtttgaattcaaattttctgtttatgtgtctctctattttctttccaaaatacacaactttttctttcttgtcttcatggatggtttttctggtccctgtgaaattactttatgaagaatatttagtttaaaacatagtttctgaacattgtcattttaacattgtgcactgggtcattcattgtgtgaggggggctgttctgttcatggttggacatttataagattattgggactcacacatcagatgcctatagcaccctaattcccaaattctaacaaacaagcaaaaaatgtagacattgcaaaatatcctagggagacagcactgcagaatcacccttgtctgagaaccactggattaaaaggacatggtttcacgtattgggcagccttttgtgttgaaccctccttatcccattccactgaatataaggctacatgcattatatctcgatggttccaaatttcctcttaaacaaatgtgtgggatacaactccaaaggttatgttgacagatgaataatcctctgaacaccattagttcagaaaacctgctacccaatgtacagcatctcttgctgaccagagtgtggagtgaaacatttgaccaaactgtgtgcataattgctaattcaaatttttaggtaaaacacctaaaacataacacattcttctctacttatcctcttaggggttgcttttcaagcatggtgtacaaaattatgacaaggcctcgtatgtgtggagtttacattttagaatgggtagacgacagtagacaagagcagcctcagaactgagcagtcagtgaagtcctttttttagccctagcgctggatgcaaattttaccagctgccatttgtgtttttgggcttgctccacccagtacagtccccatgaactgcatgttgatatgtatatttcaaagttaattaattaaaactaaataaactttaaaaaatattcctcagccacaccagcttcatttcacctgcctcctggactcatgctctccatccatggctctcatgctggagagttcagacacagggcatctccaccatggcataaagttctactgcagagcacagtctgtgacaatctatttaacacttccttaggccagtttcttcattacctgtaatggggatatagtaacactcaagttctcttcacagtctggaacactattctctgtgggagtattacctcggccccttcttcctacagaacggaggagtgataatgtaactagtattggccaataagatgaacagaaatgagaggtgtaatttctgagcagtagatgtaagattagcctgtgctttgtcaagttctatcatctctgacgtaacacccacagtgttctcacagaattctctcaaccatcctgcatcctgggatgaaggtgaagtgaactgaagccccaagcatttcaatcagagatgggaatggtggaggagtgagaaatatacattcgttgtgagtcaccaagatttctgtcaatttctcactgcatccaagcctagccagtactgagtgctatggaaattataagtgaatgtggggagccacaatgacaaaattaacatctatctataaatatatataatatatattaattacattatatcatatactaatattaatatataataaatatataatatataacacttacatattatataagtatataatatataacacttacatattatataagtatataatatacaataattaatctatattacatataatatattaatataaatatatatacataatttgatttgatgcaatactgtgaacatttagtagactacggagattgcatgatgtttcattttattcactggcaaatatttaattaagctgtcaccataataaacattaaaacacacagaattgacaaaataattctcctgagctgtggatatacaagttagacaactgattagaagcataggttcactcctgtgccatttgtggaatttttacaacttatttactttaagtgatgattttaagcataattggtttttgttcttgctttttatttattcaagcagaagaaagacacaagaatgataacccacatacatacagagtagtagaatggcaagagctaattattctcaaacacaaattcttaaagataaatgtaaaatatttgaattaaacattttgctatccaaaaaaaggtatgccgtttttttcctgagtactccagggcaggaaagtatattcatcaatccccctggtgtccgctttcttaacacattgttcatattggtatatatttttttcttattacttaacttactcatcctatatattgtgtttcctaaatatatttcaaattcattctcagccttgtgatttccctcgccctcattatgtcccatgtcctgctggggctcccccataccacccctctcctcatctgtaatgccccctcccagttcctgccctcctgggaactgctgtgctcttttctgccctgagccttgttacctccttcttgtactacctatttgtctcagtgagctcctcttccattcttcaaaggctccagagccctagagaagagcatcatctcaaaaaatttcccaagaagctgcaagtaatgagagtgtctaagaccactctttctgctttatggcaattttatatttaacgtggtattgagtcttgctgaattttcagtctgaagtcataatgtgctcaaatatacaaattccagagacacagagcagaatggtggctgccaggagctgaggggaggaggaaatggggagttgctggtcaacaggtgtaaagttttagttatgcaagaatatgttataaagatgtgctgtgcaacacttatctaaatattaattattaatcaaacaaaaaattcaaaattattaacacacatttccccctgggtttactggacagatgattttatatttgtctctgctaagtagactaaggtgtaaggatttggcacgaaagttgtaaaccacaaacccagccaaaaacaaaatattctttatacagtttttcaataaataaaattaatttaatattgctagtttaataaaatagctgtgtcttctaagttatagataaattttgcatatttttcactttaaggatcttacttaggtaaacaactgcatataccaactactaatattactaagaaaaaatgatttagagaaataaaaataattttcttgtgtctcagttttcacatataatctaaataaatttttaagtaactaaattagatgaatataaatgaagtaaacacttctatctaaactttttgtataatttaaaatcttaaaaaataaattaaataataggtactcttaaaaaagtgtaggtcatttaaaattaaaaatatatattttggatatagttataaaaatattaaaatagttctcatgtataaaagatgaatttatgagagacaattcaaagtttcttacatcctaggttttgagtaaaaattattgttaaaataattaaaaattctaattaatatataattcaatatataaaataagacaaaaataaaaatactaaatatatgtttttaagttaaaaaagcaaagtcataaaatatatgctttattaaaataattttgccaagttaagatgttatataatggttacttataaagcaatataaaataaattagagagatataaaatattataaatatagatatctttttgtaaaaaacattagaacataattttatattgaacaatcttatataatttttgtcctaaaataagatgatttactattttaagaagacaaatcaaaatgtcccaacaagtcttagtctatgtaaattataataaaatacatttgggaattatgtcccaacatatcttactctatgtaaattatagtaaaatacatttgggaattatttaataaaattaagtataattaacaggactataattttaaaaattatgtcttcctaaatattaaactttaatattgaaaatacacaaatacaaaactgaatattttgattttctatgtccaaacacagttttcttaatattaatttactctaaataaaagatttaaacattgatttttaattttaacatctatttctctttaaaacttctcaaaattacacttcaaaagttcaaattttgttaatattttcacacataatttacagacttttattgtcatacctttcaaaaaaatgtaatttttttacttcactgggacaataactcttttctttaacctttttttaaattattatactttaagttttagggtacatgtgcacaacgtgcaggtttgttacataggtatacatgtgctatgttggtttgctgcacccatcaattcctcatttatattaggtatttctcctaatgctatctctcccccagccccccacccccaaacaagccctggtgtgtgatgttccctgccctgtgtccatgtgttctccttgttcaactcccacttatgagtgagaacatgcggtgtttggttttctgtccttgtgacagtttgcttagaatgatggcttccagcttcatccatgtcactacaaaggacatgaactcatccttttttatggctgcatagtattccatggtgcatatatgccacattttcttaatccagtctatcagtgatggacatttgggttggttccaagtctttgctattgtgaatagtgccataataaacacacatgtgcatgtgtctttatagtagcatgattcataatcctttgggtacatacccagtaatgggatggctgagtcaaatggtatttctagttctagatccttgaggaatcaccacactgtcttccacaatggttgaactagtttacagtcccaccaacagtgtaaaagcgttcctatttctccacatcctctccagcatctgttgtttcctaactttttaatgatcaacattctaactggtgtgaaatggtatctcattgtggttttgatttgtatttatctgatgaccagtgatgatgagcattttttcatgtctgttggctgcataaatgtcttattttgagaagtgtttgttcatatcttttacccacttttcaatggggttgtttgctttttcttgtaaatttgtttaagttctttgtagattctggatattagccctttgtcaggtgggtagattgcaaagattttctcccattctgtaggttgcctgttcactctgataatagcttcttttgctgtgcagaagctctttagtttaattagatcccacttgtcaattttggcttttgttgccattgcttttggtattttagtcatgaagtctttgcccatgccaatgtcctgaatggtattgcctaggttttcttctagggttttttatggtgttaggtctttttttttttttttttctttgagacagagtctcgctctgtagcccaggctggagtacagtggtgtgatctcggctcactgcaagctccgcctcccgggttcctgcattctcttgcctcagcctcccaagtagctgggactacaggcacctgccactgcgcctggctaatttttttttgtattttttaatagagacgtggtttcaccgtgttacccaggatggtctcgatctcctgaccttgtgatctgcccgcctcggcctcccaaagtgctgggattacaggcgtgagccaccgtgcccggccatggtgttaggtcttcattcaagtctttaatccatcttgagttaatttttgtatactgtgtaaggaagacatccagtttcagctttctacatatggctagccagttttcccagcaccatttattaaagggggaatcctttcctcattgctttttttagtcaggtttgtcaaaaatcagatgattgtagatgcgtggtgttatttctgaggcctctgttctgttccattcgtctatatatatgttttggtaccagtaccatgctgttttggttactgtagacttgtagtatagtttgaagtcaggtagcatgatgcctccagctttgttctttttgcttaggattgtcttggctatgcaggctctttttaggttccatatgaactttaaagtagttttttccaattctgtgaagaaagtcagtggtagcttgatggggatagcattgaatctataaattaccttgggcagtatggccattttcatgatattggttattcttatctatgagcatggaatgttcttccatttgtttgtgtccccttttatttcatcgagcagtggtttgtagttctccttgaagaggtccttcacattccttgtaagttggattcctaggtattttattctctttgtattaattgtgagtgggagttcactcatgatttggctctctgttagtctactattggtgtataggaatgcttgtgatttttgcacattgattttgtatcctgtgaccttactgaagttgctaattagcttatggagattttgggctgagatgatggggttttccaaatatacaatcttgtcatctgcaaacggagacaatttgacttcgtcttttcccagttgaataccctttatttctttctcttgcctgattgctctagccagaacttccaacactgtgttgaataggagagggcatccttgtcttgtgctggttttcaaacagaatgcttccagtttttgcccattcagtatgatattggctgtgggtttgtcataaatagctcttattattttgagatatattccatcaatacctagtttattgagagtttttagcatgaagggctgttgaattttgtcgaaggccttttctgcatctattgaggtaatcatgtggtttttgtcgctggttctgtttatgtgatggattacatttattgatttgcatatgttgaaccagccttgcatcctagggatgaagctgacttgatcgtggtggataacctttttgatgtgctgttggatttggtttgccagtattttattgaggattttcgcatcaatgttcatcagggatattggcctaaaattctctttttttgttgtgtctctaccaggctttggtatcaagatgatgctagcctcctaaaatgagttagggaggattccctctttttctattgattgaaatagttttagaaggaatggtaccagctcctctttgtacctctggtagaattcggctgtgagtctgtctggtcctggactttttttggttggtaggctatcaattattgcctcaatttcagaacctgttattggtctattaagagattcagcctcttcctggtttagtcttgggagggtgtatgtgtccaggaatttatccatttcttctagattttctagttttcttgtgtagaggtgcttatagtattctgatggcagtttgtatttctgtgggatgggtggtgatatctcctttatcattttttgttgtgtctatttgattcttctctcttttcttctttattagtgttgctagcggtttatcaattttgttgatcttttcaaaaaaccagctcctggattcattgattttttgaagggttttttgtgtctctatctccttcagttctgctctgatcttagttatgtcttgccttctactagcttttgaatgtgtttgctcttgcttctctaattcttttaattgtgatgttagggtgtcgatttgagatctttcctgctttctcttgttggcatttagtgctataaatttccctctacacactgctttaaacgtgtcccagagattctagtacgttgtgtctttgttctcattggtttcaaataacgtctttatttctgccttcatttcgttatgtacccagtagtcattcaggagcaggtttttcagtttccatgtagttgagtggttttgagtgagtttcttaatcctgagttctagtttgattgcactgtggtccgagagacagttttttgtgatttcttttcttttacatttgctgaggagtgttttactaccaattatgtggtcaattttagaataagtgcgatgtggtgctgagaagaatgcatattctgttgatttggggtgtagagttctgtaggtgtctattaggtctgcatggtccagagctgagctcaagtcctggatatccttgttaaccttctgtctcattgatctgtctaatattgacagtaggatgttaaagccttccattattattgtgtgggagtctaagtctctttgtaggtctctaaggacttgctttatgaatctgggtgctcctgtattgggtgcatatatatttaggatagttagctcttcttgttgaattgatccctttactattatgtagtggctttctttgtctcttttgatctttgttggtttaaagtctgttttatcaaagactaggattgcaacccctgctttttttttgctttccatttgcttggtagatcttcctccatccctttattttgagcctatgtgtgtctttgcacatgagatgggtctcctggatacagcacactgatgggtctgactctttatccaatttgccagtctgtgtcttttaattggggcatttggcccatttacatttaaggttaatattgttgggtttgaatttcatcctgtcattatgatgttagctggttattttgcccgttaatgatgcagtttcttcatagcttcaatggtctttaccatttggcatgtttttgcagtggctggaacctgttgttcctttccatgtttagtacttccttcaggagctcttgtaaggcaggcctagtggtaacaaaatctctcagcatttgcttgcctgtaaaatattttatttctccttcacttattaagcttagtttggctggatatgagattctggtttgaaaattcttttctttaagaatattgaatattggcccccactctcttctggcttgtatggtttctgctgagagatccactgttagtctgatgggcttccatttgtaggtaacctgacctttctctctgggtgcttttaacattttttccttgatttcaaccttggtgaatctgacaattatgtgtcttgggattgctcttcttggggagtatctttgtggtgctctctgtatttcctgaatatgaatgttggcctgccttgctaggttgagtaagttctcctggataatatcctgaagagggttttttttttttgtttttttttttttggttttttttgagacagagtctcccactgtcacccaggttggagtgcagtggtgcgatcttggctcactgcaaactctgcctcctgggttcccaccattctcctgcctcagcctcccgagtagctgggactacaggcacccaccaccattcccggctaatttttcatattttttggtaaagacagggtttcatcatgttagccaggagggtcttgatctcctgacctcatggtctgcccacctcggccttccaaagatctgggattaggaggcatgagccaccgcacctggccctgaagagtgttttctaacttggttccattctccccgtcactctctggtacaacaatcaaacatatatttggtcttttcccgtagtcccatattttttggaggctttgttcatttcttttcactcttttttctctaatcttgtcttctttgtttatttcattaatttgatcttcaatcactgatatcgtttcttccacttgattgaatcggctattgaagcttgtgcatgcgtcacgaagttctcatgccatggttttcagctccatcaggtcatttaaggtcttctctacactgtttgttctagttagccattcgtctaacctttttcaaggtttttagcttccttgcgatgggttagaacatgctcctttagctcagagaagttcgttattaccgaccttctgaagcctacttctgtcaactcgtcaaactcattctctgtccagttttgttcccttgctggcgaggagctgtggtcctttggaggagaagaggcactctgttttttggaattttcagcttgtctgctctggtttctccccatctttatggttttatctacctttggtctttgatgttggtgacctacagatggggttttggtgtagatgtcctttctgttgatgttgatgccattcctttccgtttgttagttttccttctaacagtcagacccctcggctgcaggtctgttggagtttgctggaggtccactccagaccctgattgcctgggtatcaccagcataggctgcagatcagtaaatattgctacctgatacttcctctggaagcttcgtcccagaggggcaccgcctgtttgagacgtctgtcggcccctactgggaggtgtttcccagtcaggttacatgggtgtcagagacccgcttgaggaggcagtctgtccattctcagagctcgaacaccatgttgagagaaccactgctctcttcagagctgtcagacagggacgtttaagtctgcagaagctgtctgctgccttttgttctactatgccctcccccagaggtggaatctacagaggcagtaggccttgctgagctgtggtgggctctgcccagttcatgcttccctgcctctttgtttacactgtgagctactcaagcctcagcaatggcaggtgcccctccccccatcaagctgcagtgtcacaggttgatctcagactgctgcactagtagtgagcaaggctctgtgggcctgggacctgctgagccaggcaacgggagggtatctcctggtctgctggttgctaagactgtgggaaaagcgcagtatttggtcaggagtgtaccatttctcccagtacagtctgtcaggcttcccttggctaggaaaggggaatcccccgaccccttgtgcttcccgggtgaggtgacaccccaccatgcttcagctctttgggttgcacccactgtccaactagtcccaatgagatgaaccaggtacctcagttggaaatgcagaaatcacctgtcttctgcgtcgatctcactgggagctgcagaccagagctgttcctgtttggccatcttggaagagaccttccctgtgtattccgagccttctgcattctgccatcactgcagcctcctcatgttggatggacctgatatttttgcttttctagtaattcagaaatcctcagtggaaaggctgtttattaatatgagttatctccagacagggcaaaggtgtggtctatggatgctgtggattagcaatgaccaggctctcaggtgactccactcatgtgattttcacagaaagactgctgtctggccagtgagcagcacagggcactgtgagtcacactcagtgtctgcacagtgaaaacccaaaacttgccacccccccaaactccccagggctgggtagatggagtctgcactcactgacacagatttagcagctagatatggtcccagcacccccaccttcttccaagtcctgcgtgccagacaccccgacaacagctcccagatactgataaatccatggggagagttgggggtaggcagtgggagcaacacacttgcatccataacccctcctttgtgaggccactgaaggggataagagaggcctggagaagccactccagttctggacctcaggagggctgtgtccactgtgacctgggcacctattctcctgtgatattctatcatttctcaggtagggacaggtctcacgtcctggggaagccccctagcctgagttcttgccctgtgtttcactctcaccctttgtcctgattcctcacccacgatcatctttgcttgcaggttccctctctcagcctttgcttattcagctgccctccctctctgcacatctgagaaatgctataagacttccctgtaccccaagtagtggctgcattgttggaggctgtcacatattcttgtaccagcagaagtcacggagccttccccagtatctcctgagatactactcagactcaagtaagcaccaggactctggggtccccagtcacttctgtgaatccaaagatccctcgggcaatgtgcagggattctgcacatttctgagcagcctgagatcaagtccgactattactattttacatatcacagcaacagtggcactttcactgtgctccagacttacggggaagtgagattagaacctcccctgcattctctctgccttgtgcaggcaacaatacactgtctgggaccgagtgtggctcatcagtagcagctttgttgtttgtatttttcattcttcagtacagggtgggacctttctactggcctccattaatagtgagagtcaaacaagacagtctgtgggtgactccaaagtctaactcagggtttccttatgttagttagcttggactactcttggctcctccccagagatctcaacttctctggaattctccaggtgccacaagcactgatttcagtcttggccttgcacctcccctgagcagcttctgactctcctctcattacatctccatttatggcctgtcacccactcaatgtgttaaaaggtaaagcattttgcaaagtacttatcctgaactttagccccaaatccacccagcttccctagcccaggccagctctgcttcttatgaggctgatgagaggtacaagggctgcgacccttgctgagtccattcctgaaaatgcccccaataaagcctgattagcgccaatgccacaggacattgttctgtttcctttgcaggtggtgcccagtgaggaaagttcttcctcctgaatatgaatattttggagcatgaaacagctgagctgatctggggaggggaggcaaccccttgtgatggtggtcagattgcttggttgggattgtcacagaccatgtgataatgggattatattgcatatcacagatgcgctggaccctcaagtgtgctggggaactctggttaaagaatagaagtgatccctttgttcatattcactatgctggatgcccttttgagatccctgcaggacgctaaccctctgactgcggcagccttgccctttgatctgaagcttttatcatacattgtcctgctcaggggatttgggtggggcgttactcctatatatcatcacaagaaagggattctctggagactaaatgcaaactggaatatcccctggaggctgtccccctgattgggaaatatgaagagactaggggtgctcagtgtttaaaataaaacttcagagagtagagtctgagtgtaaacccttcaattccatttaatctctacaaatgtatataatgtcaaaacatagttatgtcatatatttacacatgtgcacacaaatctattaatacatgttcataagttcacatatatgctttatgttatacatatatgcatttatacatcaactgatgttattataatcatagttttacagactcaattttcctttgggtttttccacatttccccactttctttaacacttatttcttgaaaattttggtggctgcttactgagattttactaaaaaagagcttcagaatttcatttagagtagatcttgtggcaaattctattttttttgtctgaaaaaatggtattttttctcttttttatttttaaaacttatcttgaagcataatatgtaaagtgaaatttgcagatcttaattgtaaatttcagtgtgctttttatgaacacatatactcatgtgccccatgcgtactcacaacatttccattactgcagaattaaaacattttgttctagtcaatgaaattattccattacagaatagatatgtgtaccacatagaatgtgtacctgagacacacttcccctggggactccttataaagtgcggtgaattgtgtgtcttttttcccattgaggaggccaatgtggaaaactaaagactgagatgatgtagaaaactgccctgagagggaacctcactctgccctgaggtagggagccagcactggtcaaggccccggtggaggatggcacctctgttgggtccacctggcctctggtcacaggcacgatggacctgggcctgggcagcagggggcgctgtggggctggcacttagagtctgtggggctcttagctgggaaatgatacctggccctggcctctgcctagggctcactggggccagcagctgggtcctctctgggccctttgggagcctcagtccaggtacatcccaggcctactcttcccagaaatgacccagccactgggactgcacacgggcccagggaggggcacgcttgggcaggggaagaggagcacatttgcatgaaaggcccatctctctcctctaaggctagagggtgaacacgagagacctgccgcgtggcttcctctgcagagatccggggagtctgcaccatggccttgaccccactcctcctcctcattgtcctccttcactgcacagtccaggacggcacaaagcatcctgatcccccagctcactgacaccacctcccaactcatgccagaactgtccttccctgttctgctttattcagtgtataatggctgtctgtgttttcgggatccctctggcagcccgtgccgactcagtcgacctctgcatctgcctccctgggagccctggccaagctcgcccacactcagcagtcagcatagcagctatgccattgaatgctttcggcagcagccagggaaggcccatcagtacctgatggagcttaagagtgatggaagccacaccaagggggctgggattcccagtcactagttctcagtctccaggactggagctgaccactatagtgtcatttctacaatcccgtctgaggatggagctgactatatctgtggtacagattgtagcattggtgtgccgtttgggtaaagcacagataaatggggaaatgaggcaaaaactgtttttctactctgctaccaaggttgaaaaatggctctcagaaccagtgtctgctgacctgcatactcaaatatgttatgtgtgtgtgtgtgtgtgaatgcgtgtgtgtgtgtactttaattttacgagtagagagccagatattttctgattcctgcttccagttcccttggaaacagctttttaggccaggccttctagggagtgcactctgatctgtaactattgtgcaaatattacaacagagcctgtctcctcctgctggtctggtgtattgtggctatataggggggtgcaaagaaattctccttttcatattcagacactgggactcagctgcatacctcagtcctgtcttattgagatcatttaaatgatcaatcttagaagaaaacttctgacttaaataaattttagaagtctatcaacatgctagaaagcatattccagataaataaaaatagaataaagatttatagagattgagatgaaaagctttaaaccctttgggggtttctgaaggtattctcaggtgttcagtgcctgggatttgggagtaagggataaggaggagaacttatttccaacacactgaagatgacaacagataagcagaaagttaccaaagaaggaggaatagaaatagccatgaatatcatcctggtaaccctgatctggaatgaaggatttcatttatttacttatttatgtatttattttcaaaataagtacatctcatggagtccttggcaaaagctgaaggaagtattgcttcaggaaatatctgtccagtaattaggaaactactaatgtgattgagcagagacttcattaacttcacatgcaaagaatacagacttgcagaaccctcctggaaaaccatgaaacaatacatcatcaacaataacaactatagcaaaaacagcaacaacatcaaccaaaacgctttacaaaaaagttctaatttccagaactgtcacattatattatttaaaatttccatttgtcaaagcaaaataatgaggtaggttcaagacacaggaacatattgccatatataacggaaaataacaaagaaaaaaacattaaaaaaacaaaaaaattaaaagttgacaaaaactattttcaaagaggcagaaacactggtcttattcgaccaatacttcaactccattatttctccatttgctcaaagaaattttaaaaatgtaaaaatgttcaaaaaagcatgaaaagaatgtatctccaaataaagaatattaataaaagatataaaagaaagagtcattgaaataaacatagattaattgatattatcctattacaggaatagaatgaaataagggtggaaaaatacgcaggacctaaagaccctcttgacaccatcaagtgtaccaatatacacataatgaaaggcccagaagggtaagagtgaggaaaagaaacagaataatgtaattgaaaaatggtaaccaaaactttcccaaatttgacaaaaagaaacatactcaatccctaaaaagttcaataaaccttaatcagcattaatcggaactcatagatataaaacttatggaaagcgtcatggtgggataaagcttactaagttctaaaaagtcaaatagacaaagacggttacaccaaaagtgtgtcaatttctgtttcctgccatgatgcaatagatggagttcttacaccataaacaacactttaagacataatcgagtgcatgtaatgactatttccagacagtgaatattggccaacagggataacttgattatgtaacctcagagaaaggaccctaacacgcaaatgagcactgcagtggacacggatttctttttcttcactttttttttttcgagttagggtcctgctctgtcgcccaggctggagtacagtgatgtgatctccgctcactgcaaactctgcctcccaggttcaagcaattctcctgactcagcctcccgaatagctgagattataggcactcaccaccatgcccagctaatttttttgtccttttagtagagagggggtttcgccatgttggtcaggctggtcttaaactcctgactgatctgcccacctcggcctcccaaagtgctgggattacaggtgtgagccactgcacccagccaacacagattttttttttttaattatactttaagttttagggtacatgtgcacaacgtgcaggtctattacatatgtatacatgtgccatgttggtgtgctgcacccattaactcgtcatttaagtatatcttttttttttttttttagacggagtctcgctctgttgcccaggctggagtgcactggctctatctcggctcactgcaagctccgcctcccgggttcacgtcattctcccgcctcagcctcccgagtagctgggactacaggagcccgccaccacacctggctgattttttgtatttttttagtagagacggggtttcactgtgttaaccaggatggtctcaatttcctgacctcgtgatccgcccgcctcggcctcccaaagtgctgggattacaggcgtgagccaccgcgcctggaccacagatttttttttggagacaatttttggcccagaaggaggtggtgaccaagataatcgtgagctttttacacagctcagaacacacagatgagaagtcagaaaaacatagatggctgagactttcagagcaagacactgaaaagcaggcagctacacagagcaaggtccctgcgctctgcatgaggcccctttggatttggttgggcaaaacatgacaccttgcagggggctctaatttaatgaataggccttcccctactgggaactaagattcatattttttctctctgtcctgttttttcaccactgtatctacaaaccctaggactcagcctagcgcaaagagccaattaataccatgtttgttgaacgaatatgtgaattcacctaaatagaattctcagtaagagaaaaagatctgaggaaaataaagtgatttttactgctttatgtgtattttgagtttgggttgtgaattgattcaaggggatatattaaattagaatgttgacctccgtgtttagagaacaagagaggaatatgaacttgagtgctggaaaggtgaccagcaggatggactgggtcccatgggtttgtgcagagaccatggaaaaggatgagcctccagttactaagtaattgaacaagatatattttaggtaaacacttattttataatcacctgttggaatgggtgataactgtagatgtgactgttattcattgactctctgaaaaaattatttattcaaggcaagaaagattggagaatagttttatcttgaaacacttttcataaacatgacatattcttgctaaagcagataccatattcatctccaagctggaagggttatctcatcttcccaaacatgcaccccttatagtatattttatctgcttttatggcatgtccactttcttggtcacagacattgtaagcctcagagtttaatttgtttctctactgtatacgtatggcacctccagttggtcactgaagctggagattgaaatcctctacatcccccagatctgtcctctggctctatggcgctgtcctgttccatcagacctacattgcccttccttgtgtgaaccctaacctaagtccaatctctactccatgaaagctgtctgtaacagaagcctggcacctctttctcctttttatgaaataaatatctatttctatagatagatctagatctagacattaatagctccaaatctgtagaggacaaagtgcctagttctcaggtgataaccaacccacatcttctgtcctggaatatccagccccagatatcaccccattttctcctccctgtctcgctaaatatatattcacccaccaagccactgggtttgtagtaatttgtcacaacaagaacagaaaaatatgtggaaaagaatggaagaggagtgttgctgttaaaaaaaatacttaaaatatggaaatagttttggaagcagacaagagatagagtttggcagaattttggaaagcatgttagaaaaatcctagattgctttgagcatggtgttaatgcagatatggttgctaaagacttggctgggatgggctcagtaggaagtcagaagcatggtagcgaaaaagctacattttctttcttttttttctttctttttttttttttgagacagggtcttgctgtgttgcccaggctgcattgcagtggtacaatcttggctcactgcagcctccacctcctgggttcaagcgatttttgtgcctcagcctcccaagtagctgggactacaggtgtgcgccaccatgcccggctaaggttcgtaattttagtagagatggggtttcaccatgttgtccaggctagtctccaactcctgacttcaaatgatctgcctgcctcagcctcccaaagtgctgggattacaggcatcagccactgtgcctggtctagttacatttttcttagcaaatacctaattatacatctacagactggaagtagaaatacagccagtaccagcactttgggagaccaaggagggcagatcataaggtcaggagatcgagaccatcctggccaacatggtgaaaacttgtctctaccaaaatacaaaaaaatttagccaggtgtggtggtgcatgcctgcagtccaagctactcaggaggctgaggcaggggaatcacttgaacctgggaggtggaggttgcagtaagcccagacagatcacaccactgccctccagcctggtgacagagtgagactccatctcaaaaaaaaaaaaaaaaaaaaaaagaaagaaagaaaagaagataaaagaaatacatccagtaaaggagctcctggtgcactgatgggagttcacagggaattaagagcgctcttttgacttttgtgggaaaaccggaggaaaggggatcattgttttttggtggaaaacaggttggctggattgtttcatgcaattgtatggaaagcagaacaggtgagcagcaaacttggatatttagctgagaatatttccaagcaaagtattaaaagtataacctcattcattcttgctgcttacagtaaaattttgtgataaaaaatgtgaagtaagggaggaagtcttaaatggaaagaaactagggcatgataattgaggagattactagcatatttcgccaattacttgctcattccctcttttctgggagaccctaaaagtaactcatcatttactgttttccatccgcttccttccttgtctagaatatgggcctggaccctccacaagatgcgtagagaagtcagaaggccttgtcctgtgcaagcattcaagcatccactcctcgcactaatatttctagacagcaaactggtgatccttgctcacctgaaacatacatacgggttggaggaagacagaacctaacacaccttacctgtgtgatgttcagggctggcctctaacttctgagagcttcatttcactccacttcctacaaggattgctcatgccctccttcacttgtggtgaagttcaaacaatacattagatttgacatctttgccaagagctgtagagtgcaaggtgctcacccagagctacatcttccagcagatgaggctcacagttaaatcactgctatggtgtccgtcaactcaggcactgttgtgccttttcacagagcatcgcctgttaactgcttcacccacccactgtgggagtccaggtaggaggacaatgcctccccactagctggctcctctctggttgtacctgtgggtcacacatgcaggtgacggtttgtactacctcctacctggctgtactccccaaagccagggctgacacccctcactgcacttccattccatcccatcagtcacaggaggcagctattggctcattaccctttgcaaggagttcaagggtagaagtggcccatttataagaatatttatatggactatcttgtatatcctgtgaatcatgatactgttaaatcaactctaatacatcatgtttatgtccactgaaatgatgatgataaaaggaaaagtgatatctggacacgcagactgaaaaagatcccaaagattctgcacacaaggcccctattctctggggacatgtgggaattcaatggtcttgctgacatatagagtttgcttcactctgtgtcaatctgaggcatttgtgacctcagagttgtgttttctaagaatttaccatgtgtggcagctggacttcaagttatacctaaatatctctgtctcctagcactcacatccctgtacatattgaaaagggatcactagtacaattgataggatattgagaaaatgactgatgccaggccataatacactttgagttttgcgttctgctctctcagatcacttgctttggggaaagccagttgccatttgtgaggacactcaagtagtcccacagggagtttcatgcagcaagaagctgaggcctcctgccaccagctttgtggctcagtgaaactgtaagttgattctattgccttggtaaagtcttctcatggctttagttccccccactgaaatcctattttcaacctcatgagcctatctgagccagagccaccttgctaaactgctcccaggtttctgacccacagaaactgtgggattgcacatctttgcagttgctaagttttgtagtatttgatgtgaagtaattgaaactggatgcatcgagagaggggaatggaggtggcagagtgggtggaattaggcctggaggtctgctttcagtgagatgtgatgggaccatggcagacacctccctgtttctgattccagtggattgcttactgggcctggcctttttcttatactccatgacttcattgttaataccctacaggaattctgtatgcgctatgtcttatccatcttccttgggtaaatatttaaatataaatgaatcaaaacacatgggccactttctaatcttgattgttcaaaactgaattcctcaaattgaggggtatgattttctttattgtccttggtgctcgtctgccagtgtctatcaatggtagaatcatgtaaacagtcccctcccctattttgtttcactctctgaggacgagagagaagtcttggccttcaacagaaaatggtcaaactagaaagagtaacacttttgagctcctcagtgaatgtggccttggaaaaccccttcacctgggcagcaaaggaagagggagaaagacagagcctgaactggtaggaagtcctacctcaaaaacatcagtcagtcctcacatggatggccagggcattaaggagaactaattaagttaatttcacattctccatgacaaatgctgttgtcatcagtagggacctctcctctctttttccatcctcctacctgttctcactgtccctgacttacccacagtgaactttatgttttcaccttttatatccctatgcctggtcctctgctggcctgtgctgatcttttcataaatatttttgaaatgagaagacgcattttcttaagtaccatgaaagtcgacatcacatccatctttcagggtcctgctcccagactcttctgacttatctgttcactgtgctgggttggcagggaaaagtcatctgcagcagaaaaagtgacaaaatggagatacatagtgtgtcttggccaaaaatcagccaacagatgagagagatctaggattgtgagaagttctgccgttccccagcacctcacactatttgatgtctcaatgtttgtacatatcactatattttctagaagatgcactacatctagaaatagtgtttgctttgtttgtccccaagcaggaccccactctccactcagagccagttcacagttgccttcttccctggcccctgtggaaggagctgctcaggtgtttgctcccagagccctccgcattttccccttactgcggcctcctcacaatgaacaattgtcatgtttttcatttctcctgttcctgttattctagaaatccctcaatcaaaaaggatggttatgaatataagttacctgagacagagcaggggtgtggtccatggatgctgtgacctgacagggacccagcactcaggccaactccactcacatgattctgactgaaagactgaagtgtgcagcagggggaaatctgggtctttccaagctctgaacagtggtgcccacatatctgttatccctgggcaatggagcctgcactcactgaggaagataccacagctgtgtcttctctgggctgggtagagtctcctactcacaggtctgtggaaggtgcaggagctgcttcctcacttactcctcccgtgggacaaacgctgagtctcacccaccaacccaccatatctaaagaatcatgctcagacttcagctcttcctagggtggaacaaagattaccaggaggatacacaaatttgtgtggacagatcctcccttttcaggccactggagaagataaaagaggcctgagttaagcagcttcctctgtggggccacaggaggcggtgtccaccatggcctggacccctctgctcctcatgttcctctctcattgctcaggtgagaactggttttaggtgtctagggttagctccttagcttgcgtcagcctctctggctcagatccccaagacatgtatctctagttcctgccccagcccccatgagtgtctgtgcttgcaggttccctctcccagcctgtgctgactcagatgacctcactctctgcatctccgggagcatgagccagacttacctgcaccctgagcagtggcttcagagttggtaactttgcaatatagtggtcagctgaagccaggcagccgtcccaggtgtctcctgagatactactcagactcaaatatcactcagcaccctggggttcccatccacttctctggatccaatgatacattagccaatgcagggattctgtacattcctgggctgaagcctgagggtgaggctattactgttgtacgtgtcacagcagctccaagtcagcactccagacccactgggaggttacaaaaacctcttctctgatctcctggcctggtgtagtcactcctgctggtggctctaataaagtctatctcactgggtgacttatattttagatcttcaaccagcacctgattctttttttcagacaagtagatctgaaaatgtgactttattttcttcaattccactttcatattgattcatgctcataccttctcatttctttctggttttcacaggcagaaatcccttgctcagagacaaaaattctctaaattgagactttggaggagaccaaaagagagtggttcgggccatgcccggctcagagtctaggagtgactcagagatgcttctggtcccagagcttcaatctaggcattggatacaataccagcattcacaatggaattgtattctctatattagcaacaaaccatcacagattttgaaataaaaagaatataatttataataacatcaatataaaatatttaagggtaaatattaaaaaatggaaagtcttaaactgaaaactataaaacgttgagagtcattacaaaaaaaccttaaaataactgatattccttgtttgtagttggaaaactcaatgtgattataatttttataatgacaattctttccaaagttatctaaggaatcattgtaaggtcttcagtaaaaataggtttgcagggaatgaggagataaaaaaatctcaacaaagaaatgaaaactgtaacagaaaacatcaatgaaacaacagacctgggataatccttctcagctgccatgggatctaactgtatttaagaaaggggtgagtaggaaggcggctgccaaatccaggaacacagatgtcattttgagtgaccaaggtgagccaagggaggacagctttagtcagaagagcatagaccaggagcagaactcacatatctgaagctgatgggcagagtgtgggtgcaataggcctggcattgggtgctgctgagctgaaattatgctgtcacctgaggtgcgcccctggggtgacatggttctggttgttcttcaccccagggaaggacactgtgacctgttatctgttggaggatgaggactcagaaagctctttataagagagggcaccagtgtgatatgagggtccctgattgtctttccaaaggttggaaattgaacccgcatctttcatttttgtgtagagaacccaagatccttttctacataatcaagggttatttccaatagctgccttggcctgtctcagaaagagtgtgggtttgtcttacagcaatggtgcccactatttatgggaacgtcttgtataccctgatctatgctttcaggtctttgacatctcaggtttttggcctacctaatactagccatacgtctgggtactgtgatctacctcctactacacatataaatgcccatctcagcctcatctctccttgggatataaatgtgtgcaagggatttgaagcagctctgccttctttttgggtcctaaggatcagggttatgggtgtctccatccttccctgggtcttctcctcctcactgtcctgaaacatgacccagacacaggctcctgaggctcctgcaggccttcttccctgcttttgccaactgcaggtggaccctgccctgtgctcacaggtctttgtatctctccctgctggtcaattgccctgcaggggcttttcttatttctccattatgagaattcctttgtttttggaggaaataatttttatctaatttttgatttacttatcataatcctagaatttgtataaaaactcctgtttttgcataatgaaacagttgctatctcatgccattttattcaaagtcatgtgcttctgttcacttactggttagaactattgtttaatcattgacaaatatttatcgaacacccactctgcgccatgttctcctatgtcaggtgctgggtatacattgatgaatgaaacagactctatccttatggaacttgtgtctagtgagcttagaagtaaattttgtgagtgctaggatggagagtcaagctaaggactcttagttctgccagcatttaacatgttgttcttatacattttaagaataaattactccagaagaatctttttgttttgttttgttttgttttgttttggtgaagagtatccacatagacacacatagcaaagaccttatagaatgcatcagagataaacaaaataaaatgtaatgtttcccagagctggatgtagtttctggtttgatttattttaatgacacacagaagaaatcactttataatgaagtaaaattccacactacagaaacagagtaaaaatactttcttgaaaaaaatgccaaacctacctttaatcccaaggaaagagaattgcttgaatagatctgttagtatgaaacacataatagacaacctgctgtgtaaaattacttggaagtcatattttagaaggttttaaacattcttaatatactctgtttttgatattacgtcttatatttttctctgtggtggaaatttatttctaagaaataagaaaggatattagaatggcaaaaaatatttgtataaatgtgttaacattttaatggtaactatatatgaataaaataaaaacattgttaaaaatttattggaatgaataataaaattatcaagtttataattaataaaatcaagtatatttcttcttatgcaatttaaaaatagtgcagaatgtttattattctggtatcactaaaaatgacaaacttcattcatatctatagaaaaataattataaaattcagcaagtaatacaggagataatttgaacaaatattgaaacattttcttacttaaagacactaggtaaaaatttcagcaatgagtagagaggttatcaaggcgcattttattattgatgattgatatatgttttttctctcgagaaagtgcacaggtgggtatcagcagaggagacagtataggctccccagatgtcaaagcagggatgcgccaatacccatcagtcatcatcataaaagacagactgtgccttcctgtgtcaggctctgtgccaggagctgtgtgccccacgttcccttccagggtcctgcctgaagtctgtgctcactcagccagccccatcatctggaagtaacagtcccctcctcctgcactggaataagcagaagatttgggtggacagtgtggcctggccccatcagctcccaggagaagctctctgtctctctctcatcctgcatgccagttaatgacgataaaacccacctaaccaacccatctacaacactcagcttcatccctatctctctctcacactccatcaagggacacagtcatcccatgggttttttcccctggcatctctcactttcttcctcttccagatccctgggatcagctatcaccccacccgacaccccttctcctgcttggctgccttcaggctctttgttgagcctgacaccaaaggatgtctttctaaagtgtcagtttcatctattctgcccccagttcacaacctgaaacaacctccgatagtgaatcaagccaagcccctcactctaaagcacagagacatgccatgaattcctaaggggatgacagaatacatcattgatgagaagattgaacaagtgaagtgtgagtggcaagtcaggtgaggacatttgaatccaatctggcatttaaaatgtctcttcatttccaaagtcctatctctccctagtaatgttgtttgactgctagtcccagagcaggaccccacatcccagtgacagccaagtcacagtcgcctccttccctggcccctgtggaaagagctgctcagggctttgctcccagagccctctgcattcccaacttcctgcagcctcctttcattggatgggggtgatagtttgcacatgcctttctagtaatccaagaaaaacttactgaaaaagtctgtttgttcatgtcagtaatcaggggcatgaccagggcatggcccataaatgcctctggactgatactcaccaggctcccaggccaacaccacatacatgatttccactgagagaatgcagtctggacagagagcagcagggtacactgtaggtctgcccagtgggcatccacagctgtgccaacccctcccaccccacaaattcctcagggctgggcagtggaccctgccctcactgagcctgactcagcagctctgtcctccctgggtgtggtcccagcacccacttcctcccaggtctggcctgccagactcccccctccaccagaccctaggacttgaataaatacatagggtaaggtagaggcaggcaatgtgggggacacatttgggtccataactcctcctctgtgaggtcagtggaggggataagaggcctgaggcagcccactatggctgtggacctcaggaggactgtgttgaccatggcctgggcccctctcctgctgtttctctctcaattctcaggtaggcacaggcctcccatgtccagggcatgtccctcaggcttcaccagtcccctctggctaaaatcttacagcaactttatgctggtaggtggcccaactcccatgtgcatctgtgtctgcaggttccctctcccagcctgtgctgactcagccgccctccctctctgcacctccggatcagccagactctcctgcaccctgagcagtggcttcagtgctgatttctgctggatatactggtaccagcataaaccagggagcctccccagtatctcctgagccactaccaaaattcacttcatgaccagggctccggggtccccaggcacttctctggattaatggaaggccggtccaataaagggctcttgctcatatctgatctccagtctgaggatgaggcttactattactgtatgatcgagcacagcagagcttctcatgctgacacacacaggtggggaagtgggacaaaatctcagcctgctcagagtcttgttctctgatgaaatttagatcttaaaataacttatatcacttgtgtgggatgagtgagatatcccgagctcacaggaactgtcgatgaaaagagtcgagctctgtaaaatattgaagacatttattccaagccaaatatcagtgaccaatggcccacaacgcagccctcaggagatcctgagaacatgtaccccaggtggtcaggctgcaacttggttttatacattttaaggagacatgagacatcaatcaacacatgcgagatgtacgttggttgagtccaggaaggcagcacaactcaaagtagtggggctccaaagatcgtctttttgataattggttaaaagagttaaattattgtctaaagacttagaaccaaaggaatgcctgggttaaattaaggcattgtagtgaccaaggttttgttgctcagaggaagcctccaggtagcaggctgcagagaaaatagattgtaaatctttcttatcagatgtaaaaagtctgttctctcagaaattccaaaaatgaggaggcatatctggctccccgttcccatgatgacctgaactctctttcagattaactttggaatgcccttggccaaaaggaggggtctgttcagatggatgggagtcttagaattttatttttggtttacaatcctgtaacacgtcctgtaatttgctgcccagaggtcattaatggcctggaagaaataatgtgccagctgcagtgttgtccacagaaagacttactcattctgctgccctgagtagtgatatcagaaagatccatctgccaacagtcagaatacccttccaggagggttgcacagtaccaggggtgctggaagacctgggatctgaggcaagcagggggcactgttggatggatcccaagatgacaggattaccaggccacacaaggattaaacaagagacagtaacagtccactggctcttacacacttggataagcagtgacctccctgaagaatgactttcctgcacctgggctgaaggacccacatgagcactgggttttggataaaatagagcaatttcatttatgaacatagatgtgaaaattcctcagcatattcacaagtagaacccatgctggacctctgacctctaggatttaggctgagaacaggacatttgtgaggtcggtggggaataagcatgaactttggagggacagcaggtatgaggggtgctgagccgtatgttagatgccccaatcagggaaagagcctcgaggcttccagtgcagcttccctgataccctgtgggagagaaagatagatactggatatgctgcaatagagctcactaatgctctagtaaagagcaggcagcttgcattagcacagtccttcaggagagaaaacgcagccccaggaaagctgtcagaggccaagatgactcattagtcacattgaattcataatgcatttatgatgaaatatatgataaatgtcttatccttttgttcttttttattttttattatcgtgggtacataataggtgtatatatttatggggttatgagatgttttgatacaggcatgcaatgtgaaataattatatcatgaagaatggggtatccatcctctcaagcatttatcatttgtgttacaaatgatccaattacactctttacataattcaaaaaagtacaattaaattattatgaccataggtatcctgttgtgctatgaaatagtaggtactattcattctttctaactactttttgtacccattaaccatccccacatcacctcctactccctgctaccttcccagcctctggtaaccattattctactttctatgtacatgagtttcaaatgttttgatttttagattccataaaaaagtgagaatatgtgatgtttgcctttctgggcctggcttattacacttaatataatgatctccagttccatccctgttgttgcaaatgacagactcttattctattttatggctgaatagtactccatcgtgtgtatttaccacattttttatgcattcatctgttgatggacacttagattgcttccaaatcttagctaaacagtgctgcagcaaacataggagtgcagctatttctctgatatactgattttctttattttggatatgtatccagcagtgaaattgctggatcatatggtagccctatttttaggttttttgaggaacctccaatcgttctccatagtggctgtactaaatccaagaacattcaaaatcatatttatatcagtgctaaaaagtgtgacttgacttcaaacaatagccagtagttggtaggaatacaagtataagtttgctaaaaatatgatttgtcatttatatgaatatttctgttcccagaacaatctcatgtagactggcttctggaatctctcctacctcctactgagctgactctcctggagcctggccgtaacggtgcagggctggaagctatatactacaagcacatgctgtatggcatccagcactaacctgggcagatgacggcgaaacaatgtgtgatatttccatttgatttattttccttctttctctatagaaagtgttattataaaactgttatgttgaaggaacacaaaatttgaaggaaaggaatcaaacataaatgttaaatgtttatgtgtgtttatactgttgatctatgatatctcttgtagttactgttcaacatttctattttatatgcttttgtaaaataaacaacatattttatacaaaaactctcatgtgtgctagttgaaagtaatgccacctaaatgcaataacagaatttgaggagactaaaatgtgttgatttgagagacagtaagagtaatttagaacaagtccccatctggctctgaaatctaatcctttgctggtatccctacacctgaaaacctgcaggctttgcacctctgcagacagatgacattgggttaaattcatgggtctccactgagggtcacaataggctggtgtggcacagtgcattctgggagatacagaactgagggacagtaggctgggcgcggtggctcacacctgtaatcccagcactttggcaggccgaggcgggcagaacacgaggtcaggagatcgagaccatcctggctaacacggtgagaccctgtctctactaaaaatacaaaaaattagcctgacgtggttggggggcacctgtagtcccagctacttgggaggctgaggcaggagaatagcatgaacctgggaggaagaggttgcagtgagccgagattgtgccactgcacttcagcctgggcgacagagcaagactctgtctcaaaaaaacaaaaacagacaaacaaacaaagaactgagggacagtatatccccagtggacaccgatccataatcagccccagtcactgcacagactgggtgtatggtgtcctcagtgcctgctgcttccgtgtaaatgaacagcaggagatcctagggtattagtgaattatatattcatttccaacgtcacactcaagatgaagtctctacagtatttgaaattgaacttggacagcttcaactatttttgtttcaaaaaatattatatatacaaaaataccctatttctgaaggtaattggagtttattttacttccacaataatactaaacataaatggttagcgtattataaagtggtgtgtctaggcatggacagcagaaggcacttggagcctgttcctgaggggtctgggggtgttcggagctgagaccagccacttcccctgtctggtgctctctgttcagggctcacagctgtgatctcctcacccctgaacggctcacagcactactcatacttatccctatggcgccctcaggcagaagagtctgatccagggctcagggtgggatcagaaaagttcccatttgcatgaggagatcctccctgcctcagagtataaagagagaaaaggagagagttgggaaaagctttacttcaactgtggggcaaaaaggcaggactcaggacaatctcaagaatggcctggtcccatttcctgctcaccccctttattcactgcacaggtgactggacatggggccacggaaggggccctggggagcccatggagagctgctttctcctcttatttatagacccagaatcaccatgtctgtgtctttcccactttcagggccttgggtcccatctgcgctgattcagtcaccctcagtccctggggctctgggccagagggtcaccatctcctgcactggaagcagctccactttggttattggtgtgatatacactggttccagcagctccaaggaatgacccccaaactcctcatctataaaaacaattggtgacacctgtgggtccctgacaattctctggcttcaagtctggcaactccattttcgtgaccatcactgtgctacagcctgaagatgaggctgattatcactgccaattctacaaaaacagcctgagtgctttcacagtgctccgggttgaagtaagtcagaccaaaacacacagtgtgcccagccatgaagctctcccatgcaccccctactctgcagctaagtcaatgtgttctctcacttgtttgtcctaaaactggggcctgagaacttcttcagggtaatttttctagggaatgtgtcctcaccctctcaatatctgccccaaattcactctttggcaacaataccatgtgctcttttctcagaggtagcagctggtactgaatgccagaggccagctgccctgtggtggagtacagatgggtgaatcagtcggctggggcttccacaacaacacaccacagactggagtcttcaccaacagatatgtattgtcttactgttctggagtctgaaaggaccagatgaaggtgccaccccgtttggttttctctttgccctctttcctttgcttccagatggctcttttctcactgtgtcctcacatggccacccccaggtctgcatgtggtttttgtacacatttcttatgaagtctttagtccttttggattagagactcattcctatgacttcattgaatcttaataatcttagtgtccagatctcccaatacagacaaattggtaacttagttataacataaaaaatcagggggccaggctcggtggctcacttctgttaatcccagcactttgggaggctgaggtgggtggatcacgaggtcaggagattgagaccatcctggctaacacggtgaaactccatctttactaaaaatacaaaaaattagctgagcatggtggtacatgcctgtagtcccagctactcaggaggctgaggcaggagaatcactggaaccaggaggtagaggctgcagtgagccaagatcacccactgcactccagcctgtgtgacagagcaagactccatctcaaaaaaaaaaaaaaaaattcggggtggatgcaatataatttgtaacaaaggatcaggggtccagggacccagagtccatctgtgtctgacccaggagaggtgatgctgcagaggccacctggtcactccattcctctgagctcctactatgtgcagattctggatgtgttcttggtgctcagggtacagcgtggataagacaggatggtccctgtcctccaggaactgatgctatttaggggaaaacagaacacatcagtaaatgtatcaataagaatatgacatgttttaggaaaatgaagagaggtgtgttttggtgaggtggggtgagcagacttagaggagttgatgacaaagatgcagcgactgattaaggttgtaaaattcacctgctgcaacataaagtgaactaagaggaagtgagggtccaggcagggccatatgaggctctggttttgacacaaacattaggctgtggagtcctggacatgggcggaacacgcaaacggtgaaaggtcatgtctgcatggttcagaagtgggaggtgctgaggaatggagtgtggggagacagggaccacagctgggatctcaggacctgtgaggggtataggtgagctgcagctaagtgagaaaacattaaggaccctgtgtagttgacacaagattattgacatcttaagtcttcaataaatacaatcagcgctgacaaatgtggccgtgcctcagaagagctagaaatgtttatgtctaggtaactctcatgttctgtagaacttcacttgtatttttttggttttaaaggattattataagagcagacgtttatgaatatactccattcttttatcctcaatattgcccatctcttaaaatcctttggctttacacacacctacaacaaactgatcttcaaaaattgataaaaataaacgatgtgtaaaggataccctattcaataaatgatgctgagaaaactggcctacaatgcagaaaagtaaaactggacccctacctcttaccatataaaaaattaattccagatgaatgaagacttaaatgtaagacctccaactattaaaatcttagaagaaaagttggaaaatactcttgtggacattggtgtgggcaaataatgtatgtctaatcatcaaaagaaattgcaacaaaaaacttgacaatcaggaccaaataaaactaaggagctcctgcatggcaaaagaaactctcatcagagtaaacagacagcctacgcaatgggaaaaatatttgcaaactatgcatctaacaaaggactaatatccagaatctataagaaagctaagtcaacaaaaaaatttaactccattaaaaagtggacaaaggacatggtcacttctcaaaagaagacaaaaaagcagccagcaaacatgaaaacatgcagaacttcacttatcagagaggtgcaaatcaaaaccacatgggatatcatctcataccagtgagaatgggtattattaaaaagtctaaaaataacagatgctggcaagaatacagaaaaaaaggaatgcttatacattgttggtggggatgtaaattagtacagcttctgtggaaagcagtttggagatttctcaaaaaaaaaaaaaaaaaaaaaaaactaccactggacccaggaatctaggtgtgtacacagaagaatataaataattctaccaaaaagatatctgaactcattcgtttgttgcagcagtattcacaatagcaataacatggaatcaactcaagtgctcattagtagtggatcgagtaaaaataaaatgtgtgatacgcattcaccatggaatactatgcagccattgtgaacaacaaaaccatgttctttgcaaaatatggatgtagctgaaagctactttgcttccagatggctctcttctcactgtgtcctcacgtggtcactctcaggtctgtgtgttgtttttgtacagattgcttatgaagtcattagtcctcttggattagagactcattcttatgacctcattgtatcttaattatcttagtgtccagatctcccaatacagataaattgttaattcagttataacgtgaaaattcagggtgaacacaatataatttgtaacaaaggatcagggatctctttggcttctcgatggatcacctgccaaggggcaagggtgtaatttttacaatgataggcgcatagctcttaacacaagacagaattaccctgttgaatgcttcattcaaatgatatgttagggaggaggccagttggatgataaagctttgggaatgaacatttaacagcacaggatctaaaatgcagaagaaaagaacctctgatgcaaactttctgagtggagataaactgtctgatatcctgcagattaataaaaccagaaacttcatctgccccctctaatagaaatctacacattaacacaatttcactatatgaagtttccagaagatgatgtggagcttgcaggtgagcttcattttacactttccgcctattcatttctgtgggaggacttactttccctctttcaattttctcatgtgctgttcatgtcacaccctctaattcaaggctccagcccacctttcctgccaacaccaacactctctgtagatgaaaacccaccagtcagcagcctccttggcctgagagaggtcatcttcctgggtttctaagactctggtcctgccgagattctccttcctcaatcctaatcccgtggtctctggcagccccttcacatggacctcatcgctcgtctctgtgttcctccagctatatccacgtcagaaactgctcttcatctgcactagaaataaagaattatcctctcaactcttaaatgtttgctctgattctctcctcttctttgagctcaggcacaccaccccctctcagattcctgagtgtggcagtgtcccctctccagtctccctaccacctccaatggtgaaggcgaagaaaggatgtccctgcatgtatcacatcctcatccttcccttcagggtcagctccctgggtagggaaaacactgttcccttgaggctcacatacccactgtcaaaaagcacccagcacatggtaggcactcaataaacctttaccaaatgcagacctgcctctcaccacactggacacattgtagtgagctcaggatggggctaaactgggagtattagctgtaaacttgctcctctctctgtccccagcctgagagctgagggggcacccacgagggagagcacctaggggcagggaggggtcacaggcagcctcatcctctgtgtgagacactgctcagactgggggatccctcttcattcagatgggaagaaaagggaaacaaaattcggtaggaacttctatgcatccacacagaggaggcaatgacaagaaaacacaggatgcaagcacagtggtaataatgtatttctacctaatattgaataaaactcaatattgcctgtattctgtaaacaataactatttacaaaactgactgtaaattatgattttaaaaaccacagcttatgaagaagagaaacctcaaacaatgacacccctgaattgcaaatctaagacatggcacacatttattttcagttccatatgtggcctggatttatttacaagacaatattatgatattatatgtcactattccattttagatggtgtatttaaaatctcacagtactgcaactacctagtaatctactcatcagtataaacatcaatgtgacaatcctgctatccttctctacccctgcataaccccagcaaaaattcattatgaattcacagaatgtaatatcagaactgttgtagccacatacacagtttgtttcattttatgttttgataaagtaatcttttttgtttaagcttattgttttttaaaaaatatattacatactagatgtcattacaaatcagagattaataatttctcttatgcttatactactcccacagcactcattactgaatgtaaaccatatttatattttctttctttttttttttttgagacagggactcactctatcacccaggctggagtgcagtcgcacaatctcggctcattgtaacctccacctcccaagtttaattgattctcctgcctcagcattctgagtagctggcattacaggcacccgccaccatgcccagctaatttttgtatttttagtagcgatggggtttcaccatgttggccaggctggtctcgaactcctgacctcaagtgatctgcctgcctcagcctcccaaagtgctgagattacaggcttgagccacctgcctggctccatatttatattttctaaacatcctacttggagtggctgatcctaccagctaccatgtttccacctcacctgggatcaaacactgacaattggtaattttatctcttgcagtcttcaaatattgagcaaatttgccatttttgctattcaataaaaatgctggaaagttatttgccatgccactgactctgttcagtgcttggaggacagactcctaggagtgagaagttgaccacagcatctgaatagctattaccccaagtctgtggaaattagagaacaaaattttaccagaaatgccccccagagcttctccccataacctcaccacccttagagaagagagctcctgttctcctcagcgctgcagggtccacagaggaggaagagctctggccagcagggaggagccacagaagaaaggacctggtgtctcccgtgaccagggtagtgagtcatgggaaccagtcactgctctggacttgacctgacctaagaggacttggtatagagtcaccacttcagtcctcaccaaggaacatccaaaaagccctggacagattcacccttaaggagaccagtaaagcatgaactgccctgagttaatgagaaggtcacaaaaagggtctgtctggcctggtgctgagcctgggggcagtgatcagagcagggggaatgcacagctggctctggggacatctggtcatcatgtcacaggagagtgtgtctggatgtggacacctggggacatgaagggctcattaccaagtgatctaggggagatcagagctgcgatcagctaactgcctgcatggtgccctctgctcagtgatcacagtggtgagctcctgatgccccggaacacacagtttcacccttgcctgtatccctgatatccacgagaggggcctgacccaaggccagcgtgtcatcagaaggctggggggctctaatttgcatggatggaccctcattctcagagaatgaagaggggaagggagagatttggggaagctctgtctcagctgtgggcacagaaggaaggcaggactcaggacaatctccagcatggtctggtttcctctcctcctcactctccttgcacactgcacaggtgactagatataaggccatggctaaagccctaggaagcccatgggccctgctttctccttttgtctctcaacccagaatcaccatgactgtttctctcccacttccaggatcctgggctcagtctgtgctgactcagccaccctcagtgtcttgggccacaaggcagaggctcactgtctcctgcactggaagcagctccaacactgggactggctataacgtaaactgttggcagtagctcccaagaactgaccccaaactcctcaggcatggtgataagaattgggcctcctgggtatctgaccaattctctggttccaagtctggcagcttggcctccctgggcaccactgggctctgggctgaggacaagactgattatcactgccagtcccgtgacatctgctgagtgcttgtacagtgctccaggcttgcaggggagtgagacaagaacccccttcctcctttcccaggagggtgagtgcccagcagctactgcacaggcctggcctgtggcttctgcagttgctgtttccccagtgggcctgggagcatccagggccccacctgggagtagatgcttctcctcccctccgtcctcagagtcacccacagcagtccctttctaggaaaagggcctccagaaaacagaatgtcctgtaccctgcaacttgggacacagggtctctgctctaaagtccaggggctggagtgacaaatccagcagtgaaatctcagatctacatctgatggggaacctgcatctccatcatccttttgctatttccaggagttttcaaagcagtgtcttcctctcactggtcctcagtgtgttttcctgttctttttgtttcagcctatttttttttttttttttgagatggagtctcgctctgtcgcccaggctggagcgcagtggcgcgatcttggctcactgcaaactccgcctcccgggttcacgccattctcctgcctcagcctcccgagtagctgggactacaggcgcccgccaccatgcccggctaattttttgtatttttagtagggatggggtttcaccattcacaggattgtctcgatctcctgaccttaagtgatccgcccacctcggcctcccaaagtgctgggattacaggcgtgagccaccatgccgggtctgtttcagcctattttttatgtgtctttttattgaggaataattaacaaaataaacccctgatatttaaagtgcccaattttgtgtgttttaagatatttatacacccttggataatcaccacaatgaatcagtgattccatcagaagaaatcggtgactggttctggcagaatccagggaaccctatctaatatctcgtgaacttctacttggactcaagtaagaaacagggctctgaggctcccagccacatcttgggatctaaagatgcgtcggcctgtgcaaggattttgcacgttgctgtgctgcagcctgagaatgggtctgtctcggggtctgcacaggggcagtggatttcacagtggctctgaggcttacacagggctccaggcccatgggaaagtgagacacaaatcttccctctgctctctaggcctggtgcagtgatcctggctggaggctctgataaatctagctcagaatgtaacttctgttgtgaacatctgattttccttggacaaatagttctgacaatatcttatttcagttcgactagtatatcgatccattgctcatacttctcattccattcttgctttcgcaatcggtggaccctgtcctgtgcccacagttctctgcatctctccctgctagtccagcctcctgcaaaggttcagctcccagaagagactcctacatccactgccctggaagaagcaacactatgagtagaatggcaagattttgtcacatcagcactggggataactcatcactactctgggcccattgaagcaatcacatactctctgaacctcagttttcatttttggcagcatgtaaccctacctcagcagctcttgctttcaacatggggatgagctgaagaagaggcttgtaaatgacaagtatcagtcactgttcaccgtgcaggggtgtctgtgtccttctgtgtcaggctttgtgccagcagggctgtgccccgcaaactcttccaaggtcctccatgcagtctgtgttccctcatctggccacattgtctggaagttaaggtcacctcctcatgcactggaacaagcagcagagtcgagtggacagcgtggcctggcaccgccagctcctacgggagccccagatggtaatgcctgctggtctccagcttgcagggttctgattttgggctcttgctctaggtctggccacttgggcttctgcaatactctgggatcctgtatgaggatgagggtgatgatcagtgttcaggatgtggaaagagccccaggttaacccaggacacctgtctcatggggacatgaggcacaagcctcccatctgatcccacagcctggcctatagactcactttaattttgtgtgactgtcacctgactcaggacattcctgcagtcattttttcctccaggactgatggaatgaggccattccctgggtctgtcgcctcatatgcagtcgacctatatactgggctttcaggataaaacattcccagcctgggcattgcaatacagacaggcaggtagctcagacagaaaatactcttgttgattccagatttctgggcacatggacttggtgtgtgtttgtgtccatgactaaggtcaggtttggggttgggagtgagagtggtcaccacatggtccaggaagaatgtgttgtcaaagataaaattcgtacaccttcctgcccttccctgtacctgaggcagcttcctgaagcctgcaggtttctgagattctccataaatggagaggaaacatcccatagaatggatgggttttttttgtcccagacaaaaagacaagacaggacgagggtacagatgtcagcaagggttaaacagcaagtatgcacttgatcatgccaaagaatactgaaatagctttgagggtaattcagtgtccttgagaattaaaaacaaattggagattgagggcttcaaacccccattaggtccttgtgcaaacagatgctgaattccaacccacattaagaaagaggctaaaaagatgagacaaaatctctgaaagacaggtggaggggatttctgcagtttcttggtgcttaagagacagggacctgccaggcactcacctgagaaatcctgcagggtcacagcacagggaagggaatgtgtcgggtacataagatgactttgatgttgaaaacaccacctctaccactgataatggttttcatcattcatacttaggtgcatgtacaacctctagcaaccataattaccacaaaggacaggcattgtgtaaacttttatgaggttctgtgttataaaataattacacaaaatgtataaataatgtgggcactaataaggtgaggttatatgttgcaatatctggggttcctattgaatttatagactgtaaaactaaataggtgctaatgtaaaatgatacagttagaaatacttgattcatgaaaaataaaaagtgagcgaaaagaaataaagcaaaaagcccaaataaaataaagagaaaggtaaactcacacacaatatcagcaattatattcaatgtaaatgtgttgatgaaccagataaaaataatttccttaaaataaagttacttgtgtgttatattttaaaggatgctaaaaatacactatgcaaacatttacctgcagaaagctcttgtggttatctcggtatcagaccagataatttcaatgaaaattatttacatcaggaaatgtgggacattttatgtatataaaatgaaatatttgacaagaacacataacaattataaaatacacatcagtccatgcatggtggctcacgcctgtaatcccagccctttgggaggccaaggtgggtggattgcttgagctcaggagttctagaccagcctgggcagcatggcaaaatttcatctctaaaaagtacagaaaaaaaaattagccaggcacggtggcatatgtgtctgtagtcccagatacttgggagcctgaggtaggaggatcccttgagcctgagaggtggaggttgcagtgagccaagatagcgccactgcactcctgccagggtgacagagtgagatcccatctcaaacaacaacaaacaaacaaacgaacaaaacaaaccaaaaaagcacacacaaataaacaaaccaaaaaacatgtccctaataatataatctatataaaatataaattagcaggactaaggaagagaaaagaatcaattcccaattatagttataaataatagcacacacttctattaactgagtgaatcagcagaaaaaaaattgcacataacaatatgtgaacaacctgaaaaaccaaattcacccactgacgccaggagcccaaacctgaggagtagttggctaatgaatatgtattactgaaacgattgaataagtgctagaagaaataaatgaggcattcattatttttacccgatttgatgcttctcctctctgtcctgtgagcagggggcactcccatgtctattcctagtcccattcttatcccctcgtctctctccccaagactgagctgcattctgcagggtggctcccgtccccctggagtaaatgactgacgtgaggagccctgccttccagtgctgctgttttcatcgtgctctggtttgaatgtctcccttccaaaaggatttatacttaattgccagtgtgatagtactaagaggtaggccttcaaaaggtgatatagtcttgaacacggagacctcacggttgggatcaggtctcttatataaaggctggaggtagcggtgtgctctgtctctcttcttgccatgtgaggacacagaaaaaaggcacttatcagatgacagtgccttgatcctgaacttcccagcctcaaaaactgtgagaaggccaggtgcggtggctcatgcctgtaatccaagcactttgggaggccaaagcaggtgaatcccttgagtccaggagttcgagaccagcctgagcaacatggtaaaaccccatttctataaaaaatacaaaaattagccagatgcagtgacaggcacttgtagtcctacctaatcaggaggctgaggtgggaggatcacctgagcctgggaggtcgaggctgcagtgagttgtgattgtgccactgtactccagcctggatgacagagcgggagactgtctcaaaaaattaaaaaataaataaataaaaaataaaacagtgggcgagataaagaaaatgtgttacttatataccacggaacactatgcagccataaaagaaagttatgttcttggcagcaacgtggatggagctggaggccattatcataagtgaactaagccccgaacagaaaaccaaatgctgcatgatctcacttataagtgggagctaaactatgaatatacccgaacatacggaaaggaacaacagacactgggaatgactaccagaccaaaaaaaaaaaaaaaaaaaaagaggatccaccctgtggatcctctgcccactgcctgggtcatgaggttgttgggaccccaagcctccgtgtcatgcaatcaacagatgtaactaacctgcatgtgtaccctttaaactagaatagtaagagtaaagagcattgaaagaaaaagtcaagatcagaagcgaagaaaataataaatgaaaaaacacaatctatagttatccaaacaatccatgactgtcacaaacacagaacaaggacccagtggacagaatgaggcagccaaatactcaacccaacatgatacatagggaacacatttttcaaaacaccaaaaagacacaatgggaaagggagagtctggttcaagaagtgattttgagaaaactgaatatgcacatgcaaaacactgaaataagacctttgcattgcacgatacacaaaatcaacacaaaataaattaaagacctaaactcaatcttgaaactgcaaaggtcttataagaaaacataggttgggtgtatattttaggaagcctgtatctatgcacacaggctgcaaaaggtgaaaaataatcataacactaaagggaaaattaggggaactacatgcacagacaatgcaatggcttggctatatatgtgtgtgtgtatgtgtgtgtgttttgtagggtggaggtttggatacaaaaattacagctaacatgcaaatataaacaaagacactagtgacactttagaacttctacagggggaaagaaacaatgaaataaacaaacaaacaaaatgcatcctaaagactaggagagaattatggaaagtcctacctctgaaagagattgttatctaacacctacaataaactcactctactaaatgaaaaacaacaaaaacaacaacaacaaatacccaagctaagaggatctgaatagacatgtgtgtaaagaagacaggaaattgactcacaggttaacagtttctcaatatcactaatcctcacaaaaaagtgaatcaaaaccatactcaggtaccatataattccagttaaaatgaatattgcaaaagataaaaataaaaattgttggaggtgatggctggtgtagaattgcaggaaggaaaactgttgtacgctctttgtgggaatgtaaattagtatacacactatgcaaaactgttggaggttccttaaaaaagtaaaaggtcaaagtacaaccaccactccaggttaacaatcccaccactgggtacacatttagaggaaacaaaatccctgcattgaagaggtatctgccttcccatgtgtcctgaagcactagtcacaatagtcaagatatggaatcaacctaactgtccatccacagatgaagagataaaggaactggatatatacatgatggaaagcatttcagccataacagtttgggaaatcattgatctgcagccatgtggagaaacctggaagacaattaggggaaatgaaatgagcctgttagagagagacccatactgcatgacattaggcaaatggaatccaaaaaacactgtcttctagaagcagaactttcaataggggttactagaagctggagagaggagggggcctgggcagggattggtaatgggtacagagtaacactcagaggagaggaatccattctgatgttctattccacagcagggtgaccagggtcaacaatgtctaggggaatttttcaaaaacagctggaaaggatggttctgaatgttctctccacagggaaataataagaagccagacaccatgatttgatcatgacactacgtatacatatatcaaaatgtcccttgcaccctctggttatatacatacactctatagtaatgaaactgccatcaaatgttggtagtattcattctaactggagtgacatagaatctgagtgtggttttcaatcatgttttggtgtgaatcggccatgttgataatcttatcttttacctgtgcatcaacctcatgtcttcaggtcctctgcccacttttacacatcaaattcaaaacaaattaacaataacatggcaaatataactaatcacacacacacagaaaatgaaaaccaccactcagattccatctcactctagatggaatggatactacaaaaaaaaagttgaaaaatattaaaagacaaaaaaacgatggtgtggatttccagagggggaacttgtctccgcagttcgtaggaacataaactagtacacacactaaagaaaccacttggaggtccctccaaaccttaaaaccacaactaccatttcatccagcaatctactactagtcgtatatacagagtacatgaaatcaagccatggaagagattatctgcgttcccaggtggaatccagcactatgcagaatggccaagatgagaaatcagccgacctgtccatctgcagatgaagggataaggaaactgtcccatgcgtagacactggaatactcttcagccagaaaaatacaatgaattcccatcacgggagccacacggttgcacctggaggacatgatggtaaatgaaatgagccaggcagagacagacaaactttgcatcctctcactcatgcagaagctgagaaactttatctcaaagacctagaaagcataatcatggttaccagaggttggggggaagaaggggaaggggcaaggattggaaaggggtagaaagttccacacagatgagaggaaggaaattctgtttttctattccacagcagggtgactagggttaatagcatcattacatcttcaaaacagcttgaaaggaggatactgaagcttctcgccacaaaagaataaacagtggtacgaaataacagaaaaaataaataccctgatttcgtcattccacaatgtatgcaaagaccaaaatgtcgcactctaccctctcattgcattcctttactattcagcaaatttgtttaaagaaatataaatacatgatgctagaattcacatgggaccatgaatcaccctgaatttcttccaaagcaatcctgagacattcagactacatcagatgcatctcacccaccgatttcaaatttcatggaaaaactgggtacctgcttccacacagagcagtggaacacaagagagggcccagaagtaaactcacacaccaaaaaccatctgatccttgacagaatccacaacaataagcaagggggaaaggatgccctattcaaacaatggtgctgggataagtggttagccatatgcggaagagtaacactgggccccgacctctaaccagacacaaaaagaaactccagatgaatgaaagatttaaatggaagacctcaaactattaaaatcctgcaagaaaacatacaaaatacctttctccacacaggttttggcaaagaatctatttggctatgtccccaaaggaaatgacaacaaaaatggacaagccatgcttaatactctaaagagccaccacacagcaaaataaattagcaacagagtaagagacagcatacagagtgggagaacatgttcccaaactgcatctgatcaaggtctaatatccagaatcttcaaggatcttatgccaatcattcaacaaaaaacaacaaaaaaatcccattagtgtatgggcaagggatgtgaacacacacttctcataggacaatgtgcaagtgaccaacaaagagggaaacatgctcaaactcactcatcaacagagaaatgccaatcaagagcaggtcgagataccatcccacaccactcagagcggcgatgactatgcagacaaagaaagaaagaaagatactggcgaggcagctgaggagaggaaaggctgatatggtcttggtgggggaagcaagctagtacagacactgtggaaagaagtttggagatttctcaaagaacttagaactaccatccaaccccacaatccctctcctgaagatctacccaaggaaaatatatccttctatccaaaagacacaggcacttgtatgctcacggccgtgttattcacaatggtaaagaaacggaatcaacctaggcatccatcaacagtggataagataaagaaaatatggtatgtatacaccacaaaacactacacagcccccaaaaatcacatttttggcagcaacatggatggagctgcaggtcattatcctaagtgaactcaaggccagaacagaaatccaaatgccacacattctcacttataagtgggaactaaactatgaatgcacctgaacgtaaagaagggaatgattacattaggaataactaccagaccaaaaagaaaatgcaaatgggagggagggggcgttgcgtcctgaagacccaccttgtgcgtcctctgctcactgcccgggtcatggagttgttgggagcccaagcctcagtattatgcaaccaacagatataattaacctgtgtgtgtactctttcatctataataaaagtagaaactattacacacacacacacacacacacacacacacacgaagaagcttaagagctacataaacaaaaaaataagtaaaatctatagttatccaaacaatccctcactggcaaacacacagaaacactaacctatggacaaaatgagaaagccaaaaatgcagcccaaaattacatatggtgaatgcatttttcaagagaacaccaaatatcacaacagtgaagagagaagtctgctaattgtctttgagtaaaatgaatttctacctgcaaaacactgaaatggatcctcatgttacataagacaaaaaaatcaatgcaaaatacagtaaagatctccacccaaaactgaaaacacagggtgttttcacaccctagaagaaaacacagggtgagcgtttacttcagtgaaactttaatctatgtacacagattgccaaaaggaaagaaaacaaaagggaaaagtaggaggaagaaacccacagacaatgcgatcttttttcctttttttttgtgacgggacaccaaagtcaccacatgcacatgcaaatagaaacacgcaggactatggaaagctttagagatgttccacaggaatgaaaccaatgaaccgaaagagaaggtgtcctacagatttggagacagatctgaaaaactgtatctctgaaagcggttgttatctaacatgtccaagaaactaacaccactgtgtttggaagcaacaacaacaacaaaaaagacaaaacaaaacaaaaacacaacaacacatatgctgaagcaaaactgggcaaaggcccttaatagacatttctgaaaagatgacatgaattgactaatgagtcaaaaagaagttgctcaactttatcatttctcccgcaaaggtaagtccaaaccacagattctctgggattctggagaatgtgaattctgactcagtaggtctggagtgagcctgagattctgcgtttctaaaaggttcatttccccacaaatccacattatgtgtattaatattaccaagtaaataagaaaggtcaaaaataaaatggcaagccattagtagataaccttagtcttcctcctcatcctcctcctccactgcatgggttaggatggtccccagcatcctgatcccccaggtcactgacatcagctcccaaactcatgccaggaatgtccttccctcttcttccttcaggccataatgggtatctatttttccagcatctttctcccaatctgtgctgatttagccaccctctgtatctgcctccctgggacaaagggtcaaactcaccagcactctgagcaagagctacagcagctgccacatagactatccccagcagagctcagtgatggacaccaggttcacaatgccagtgggcagtggtgctgtttactgcatccagtggggatggagtggttgtccaggcacagacagatggacaatcacacagcaggaacaaatgtacattctgaaatttaacaaagacagaataagggactcttggggaatagaggtctcaattgcagacatagtgagtgcctcaaaaattagagaactggggccatctctgtcatggcccggattcctctctccttcatcctcctcagtcatcaaagagattccattagggggcaatcaaaggatgctggggcctgctactagctcccaaaaaacaccacaagcatttcagcagggagaaaagaaaatgctcacaaggatggggttagatttagttataaaccagattgtgtggcaggagggaggacatatcccccatcctttggccactccaaaattgggagagctaatctggggaaaggcaccaacacctattcattagtgtctcggtcctgtgtgatcatgggtctgtgtgagttctcagcagctgcctctctcaaggtctccccacaggacagcagggtgaaacctggggcaggaagagaggggaagctgatttgcataaagaactttttttatcctattgggtctggggaggcatgaaaaggccctgaggaaaacaaaccccagctgggaagcctgagaacacttagccttcatgagtgtccccaccatggcctggatgatgcttctcctcggactccttgcttatggatcaggtcaggggaagggactctatccctgggggaccacagaaaacagggtccaggttactctcatcctcatgatcataactgtgtctctcctgttcgttttaggagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttccacagtgatttaaacctatgaggaagtgcaactaaaacctctttatatactgagaacagttcagcccttacagacaggagggaaagtgagagggtggaaatggtcaacacggtgagtgaggagtctcctcgccccagtctctgacgcaggggttcactgccaggtgcctcacccagtctctccccgggtgtgtccaccttcccagtgtggcttttccatggctgtgcttcgtctccactgagaataatgtggagggagaattatctacaaaatatataagctcacagtgagtcacagacaccccagtgctccaggaagacgcttcttattcaaagagaattaacaggcatatgctcactcattaatttgaccatggaggctgactgaatattttatttatcactgaagtgggagcattttcaaggggcttgttaaaaatgtaattctctaacctaaacctactaagtcagaaacttgtgttggtgacagatagcctgtatttaacaagctgtacatgagatttttattagcgttaatgtttgggaagaacctacttttattatcataaaattattcataaggatctccatttataatgatgtcaggttaatattccataatcctactctcctaaattcccattcaaagcccccaaatactcagaaacagattttaaatctcaagccatagcaaaaattataacttgatttatgcagacagagtagggaggaatttctaaaaccgtaagttcctaggtgccaggtgtgctgactcatgcttataatcacaatactttgggaggttgagacaagaggactgcttcaagccaggagattgagaccagtgtcttccacatagcgagagtctatcaccacgaaagaaaaaaaaaagatataagtcccttcaggaatttccaaaaacttgtttccttagggtatatttagtggtccatatgaacatctgttactgaaaaccatcccgtagaggactggcttccagaatcccttctccctcccactgagctcacctacctgtggctctggctctcagggtctttataggacacagggctcagcctcttatcaccgattgttccacaggatcatggttccactgagatcctctcagcatagatacgtacctgtcctgaacagtgtcttttaacataatgttggcaagatgggaaggactaaggggtgacggagccttggagccaccagaagatggcagtaacctcactgctgagctttgctaggccagactcaggctcccaccctcctcccttcctctgactctttcttctggccacccggggtccaggagctttttccactcaatctgggctcaggggtcacctcagagaacctctcaagacaaaggaggtgcttcaggggatctaacacaagtgagggcagattttaagactgtccatgcacagaaaatcctgtgaaaagaaacaaaccagccctacttgtgtctgcgcacctgagtccttaggactgttttctcctgatctcctggctgagtaaagattgcaaatgtgcggttcattatccagatccagagaaatccatgagagtttatgaagacaaagacgacaactaccctatctacttgtcacacaatgaagacactggccttagatctgtcagtgccctggaacattctggaagaagagggtgaaggttacttggcatacgttgggactcaaacatgaggatctcatgatgacccagagggataaaggtgggatcagttgtgagggtggaaaatgtggatttcttaaggccattttgttaatccttttctcattgcaaaggatttaaactgaaatgaacacgatttttctaataaatgcttatgaggctttccattaaatttaatcatatttcctgcctttatgaaaataaatatagaaataaaatatacttccataatgcattactgattgtgtatctttaaactagagggaaccattacttctaaagaaaaattactaggattgtttgcattttaatctgggatcctacatgatggctacagatacagctgttgttcaaggttttagcctggaatctctgccaattcaataacggaggcaataaaaatagacactagtattataaagacagaattcatttattttgaaagttttgaaagctatgaatatctaccaagaataaaataaattgtactgaaaatatattagaatgaattaaaaaatgccaaattcacaactaataaaatttattataaagttaaaaattcttatatttttctgtctcagtataaaaaataaacatttaatgtatctattagaaaataattagcaattttgtaaatgatatcaaagaaaatttgaacaaatggtgaaatattttcttatctgcggacaccaaattaaaaaaattcaggccaggtgcagtggctcacacctgtaatcccaactactttgggaggccaaggcaggaggatctcttgatccaaggagtttaagaccagcctgggcagggacgggtgcagtggctcatgcctgtaatcccagcattttgggaggctgagacggcagatcatgaggtcaagagatcaagaccatcctggccaacatggtgaaaccctgtctctactaaaaatacaaaaattagctgtacatggtgacgcatgcactcctgtagtcccagctacttgggaggctgaggcaggagaatcacttgaaccggggaggcggaggttgcagtgagccagatcgcaccactgcactccagcctggtgacagagcgagaccccatctcaaaaaaaaattagccaggcatggcttcatgtgcctatagtcctagctactagggaggctgaggtcggaggattgcttgagcctgggaggtcgaggctgctgtgaaccgagattgtgctactggactccagcctgggtgacaaagtgagaccctgtctcaaacaaacaaacaaacaaaaaaccaaaaaaaccccaaaataaaacaaaaattcaacagcatgtagattagtaatgttagtgctttatttttaaaaattattgttaacttatatgggttttcctctgagaaggtgcactggaaggtgtcagcagagcagatagcacaaactcctcagatttcagaagcaggggtttatggtaaatgaaaaatgccagtcacttgtcagcatgcacaggtggctatgcccgccctgtgtcaggctctgtgtcagtagtagggtgctccatgcgtccttttcagagtcctacatgccatctatgctcactcagccaggcctgtcacctggaagtaacaggcaactcctcctgcactggaattagcagcagagtcaggtgaataatgtggcctggccacaccacctctcagcaaatgtccccagtggtgatgcccgatagttcccaatcctccttaagtaattaattcacttcaattgaattaaaaaaatcaatcacttccctatgacacacaaggacattcactctctggctttaactatccttgcctgccttgttattatcattccatgtgcccaatactgtcaaaagatgtatttttgccataccctccacatgcatttcatatgtgtgatttttattttcaaattctatatctcttctaggaatatggtgtgttttatttgtcctgctgcaggactcccctctccactcagattaaattattaaattccagataaaaaattaacttggaatactgttgaatcaatagtagaagtaaccaaaataataaagatatttcaaaatgaagattgatttttaaaagtaaaaatgtcacatactccacctagaagataagagactgtactacaaattcattagaacatccccttcatgtcatgggccagtcatgtccctgaacttaacctctgtcttctcgggtgatgttacaggccaatgcagcatcagctgcccacactcctagtggtggaatctgggagcacaggcaggagtctgcgcctgtggccttggctgggtgaaagatgacatttccaagacttcttgcttggcagccatcctcacgtgcaggtggtctggcagcagcactgcaaaacccaggcaagggatgccccactgcaaggcccagtggtaactgtggtggccattggcattgggggcagatgcagccatgtgagttggtgggctgtggcagccaccctaatgatggtttccacccctcccagctggtggtggctaaaaccacccggtaggagtttcaaaagcagtggcaccattaagcggagctcctggaggaggactggaagcaactgcttgcattgaaggaatgtagctatagtggaattattgaaccacatcatatttgcaaagatgcagaatgtattacagattacgagatatggaagttgaggttaatctggtagagagcagtgaatatgaggaggaagctctctattgggcgggtgctatcatagctgcagaaggtgatggtgcaatgcttctgccagtgagtaaagtcttgtacaaacttaaaccagttacggggtaaaatctgatccaggactacctgagggtcacttatgttggcctgttcaatacacacatttctttccaggagccttaccaaaggtctatagtagtgagttcagtatggaggcagtaatcagatcatatctggaaggaactggcataaactccaatcctgtgggacatcatggacagcaactaaattcgaatcaacagagtagagcccttgacattggacaagttcgtggtgaaagatctgaggctttaggactccgacatttgtgaatgacagcactaaatgaagtctttactggtgaacgtctatccagaataccttatgcttgggctgtggcagtggataatttaagtagacccactctatttatttatttattttgagacggagtcttgctctgttgcccaggctggagtgcagtggcgtgatctaggttcactgcaagctccgcctcccaggttcacgccattctcctgcctcagcctcccaagtaggtgggactataggcacccatcaccacacctggctaattttttgtatttttagtagagacagggtttcaccgtgttagccaggatggtctcgatctcctgacctggtgatccatccgccttggtctcccaaagtgctgggattacaggtgtgagcctctgcgcctggctaagtagacccactctaaaagactggtttcttactgtgagatttcagttggtaatggtccatgggaaaaatggaagacttcagggctcaatttgtgaactggagcaagatcaaaggcaacagggttgcaagtcaggctgtggagcatgattaaaatattgcaaatgacaaggacgttggagtcttgcattcaactgtaaaatgacagaataacaaataaatataatgaatcattgttctagagtccaaaaagggccaaaagtaattttcagtattcaagaactaaaaagcaagcagttttctcgagcacccatgagcattgtttctcctgagagatttgtcctcgttttcattgctggaacacctgcatggttgtagatggaggaatgtcttttgatgttcctatttttatatcagacaagctttaaagcaacaacagttataaaagacaaagaaggaaattttataatgataaaaggatcggtccaacagaacaatatcacaatcctaaatatatatgcacctaatactggagctcccaaatttataaaacaattattactagacctaagaaatgggatagatggcaccacaataatagtaggggacttcaatactccatggacagcactagacaggacatcaaggcagaaagtcaataaagaaaaaattgactttaattatatcctagaacaaatagatttagcagatatttacctaacattctacccaacaacttcagaatataccatattttaatcagcacatagaacgttctccaagataaatcataagataggccacaaaacaagtctcaacaaatttaagaaaattgaaattatgtcaagtaccttttcagaccacaatggaataaaactggaaattaactccaaaaagaacccttaaaactatacaaatacatgaaaattaaataatctgctcctgaatgacctttgggttaacaatgaaatcaagaaggaaatttaaaaattgcttgaactgaacaataatagtgacacaacctattaaaacctctgagatacagcaaaactaagaggacagttcatagcattaaatagtctgaaacagcatgaacagacaatctaaggtgacacctcaaggaactcaagaaacaagaaccaaccaaactcaaacccagaagaaaagaaataacaaagatcagagcagaactaaataaaattgaaacaaaaaatacaaaagataaatgaaacaaaaactggttatttgaagagataaacaaaattgacagaccgttagtgagattaaccaagaaaaaaagggagacgatccaaataagctcaattagaaatgaaatgggaaatattacaaccaataccacagaaatatgaaagatattcaaggctactatgaacacccttatgcacacagactagaaaatctagaagagatggataaattcctggaaaataagttattatttgaaaaagacacttgtatggccgggcacggtggctcatgcctgtaatcccagcactttgggaggataagcgggcggatcatctgaggttaggagttcaagaccagcctggccaacatgttgaaactccatctctactaaaaatacaaaattagctggacatggtggtgcatgcctgtaatccccgctactctggaggctgaggcaggagaatcgcttgaacccaggaggtggaggttgcagtgagccaagattgcaccattgcactccagcctgggcaacaagagcgaaattctgtctcaaaaaaaaaaaaaaaaaaaaaaagaagaaaagaaaaagacacttgcacacatgtttatagcagtacaatttgcaattgcaaaaatatgcaaacagtataaatatacatcaaccaatgagtgaataaagaaaacgttatttttttatttttagacggaatttcgcttttgttgcccaggctggagtgcaatggtatgatctaggtttaccgcaacctctgcctcctgggttcaagtgattctcttgcctcagcctcccgagtagctgggattacaggcatgtaccaccacgtccagctaattttgtatttttagtagagacagggtttctccatgttggtcaggctggtctcgaactcctgacctcagatgatctgcctaccttggcctcccaaagtgctgggattatgggcatcagccactgcacccagccaaaaatgtgattttatatatatatatataatatacaccatgaaatactactcagacctaaaaaggaataaaataatggaatttgcagcaacctggatggagttggcctcgtttactactctgggtttctgtctgaggatgagggtgatgattgctgatcaggatgcggaaggaacccagtgctaacccacagcatctgccccacagggaaataaggcacaagtctcttgtttgatcccacgctatgacctctagacctactcttccctcttgtcaccaaaaccacaatcaggaaaaatttctgcaggcatttcaccatcctggaacaaggatctgagactcttcactgaatttgtgaccttctatccagccaatatttatactgagctattaagattaacatcttagcctggtcattgccacacaggcaggcaaggcagctcaggtggaaaatacttttggtcatcccatgtgtctgggcatatggccttgatgtgagtttatgttcatgctcaggacaagttatgggtcaggggactagtcagcttatgggccaggaaaaggtgctaaggtttgtggagtcaaagagggaattcacacatattaatgctccttgtttccacctaaggcagtttgtgaagtctgtgggttctgtgactgtccacaaatggagcaggaacattccttagaacggatgattgggaccccacaaaggaaaagacaagaggaagcacaggctacacaatgaaaatacacttggtcatgccaaaggctaggtcatgccaaaggctaatgaaagagctttgagtataattcagtgcctttggggttgagtggaaaatacaaaaaccatctttgccctgctctcacaccacaacaatcaacacgtttccatgaccaaatgtgtaggatttctccccaccccctagaaagcaagccattggttttgcagcggacaccacacaggtgccctctcattgaatgcaattctgacactatccacatggagacagggtcagatcttacagtttgagggctacttccccaagactgtgccccactacttacgccaatcccaagcctcagattgctttacctgtgcttctgtccaaatagctgtaagttgaagatttcacaacatctccttggcttctattaatttgctagaatggctcacagagctcagtagacacttacaggtttattaaaaaggatacaaccaagcatatagatgaagacatgcatagcacaaggtatgggaagtggtgcaccaccgtccagtaatcttcatgtgttcagccttccagaagttctcccagcctagctccatttgggttattttatggacgcttcctcaccgaggctttatggagtaaaccactgcccattggtgaataatcggcagcccctctcccctccacagaggttgggagatgaggctgaaagtcccatccctctaacactgccttggtctttcttgtgacctgcccccatcctgaagttacctagggactgtcagccaacagtcatctcattagcatacaaaaagactctggtgattttaagtattttaggagttgtataacaagaaatggggtcaaagaccaaaaccataatttataataacacagggatgaaaaagaaagtagaggttgatgatttcaagcccacactagtcctcattatgacagatgtggatttccaacccataagaggcaggaggctgaagagctgagacgaaacctgtgaaaagcagggacaggggacatttctcaatttcttgttactgaagtgatagagctccaccaggcctcacttggattgacaaactaaattaaaagatacactctttaaataaaaagcacttctgagcatacatccaaaagaatgaaaatcaggatattgcagaaatatttgcacatttttattcatgcagcattaatcacaatttcaaagacatggagacagcataaggtccactaatcattgaatgtttacagaaaatgtggtgtatagctgcaatggatgctgttcaaattcaagaagaattaggccgggcacggtggctcccgcctgtaatcccggcactttgggaggccaaggcgggcggatcacaaggtcaggagttcaagaccagcctgaccaatatggtgaaaccccgcccctactaaaaataccaaaattaactgggtgtggtggcagaagcctgtaattctagatactcaggaggctgaggcaggagaatctcttgaatccgggaggcagaggttgcagtgagctgagattgcgccactgcactccagcctgggtgacagagtgagactctgtctctcaaaaaaaaaagaataattaaattttgccatatgcagcaacagggaaaaccctggaggatattacactgagtgaaataagccaatcttagaaggggaaatgctgcacggcctcatttatatgaggtatctaatttttttttttcgagacagagttttgctcttgtcacccaggttggagtgcaatggcgcgatctcagctcattgcaacctccgcctcccgggttcaagcgattctcctgcctcagcctcctgagtagctggtattacaagtgcctgccaccacacctggctaatttttgtatttttagtagagacacagtttcaccatgttggccaagctggtctcgaactcctgacctcaggtgatccgcctgcctcgacctcccaaagtgctgggattacaggcatgagccaccacgtccggcctataggaggtgtctaatatactcaaccgagcagaaatggagtagaatgctggttgccaggggtagggagagaaggaaatggggagtcactgctcaagggctatgaagctttaggtttgcaaaatgaacaagttctagagatgtgctgtacaacactgtgcttacagctgacaacactgtattatgtacttaaaattttattcagagggtatatcacacattaaacgttcttattaacatgaaaaagggatagaaaataccatgaaaccacttacagaaagcaagtatggcaatcctctgtcctttgtcttgggagaaagttttggccaagagacaatttaggcaaaaaagagaatttactgaagaaaaacagagagcaaatagtttatttagagagacagtgtactctggaagataaggcagagcgggctgctgatagagaatgagccagcggcccgagaaatgtgcactgagtttttatgatattgcactttttcttggagttcccacctctgttttaagtctccacctttttttctttctctagtttttctgcttcagccttaagtccctgccttttccccacatagtttccagcccaggctgtgggaccctcccttaacacacacatgggcccagtgtttgataggaattctacctaatggctgcattgctcattactgccaccccaggaaggttgtatggtggtcaaatctatacttactgtacctgcatctctcttagaaatttctcctttgctctcacccctattatcagcatgcagctagctacattctgacaggttaacttcagagtgagtgaatactgggtgtcttaaggggctttgttctggcataggtatttaccctaatctctgttcgtatctagcatgtgtgctttgggtggtctctggggtgtgagattttccagaactcccttttctcaggggctgcccctcctgcttctgtctagctatctgcctactctaaagttagtattagtatgaaagcttttatgaaaaacatttttttccaagaaaagggaggcattttatactggtgaaataaggtgttcaatgacaacacataacaactgtaaattgtatgcacctaataaaatagctttaaagtatttgaagcaaaactgtctcttttagcagaattaaaaagagaaataatcaatccataatcatatacacagatattaatacaactctcttattaactgagtgaatgacatggagaaaaaagagtatacatacaaatacgtgaaaaccatgattaacaaaatcaatccagtgacaccaggaacccaagcctgaagggtagttgcttgagtatgcattcatggatgaacgcatccaatgaatcatcacaggaacaaacaattgaggccttcgtttatgtatttctaactgatgttaagtttttccttcctattctgtgagtagaggtggatccctgtggaaggagctgcccgggtctttgctccagaagctgtctgcattctcccctcactgtagcctcgtcacattaggccattgttatatttcccatatgtccttcttctagtaatccaggagccctcaatgaaaaggctgtttattaataccagtagctcaggacagagcaggggcatggctcatggatggtttggaccaggcccttagatgactgcactcacatgattcccactgagactgcagtctggccagtgagcagcaggggcactgtgggtctgtctcacggtctgcacagtggctattcatagctgtgccaacccctaaattccccagggctgggcagtggagcctgcactcactgaagccgactcagctgctgcatcttctctgggtgtggttccagcacccacttcctcccaggtcctgccagactctctcatccaccagtccccaggtcttgaataaatgcatagagtggggtgggggcaggcagtgggtgggacacatttgcatccataacccttcctctgtgaggccagtggaggggataagagaggcctagggcagccactccagctctggacctcgggagggctgtgtccaccatggccggggcccctgctcctccctgctgctcccctctcacttatcaggtagggacaggcctcagattcctgggaaagcctcccagtctgagttcttgccccgtgttccactctcacatttcatccctgcttactcacccatgagcatttgtgtttgcaggttccccccacctcggcctgttctgactcagccaccctccctctctgcatctctgggaaattctgaggctcacatttaccctgagctgtggcttcactgctggtggctagcacatatcctgctaccagtagcatctagggagtgctctctagtatctcctgagagatgatatatctccagtgggatagatatctcaagagtgggctcctgataaaaggataaagttcaaccctatttactcattttcacactcttctttgccctttttctctgagataatgcagcagaaagacccttgccagatttcagcatctgcttgtggacttctaaggtcacagaaatctcaaccaaataaacttttagtctcagtaagttacccaatatatggtattctattgtatcagaagaaaatggagaaaatggactaggacagcacgtgtagaacagtctgctaatctgactcaagtaagcaccatggctccagggtccccggtcacttttctaaatctaaagatgcctcagccaatgcagtaattctgcacatctctgggctgcagccagaggatgaggctactacatatctcagcagccatggcacttccacagtgctccagacccccagggaagtgagactaggacctcccctgtgttctctctgcctggtgcaatcaccactgtcctgcctgggaccaactctggctcagggattgattcctgttgttactttttcagccagtgtctaattttcctaggatatatagatgtaaaatgtgtttttttcttaaaatgttaatttgatatatttttcatatcttttccccttatgatgcctacagtggagtaggtcagttcttagagctaagtttccctccaggaagattacagaagaggaaggagatgaataacctacacgtgctgtcctagtccatttcccccattttcttctgatataatagaatatcatatgttgggtaacttactgagactaaaagtttatttggttgagatttccgtggccttagaagtccacaagcagatgctgaaatttggcaagggtctttctgctgcattatctcagggaaaaagggcaaagaagagtgtgaaaatgagtaaatagggttgaactttatccttttatcaggagcccactcttgagatatctatcccattgccaggataagggcactaatccattcatgatggtggaaccctcatgacctaatcacctcttaaaggtcctgcctccaattacttttaccatgataattaaattctaccatgagttttggaggggatattcaaaccatacacatgtcccaaactagggcctagacctgacttagagatgtgtgtggtctgagaacttctgatcagctggttggtccagcatgccccaaccccagctccactgaccagctccaggagtgagtgaggtcaccttcctcacaactgctcattccagcctgtctctgaactgttcactcctcttgaggttcagaggatgcaggtctttgtggttccagggatgttgggcaaacagtcttttccacagtggaatatgactgtgcttgtgacttcgcagtgtgcagaggacactcagcacctgcctctcccccccgactttgtcaggcccatgattatcaccctctccttcatcccaagttcatctgatacgcatgccaagatttcagtgaggctggggacacataaggatgatgatactaaaatgaacaagttccatttcataatagtggcagaagatcagagatctgtaggggagttgtgcccccactctgagtatttaggaagcaactctagggacatcttgctctgcttctcccttctctgcacaggtgaaagaaggagcctgtgcagacaatcgttcattagaagctcctgccttcttcctcttttccaccccctaggactggatggggcctttgtaatggcttcaaattatagtgagagtcaaacaagacaattggtcaatgactccaacatccctctcagggctgcctgacatgagacaggatggattgcatctgatacacccccacccttctttcttatcggtatattaggtttttcttattgatgtgaacacactctatattacacaaaataagttatatttatatttcaaacctgtgatggtgatttttaaattatagtaaaaatatacatataaaatttaccatcttaatcattttaggtgtacagatcataagtattaactatattcacattgctgtgcaacagatctgcagaaattatccatcttgcaaaactgtagctattgaataacagctccccattttcctgcctcttgtggtggttttaaatacaatgcaatacatactagctgaaaatggaaaaaagaagtatatgaaaatgttaaatgcatagcacaaaaaatgaataatagggtcactttggttataactttaaatgagaaaactcaaagtaaaacaacaatctatgatatatcatataaaatgcacaatttaaaatttttaaaatttaatattaacaaaaatatatgtaatacaccacataagtattcaataaaactgaatacaattatgtttaatttttttaaactgtgaaaaagatcctattaacttttgaatatttacgcaaggaaaccaagtacatctcttcttgaaaaagtttgattccaattttttttttctttttttttttttgagacagagtcttgctctatcacccaggctggagtacagtggcgtgatatcagctcactgcaagctccgcctcccgggttcacgccattctcctgcctcagcctcccgagtagctgggactataggcgcccgccactgtgcccagctaattttcttttgtatttttagtagagacggggtttcaccgtggtcttgatctcttgacctcgtgatctgcccgcctcggcctcccaaagtgccaggattacaggcgtgagccaccacgcccagccagtttgattccaattttaacagacaggtgtttttgacaaccagtttattttcttactgaaattttctttttctttttttaaaaaattttaaatctttaatttccgttttcacttattttcttcttgcttccaaaaggaaaggagtgcgtagctctgttgcctgtacatcgtccacagcccctggctcggggcagggtcccctaggccgcccgggggtccacatgcagcccctggggggccggcgcggggtgaggtccggccggttggggccgccgctaggcgcgctggctgggcagctcctgggagatgaagcgacgcaggcgctccaggtactggctgtagagctcgatgtcgttgtgtccggcgccctccacccacagcggctccaccgccttggggcagcgctcgtagagcgccagcccgtgtgagaagtcgatcacctcgtcctctatgccgtggatgatgagcacgggcgacgtgatcttggacaccttctcgatgttagggaaggcgtcgaagcagtaggtcttggtgtcggggaaggcgacgcgcatgcccgaggtgagcggcgagtgcagcaccaccgcggcacactcgtagcgcgaggccaggtccacggtgggcaccgtgccgatgctctgcccgtacaggatgatgctgtccgggctgatgccgtacctggcggcgccggagcagggtcagccgcggcctccgaggcgcgcgcacccttcccaccagcgggcgtccccgggcccagctccggatgcgaccctctagtctccccactcagccaagtcagtgggtcaggcccaggctccacaccagtcccgagggccacccccagcccccaacaccgcggcggtgggcgaggccagcggccccgccccgttccctggcgctgccgttcactggcgtttcctagcaaggatctgcagggatcccgcctacggagtgcccctggggcaggggtaggggaggccctggcgcctgttctcctcctggtcacccctaggtgcacactgggaactgtgtgccccccacatcctgaatgcttcaggcctccctgcccgggttagaaagccgttcctggtgcactggccaggacagcggacactcttccttcctgcagcccttgcccacccccttggccatgaggaattcaggcagctgtgtccccagatgtctccacccaattttggactctcggagtccccacgcccaatgagatgccagtgcaacccaggtcagcatcgaaggtggtggctgcggaggtggcaccccctcccaccagcaccttcccttgggagtggacaagtcctcggccacctcagcaccaccagctcccacccagggccacccccacccccaggtcattggtgtgcggcccttgacccagctgatccagcaccagttacaaggcctcctcgtacccagtcccaaccacgcgggacccacctgccaccctgcccatgccaggaccccacaactctcctcccacacgctccaggctctgatcccaggcagacaccctcttgcaaggcaggagcatgggcaggtgtgcgtcccctctgcctggcattcggactccaccagcagggctgtccccgtccctggcctggaatcccagcctcctggcagcactccacagctcgccactcacccatgccccaaaggatgctgcctggctggtacctgtggccccagctctgcctcggcctccctggcctgctccctggcagccatggtcagtagtgtgctgagccagcccagccctgtcacctgctacaggcaggagcccccagctgccacctggatgtccccactcaaatgaacgggacacatccccagtggaggccctgggcacgctctggcctccccctcacagctctgggcctaggttcctgcaggacaaagtggcagcaggacagatggccgagcagacgagctcagagctggccatggcgggtgtgactctgccagtggcccaggcagtagagacaggaggggccgaggaagtcgcatgaagtggtacttggtgtcagcgccccacactgctgggaggcccccagagccagggtggtgccaggggaccagctcccaggcccacagcagggaccgcctgcaatatcaccaaggcaacgaggaccccacctccccagggcctctgacttctcagagttgtgcctggtcccctgtgggagcaggtcagaccagtgggctgggcagggccaggatgagacagccccagtggatggcgagcaggaaaggccgccagaggcccacccgggtctcctcgtccaaagcagcactggcccgggcggtgctcaaacaccggtgaagggcccaggcaagcgcagggctggggacctggatgactaggagggctggatctggaatcgaggctggcccagacctcgggtgtgtgctgggggtctgcaccttaccctgcaggccctgccccaggatggccaagctccgcagccacagggcctcatgggccaggcctcgggacctggatgcagcagcctcgcctcacttggccccaagtgctgccttggcagatgggctcccagccacacgtgcacagacccccagaccaccacccactccctcccaccgggtggcatccacgcccctgtgacaagctcagccccttcccgtcctcaggccaggggttccagggagcctggctccacaggccagggtgtgggaggaccgcctggccacacctcagccatgtggaggtggcacctgcacacccaagctcgcctgtccggctctctggccctgtgcatccactgtggctcccctcctgcagggccgcccaacttcctcccagggaagcccgccccccggcccccggcttggtcccctcttgggtgtgcccaggctgagctgcccccagggtcgccctcacctggtgtgcagggcctgccaggcggcgtcgatgtcggcatagaggttcctctcggaaggcctgcccgcgctggcaccgtagccggagtagtcgtagaagatgttgcaatggaggcgggagcccaggccaatgtagaagctgctcatctggctcaggtccacggcgttgccgtgcgagaagaagaccgtgtacctggcaccaggcacgcagcgaacatacatgcaggagacgcggttgccgcgggcgctcttggtggggaagacctcgatggtgtccagctcgcgctggctgtactggaagtcggcgcgctccgtcaggtgcagcttccagcgcccaggtgcgcccgaggaggcccgcagggtccccgagggggcggccccggccccaccaggccccggctcaggctcaggcaccaggaaggcgagcttggcagcgatgcggccggggcagggcgggcagcaaaggcagcagagctcactcagcgacagcccattcatggcgggcgccgcccgggccgggcctccaccggggcccccgccaacaacgccgcctggcctggcccggcaggggaagcgtgggggtgctccgagtcgcgggcaggggggagagcgcccccccagctaccgccccagacggcagccccgttaggaggccagggcccagccccatcgcggtccaagccgagccccagggagcctcgcaaccacaggtctccatgtcgtgccctgggaagcccatcccggcccgcgcccccgggccccagggccgcgctccatggctcccggccgcccgcccgtgcatccgtcggtccctctgcgccccggcccggcctcctgcaccgccaccgccgcagctcccccacggacggaagtgagtttactgaaattttcaagccacagaaagaacaaaagaagtaatatccattatattgtccaaaacaatagtacctggaagatctggaggcaaaaatgaagcctgagaatagcaggacatagacatatttcataacatagactcacagcagaataatggttatgttggttcattagggaagaaaacactaaacagctcttgcagatacactcaatatacagtaagatagcttgtgattttaacgagttagcaaagcagaacaatgaggcaaaagcaaacagaaacactaaaagaaatccattccctagaatcatttttaaagactttgctagatttaccaaagaattcagtattgacttattctgtctccattttatttcataatggaacccgtctaattttatgctaaatgtatgctgtaaggacaccttgctactctgaaaaaataagggatcagtggataaaagaccatattttattaaaaaaagagtgtgttttgatgcatgattttgtgactctacatttttaagtaaggatgaagaacttggtgattaattaaatgattcctcagttgctcatcaatgccatcagatgccttgaatatactgtgaggacagcatctggaagaaatggaggagatctgagtaataattcagatggagccaatttccacaatcttattttcccattacctgcagctctgaatttaactaagtctctgtgttaacaacttgtattgtttatctgggtgaatgacctcagaagacaccaggcagctggatgcctgcacttctttcgtgctaatggttcatatagtctcctcacccccaacactttgatacttccttgaaactggattacatatgagatagaaacaaagaatgcaggtggcataatgactctcaggagtcactgaatctgtgttcatgatgcattactgtgccagctgcctccctcttcttgtgaaggcccttctttattccttgagatgtgctcatcatgaaatagctacaagcatatcatctgcttgccttgcccgttatagcaaccatgaaaataaatttgcagcatcatatatagcccaaatattctcgaaagatgatcctaatagctctaataacaaaataagttttctacagagtagctatatgtacatgctctcagcttatgtaaacttgtgtttttattgctcttaaagcaaaatttttcctaaaattgagaaaagaactaaagttctttgtcattatatgaagaaagatacagcatctaatattgtgaacttctctattttgagatgttttcagacatcaagactggataataggctgggcacggtggctcacgcctgtaatcccagcactttgggaggccgaggcaggcggatcacgacgtcaggagattgagaccatcctggttaacatggtgaaaccccgtctctactaaaaatacaaaaaaattagccgggtgtagtggtgggtgcctgtagtcccagctacttgggaggctgaggcaggagaatggcgtcaactcgggaggtggaggttgcagtgagccgagatcacgccactgctctccagcctgggcgacagagcaagactccgtctcaaaaaaaaaaaaaaagactggataataaaattatttaacaattcggaacataaatttagaattgaaaaaagctttatactatactatactatactatactatactatactatactatactactaacacattttgtttgagcatggttgccttataagtttttggtagttcaatgaaaataatggctacttgtgagaaaactgaaatagactaggacatagtagatagagatagaaagaacaggtaaattaactgtctatgccacatggcaaagaaagtttacagtacgtagtcattaaacgtacatgcttataaatatataaccaatgatgaataattttaaatgcaatttagcagaattcagaccgttttatattaaacatatatttctgaatgaaatataaaatctattgaatgagggagacactttatatgtgtaattaatctcataaatagagaagacttttacaatagtttgtacactttagctataaactgtaattcaagagattcagtaagagtagctttttgtaacttaaatattctatattttccctgcatacatttttgcctttgatcatgtattttatttagcctgctaagatggtagagaaggtacagacagtaagcttttcaacctgacacataaattcaggttatttgaaaatggaatggtaaagtgttactgaagaacttttactatggttcgcatttggtaatatttcctaattattctataaacaaaatccaaaaaaaccttgatttcataacataaacttctgaggtctaaattaatcaataaaataaatttgttttaattaattattagattaaattatttatttaaataattatttaaataattatttaaataattaaattaattattagattaaatactagctgaggctcattagaggtaaactagagaattatcatcccattaagataaattttgattcagggaagtaacatcttggaagtttactaaatttaaatttaggaggaatttactaaatcaagtaccaagattttatttctgcaccaaatggaagacatatgtaaaatttaaatacattccattacttaatttactctttactatcatgagaattagtatagacagcatattttacacagagcatacaaagccttatcttcattgaattacaagtaaaatatatgtatgtacatataattatatatgtaatttagatattaaatgacagaatttacttatttacctgtgtgtgatggaatttgattctagtaattattccaggtacagtaactggttgaaaatgggacatgaagtaaactgatatgcttacaagtaattacagcaagcgaattcattgtaatgtctccaagcaaagcaagactacccacatgagataagaaatgagaggctacttattttgaccaagttagctcggtgacttggggaccaaggactacatgcacatggatgcttcttttgtacccctacccctgccaaaaaatatgtttccatggcaatatttgggaacccattatttcccaattgatgcttttactttcatataagacaacagttgatactccaaaatcaacttacattttaattaaccaaatacaatgttcctaaagacaaagagaaacatttcataacaataagagttaagccaacagaaagatagggagtatgaaaaaacagagaaaatcaataaaccaaaattaaatgcttgaaaagacaacacaattggcaaatgtttatttaggctaagcaagaaaaaagcagaagagactcaagtttctaaaatcagcaataaaagagaatccatcactgctagtaatacaaaataaaaataaaagacaatgcaatgaaaatcttatgctaaaaaaattagatagcctagatagaatgaagtcctagaaagacacaaactaaaacagactaaaggactaaggagcaatagaaaatctaaatagacctacaaaaggtaaaaagattggattgtaattttaagaacttataataaaattcccatctcaggtagctatcactctgagaaattaatatcaattgttcaccaactcttgcagaaaataaaaggggagagaacacttcccaattcatcttataaagccaggattactctgacaccaaagctatatcacaaaacaatatataacagtatctttcttttttttttttttcagatggagtctcactctgtcgccaaagctggaatgcagtggcccaatctcggctcactgcaacctgtttcctgggttcaagtgattctcctgcctcagcctcccaagtagctgggattacaggtgtctgccaccacgtccggctaatttttgtatttttagtagagatggggtttcatgttggccagactggtcttgaactcctgacctcaggtgatctgccaatctctgccttccaaagtgcgatataagtgtcagccttatatcacggtgagccactgtgcctggcccattgtttaaataaaattaaaaatcttcaacaaaatactggacaaactgaatccagcaacatataaaatagattatacactatatgcagatgtgatttaccccagcaatgcaacattgatttaatatttgaaaatcaatgcatacaaaaatcgcattaatagaataaaacacaaaaatacatgagcatctcaacagaaagtatttgagaaaatattacacattttcatcataaaacactccagagttatggacaagaagataacttcctgaaactagtggtagttatctatgaaacccacagctatcattatacttaccaaggagagagtgaatgactaatcagaatgaccactcttgcaaattctccctttttcaccttcctgctctcatcaccctcttttgctcctccatcttcccaaaaacattttcccccatcttttcccaaagccttctcccctctcctgctgctcaccaccattttatccccctccacctaccccaaaacttttttctcacacccccaccatcttttcacaatgccttctctccactcctgcttaccaacctcttttccccactcctgcccctctcccatatgccactcttttttcaccctccatctaccccaaaactatttgtcttcccaaccctcctccccctcatgctcgccaccatcttttcctcctccatctacccaaaaacttttctccccactgtctttttgcaaatccttccctccctcccgcttgcccattttccccacctttaccaacctctctttactcctcccacttgccaccctcttttccccctccatctgcccaaaaactttttacccaccatcttttccccaccctgttttcacaaaaccttttctccctcctgctcagccccccgtttttccctctcctatttgccaacctcatttccccctccatctacccaaaaacgtttttttttcccaccgtctttttcctattgcctttttgcaatgccttctcctgcttgccatcctcttttcccgttggtactcaccaccctgttttcctcctccatcgaccccaaaactattttccccctcttaccactccggtcgcactgcagtcgccatctcggccaccacccacagtgaggcgagccgcggtgccgcaggctgcagcctccagcatttggcaggtgtcttccttccccttctcctctgcctttaagttgggcacagaagagctgtgtaggcaaacaggaaagaacccgggatggtctgactcccccacctcagcatactttatatgcggagttatgcaaatgagttctgggactacatgttctgattggatgagagaaaaacctctaggcatacttagattggactttgttatcatgttctgactggatgagagcaagtcttaaaacgaccaatcagaacatgataataaagtccaatcagagtaggcctagaggtttttctctcatccaatcagaacatgcagttcaggaattcatttgcataccctccctgtataaagcatgttgagtgggcagagtcagggtcttccgtatattctccccgcaccatccgtgctcggcttagtgcaggaagaggagaagaacgggaagacaaccgcggcacagcagcttacgtgctgatgttggctgtggtgatggagcctgctaccggagccacagtggcccacagcgggagcatggccagagtggtggaaagacagtggggcaggtatgctatcagagctgcgctgcccgcggtgagggcagattgggggcgctatctggggttgcattgcctaggtgggttctgtgcagtatcggggactacgttacttgcggaggtggaacaggggaagggggtggggtgggggggacactattgaggatgggattaggtgtgctatcgggggccgtgctgatcatcaaggcagcttaggtgtgctatcggggcaggggacacgctgctccgagttgggggatgttacaggggctacactgcctgtggctggcaggggttaggggcactatctggggctgcacagccggtagtgggtggcgtgttagggacgctataagctactgtgttgtctgtgccccagggagggttaggtgtggggttgggtgtgctatcggaggctacagtgctagcagacaggttaggggcactgttgggtgttgcaccgcttgtgccaaggggtatgtttggtgtgctatttggggctacaaggggcaggttgggagcactgtcgggtgctgcactgcccatggcaaggggtgggttgggtgcactatcaggggctacactgcccagggcggggcgggcggggggggcgtgctatcctgggcttcactgcccatggcggggggctggttggggacgctgtcataggttgcattggggtggtagggggcgggttcggtgtggtattgggggctgcattgccagcagtgtgggggggggggtggttgggggcactgtcaggagcttgcgctgtcaagctagtagcaggttaggtgtgctattgggggctgcactgcccgaggtaggggggcggattaggtgcgctattgggggctaaactgcccacagctggcggggtttgggggctctgttggggggttgcagtgtcagaggcgggttaggggcattatcagctgctgcactacccgtggcaggaatcaggttgggggcactatcgggtgctgcaatgcctgtggtggggacgggttgtgggcattatcgggtgctacactgctggcggtggagtggttgggggtgctatcggggtcacactgtcagcggcgggggacaggttaggggtgctatcggatgctacactgtggtggagggcagggggtggggtgttgagagcgctatttgaggactacattgctggcagcggggggcggattaggggcactctcagggctgcactgccggcagcaggcagcagaggtggcagtgacagcagtggtctccacggaaaggacagtccttccctccctggactccaggctttacaaagcgattttctcctgcttaagtacagaggacatacagtgtttccgcaggaatactgagcacggcagggccccccacatctgctgtggtttcctgggttacaccctctcgctctgtgttgtggatactgcctgggacccccaggcaccgagtaacgtgcaccacgtgggggacggtgctctctgggtggaggctcaggaatgagagcccgcacttgggtggggagagctggctgggtctgactttttgctgcttccgttcccctaggaccgcagctctggtgggcccagtggttcctgcggagtggggagccgggcactgtggtgtctccagtccccaccacaggctccgattcatggccagcttgggccgaaaggggagggtgggtgtcagtgccttcgctgaaactggcacctgccacccagtggccagcatgaccaaggtgaggctttaatgctaccactccctgcatctgttctaggtttttctggctttgcctgcccagcagtctgtgcccacctagaggagtaggaggggccaccatgccgcatgctggaggctggagcccgcagcctgcagatggcacagtactacagctcgccttgctgcggttggtggcagtgatggagactgcagctcgaccccagcgatggaggctggaggtaggagggtacctggtggtggccacgtggtaggagccttgtagggtggggctggtgcattgagagcaacagcagcagtggttgtattggcatgggcattagtggtggcagcagcagcaagtctgtgagccgggaagggggtagtaggagccctgcaaggcccagctggcctggggtgggtaagaagcagtgggtgctgcagcatgggcctcggtggcagcagtggaagtgcagccagggcaaggagtcctcccccacctttctgcagtctctggagggcgcccacctcctgctggctcctgagccaggcatgagtggcagcattgtctcattcttaacaaaatttagggaatgactatttgtgtatctttttgcttgttttttgttgtgttaatcttggacttttcgaatttcatgaatcagggagtggataaaaggtatcataataggccttctaactctatcacctgatttttttcctttcttccagtctgttttttcttatcaccatcatcttgttctttattttcttatgctgctgcctatatttctggtttctattcttgtttctctttctggtcctcctgctttttgttttctttatcccaagcaatggccttaacaaactgaaactgagttaaaagtaaactacttgctagtgtgttgtatttttaaaataattggtccattactgtgttttagagatgagaaagtagttgcataatgatttagttacttgaatagctttgctttcgtgatcctgttaatgcgttgtaagtagttatgcaaggaatgaaaaaatgaagcatcaaataaaatactgatagcaaacagtcatttcatctctctcccatatagtctggagataaatgcaagtcagggggttaataagttccaaaaatttatgagatcattaagtgaaccacattcccttcattttatttttctgccacagttttcaagagcgttgtcatttgcatgagcaaaccttgttcaccacatctttgcaacagggaagggaaggggaggatcatatgtacaatgttttaaggcaaaaaaactcacaaccaaaagcaaggctttattaactttcaccttcgagaagctgcagtgttgagccctgttttattcctagtattactgcctttgatacgaactcttaagtgatcactttagaagttaatgcattttattgactgctttcaagaaacagtctatattgtatcatgcatgtttttcaagcccgcagaattgtataaggcctatatatacatagggcctataattttgacactttttaatgatttataaggttacgatcatgtaaaatcctgttgacacgtgagaatatgcctaagtaccgctagatagcttattttgaagagatagttattttgaagagatagaaattggttgcagtttgttaggtgtatttgtcaatgcattgcctcaatgctttaaagcatatagaagtttgaatatgctttaatctcatgtagtcctttgtttatagggtgtttaatatttttaaagactaaagatgtcacagccccctttaaggttcagtaatattaagattggagatttatagggttagaatccaacaaattcagaggaaaattgttaaattatatagctgtagagcaggaaatgaaacccaggttctaagctctaaggggaccatgagctgccataccaagtgcatcagtgactgggcatagagttggcagaattacaggatggttaagagagtgagctgtagagcctcactctatgtgaacatgaattttatataagtatgtatgtatttatttattttgagatggagtctcactctgtcgcccaggctggagtgcagtggtgtgatcttggctcactgcaacctctgtctcccagattcaagcaattctcctacctcagcgtccccagtagctgggaatacaggtgcacaccaccatgtctggctaatttttgtgtttttagtagagttggggtttcaccatgttggccaggctgttctcgaattcctgacctcgtgatccacccacttcagcctcccaaagtgctgggattacaggcagccactatgcccggctgtgaacatgaatttttaaactgcatggtgctttgggtcccagcttctccatctgtacaatggggacagtactaaggttttctttttcttctcagttgactgaattatttccatagtctgtctgtcttgccactcttgttacccacacgaaaggacctaaggtaatttctgacagcctgggactccttgtgcaaaacagaaggtgccacagacctcattttaggagaaacctttgttttcctcttggaaccccaagaactgtaagcagacaggtccatctcaaaatccaaggctctgctctgttttgctttgctttacctgactttttttttgatttgggtgggcatcaaaaattagtaggggagagctaaagaaagttgtggatatgaacatgtatttatggtaaggtaagttatgaaggagagaaatcttaggatcttgtatggcaaattcttgcactaaagtagataatgactaattaggaaagcaggaaatataggacaagtcagaaagtcataagatgggagagaaaagcttacgcctggtagatcctctcctgtctagaagtgtcgtatgtgtgatgtttatatgaaggagctctaattaattggattaaaagataatgaaagctctaaaattgtcagaaaaatagaagctctaatgccttttatttcacgtgacttcagcaatctttgggaaatgagagttttaaaattattggtggtaaaaagtcttcaaaaagtagacatttggtctaaattaagtcagaggttaaattggctaagtgctttaatgtcataaactgcttctttgactttggaaaattgttcagtttacctaatttggaactgttagatttctaggtaaggcctggggagaggtggagttagccatgtctcctagctatgctggaagagttagactttatctgcagttctgtcatgtatcctggactctgcacctggtatgtaattgaaactgcttacattgaaaagaaaaattatgtgtttttggttttaaaaggggtgggaatatggttttttccaaaaagtgagttttggcaaatttagaaagtttaagaattatttttagttgtaggaaaataaagtttaagcaagttatagaaggtttatgaaaattaactttgtaaagaattgtgtgtgtgagcaagttgactaaagggacagtaatgttagatgtaataaatgcaggtacccttccactttatcttctgtttcttaggttataaatattcactacctacgtttctaaaaactctttcactataatattaacacataactccattctccttgtattgcctgctttttcatagtatcctgaaattgcattagtagatttagattcagaagatggtggggaagcatcttatgagtgttttaagtaaatttaaggcaaagggttttctgtacatgggtggttatcacagcatcacttgttgcagcaaaacactgggtaacaacaatgtttatcaatgagaaattgttcggataaatgatgatttgtgccttgcgaggctcaactattcaaaagcaccctcttttcctcacttgctttacctttggttctgggcctggagcctttcagaggttactcaggaaatggactcctgtttcctgtgactaatctggacagcggcttcctatttcattcttcagcatcttccaaaaatttctgaagataatttcttcctttgtgaccacccatactcttggtttactttgcagttaacaatttcatgccttcactagattatctgtgtgaaggtgtggggtgtatgtgttcatactctggagggagcagaggaaaatagccacagccaaaggagtaatcttgcactaaatactcattataagaatgttgatacgttcatagatggtaaatctgtcagtaatttttacttgtatgattcttggttaagactgcactcactggtgataagcgtgctgaagggatcataggtgctatacttatgtgtgggaattgcattcaaaccaccaatgcctgtctactcaagttttgttgccttttgattaaaaactcttgggaatgtttccctggcatgcaaatatgggaactgcagtttgattctaggtagaaactctttggtagttgaaatgccataataagagacacagctgtcaatgggcaacaattcactgttggtaaggaatttacagtgctacttgccatattcttctttatccagactttgtgccaagaaaatgaaattctttttaaaaatttttttctagagtaatcctacaatattgctgttatcaagcctgatgctgtaattagtagaaaatgtctagaaattaaaagaaaagtagtattttccaactatggttaaattaattgcaaaataacttcctcttaattgtcagattggagacaagcttattaagagtgaaataaaacataatgtgttgctggtgctaggtacctctaaagcctttgagcactttcttctttataaaggctcaatctactcatgtgtcctgtaaataatcctgctctaccagcatcctatgtaaattttaaaaattatagttcatatattagattgtaacaaatgttgttcttctttaattatatgcaatgcaatcttgttatagactcacattagcttgccttattccctgtatgtttgctgtaaaatgtatagtccttttcaatatatgatagcttaaagatggacttaatattttgttttagaaccaaaatcttttatcttatatacaggaaaattacattggaattcagagatcagcaaacatttcctgtaaaggatgaaatagtaactattttcaggtttgctcagcatgtggtctctgacaactaaactctgaagtcataccaaggcagcatcagtaatgtttaaatgagtgaatggcgctgtgttccaataaactttatttacagaaacaagtggtgggccacattttgactgcagggtatagtttgtggacccctgaacaatggctttttctgaaacaacacaattgaattgagatttgaaagaatgttgaggcagcattgtttgtctggggtaatacctgaggtttgtcatctcacaccagggaaatcagggatgtggacacacaagaagtgagttcaagagtggatgattaataggtgaaagaaagagaaaagagaacagctctctctcctgcagaaagagagaggggcacctgagtgggtcttccggttttgtggtgaaaagcacaaggttttataaaggagcttgaggaggtggtgtcttgatttacacagggctctagagactggttggaccaggtgtgaacgtttgcatagcacagggagaagctggccattgcaccctaatcttttattatgcagatgggttctttaccttaccaggaccatattgtctgttccttactgtacctgtggttgacagagaaaagggaagatggagccaccatgttgaacatgcctggcccacaggtagccttttcctattggcacagctgctggcattcctatgagagcttatcaatgtctgcagcccaattttacaagatgctctttgttagaaaataaatgatatgggttttttttttcattagtaggaaaactttacactaggacttccttactttcagtatctgcctaaataatttctttttaattcctacatcaatgttgcatgtgcaatagagaaggtgacatgtagggagctgtgtcagcaggggttgcatatttcttgatgagcatcccatgatgcattcttcttcacttgtggcaacattagcattaactaatctacagtaaagtagatgggtccacaggtcatgggacatacactagctctgccaattacatgttgatttaaataatatcattctctaaggacagctttttttcccccagatcctggtatgtatgtggagttggggagagacaccaaactgtaccccatttcctcatacattgcttatacttttagaagtgtttgaaagataatatcacatactagtagtttactgtttcttattcaagttagttttaatagtcgctagggtgaatgttttcaaaattgtatagatattcgggttgaggcaatactataaattatgagttcatctcagtttttttgtgctagcgtaatgacatttcggagacataatgcatatgtgcaaaatacttcacctctctggaaaacagtaaagggctacataataggacagacaaaaataaaggcttggcgtaatggctcacacctatgatcccagcactttgggaggacaaggcgggtggattgcttgagctcaacagttcaagaccagcatgggcaacatggcgaaacccatgtttacaaaaacgataaaaataagccgggcgtggtggcatgtgtttgcagtctgagatacttgggggactgaggcaggagaatcgcttgagcctgggaggtcaagggtatagtgagccgagatcgtgccactgcactccatccagcctggataacagagtgagaccctgtctcaaaataagtaaaaatttataaaacaaagaatgtttctaactgtaataaaggagaagtgatcaagcttaagtgtagcttagatttaatctttgatttccgggtactatattacttaaaaatatgatttggatatttagaagttgttcaaattagaaactcaggagtggggtcactggtcactaaggtgctgaatatttttaataccttagtggatatgtaatcaacaaagccaacggaaccaatagagcatttgctttcataagaatttaagtgttgctgggtactcttaaatcgagctcacattattggtgtcatttaatataattactgaatttctttgaacccagtttccactttttaaaaattatttagctcattaggctgaaaacttctctttgttacattttattacacttcagtgtaatatgtgtaagatgtacattgcttctctctagaaaggtgagacaagttgaagcagggttgggggtgggtgcttccagttcataggtaaataggagacaaacggttgcattcttttgagtttctgattatcctttcactgaatacacaatttacatgcaagatgccatagaggaatagtcacttatgcctgagtctggcttagtgaatctgcatttttacataaaaaactgggcagagaaagccaatcagatacacatttgtctcaggtgaggagagggatgactttgggttctgtcctttgtcccccacctgtaaagataatctatcaattgccaatttatattgccagggtcaaattcaacagaactgttttagtgtaaagatcttgaggcccacaagaaatttcctttctgacaaattatgagggaggtatatagctttcgaaatctttgtagttatttttttattttattatttgggttttttttttctttattgacaaataattgtatatactcacagggacatagtgatgtttcaatacagaaaagttatagtgagcagagcaggataatttcatatcctttgttaaaggaaaataaatctccgggacaccccactaagccaaataatagttatcttatttagaaataaaatgggaggcaggtttgtttgatggagttcctagctgaggtgggagaattgcttgaacctgggaggccgaggttgcagtgagccgagatcgcgccattgcactccagcctgggcaacaagagcgaaactctgtctcaaacaaacaaagactatagaaaagctatttgtgaaaatgctttttgatgtgctgttttatgtcacagaatgcaacctgtgttttgattcagcaagttcaaaacactctttttgtggaatctaagaattgattattttgatcctattgagctttcataagaaaatatgaatatccagttgtaaaaactagaaataagctataagctatctgtggaatgctttgtgaggtgctgttttatatcataaaattgaacttgtgttttgattgaacaagttgaaattactcattttgtagaatctaagaagtaacgttttggaacttcttgagcccttattaaaaaatagaaatattcagtcctaaaaactagaaacaagccatccgtgcaaatgcattgtgatgttctgttttgtatcataaagttgaacctgtgtgttgattaaacaggttctgaacacttttttttgtagaatttatgaagtggcatttctgagcctattgagcccttatacaaacatacagttttaaaagctagaaacaagctatctgtcaaaatgctttgggatgtgctattttatgtcacggaatgaaacctgtgttttaattcaataggttcaacacattcttttggtagaatctgagaagtgacattcccaaacctctgaggcctttaaaagaaaatacgaatattttcctctaaaaactagaaacaagcaatgcgtggaaacgctttctgatctgttagtgtcacagattggaaactttgttttgattgagcaagttcaacgcactctttgtaggatctaagtagtgacatttccaaacctattgagcccttataagaaaatatgaatatttagtcctaacatgctatctgtgaaaatgctttttttttttttttttggcacagagtcttgctgtgttgccaagctggagtgcagtggtgtgatctcggctcactgcaacttctgcctcctgggttcaagcaagtctcctacgttagcctccctagcagctgggactacaggcgtgcaccaccacgcccagctaatttttgtatttttagtagagatgtggtttcaccatgttggccaggatggtcttgatctgttgacctcgtgatccgcctgcctcagcctcccaaagtgctgggattacagacgtgagccaccatgcctgactgaaaatactttttgctatgctgtttcataacacagaattaaacctgtgtttttgtgagacaggttccaaacactctttttgtagaatctaaaaaagtgatgtatccaaaccttttgagccataataagaaaacatgaatatttagccctaactgctggaaacaagctatctgtcaacacactttgtgatgtgatgctttatatcacagaaatgaacttatgttttgatgaaacagattcaaaacactattgtagaatcttaagaagtgacatttctgagcctattgtgaccttataggaacatacaaacatccagtcctaaagtctacaaacaagctatcttggaaaacactttttgacgtgcagttttataacacagaattgaacctgcattttgataaaaacacgttcccaactctctttttgtagaatctaagaagtgacatttcgaatctattgagcatttacagtaacgtatgaatatcttgtaataaaaactagaaacaagctatctgtaaaaacactttgtgatgtgctattttatgtcacagaatggaacctgtgttttgtttcagcaagttctgaactctttgtagaatctaagaagtgacgtttttgaccttattgagcccttataagaaaatacaaatatccagctataaaaactagaaacaagctatcagcgaaaacactttttgctgtttcatatcacaaaattgaacctgtatactgattaaacagtttccaaacactttttttgtagactcttaagaagtgatgtttctaaggcagtgaggccttatgggaacatatacataatccagtcctaaaaactagaaacaagctatctgtgataaccatttgtgatatgctgttttatgtcagagaatggtacctgtgttttgattcaacaactgtgagacactctttttgtataatctaagaagtgatgtcaccaaacctattgagttttataaaaaatatgaataaccctaaaaacgagaaacaagctatctgtcgaaaatgctttgtgatgtatttttttatatcaaataatggaaccagagttttgatgaaacagcttccaaacactctttctgtagaatctaagaagtgacatttccaagtcaattgagttcttacaaaaaaaatgcaaaatccagtcccaaaaaactagaaacaagctacctgtaaaaatgctttgggacatgcagttttatgtcacagaacggttcctgtgttgattcaacaagttcaaaacactcttgatgtagaatctaagaagtgctgtttccaaacctattgaacttttattaaaaaagtaaaaatatccatccccaaaaactagaaacaagttatctctgaagatgctttgtgacgtgatgttttatgtcacaaaatggaaactacgttttgatttagcaagttctaaacactttttctagaatataaaaagtgacatttctgagcttattgagctcttagacgaacatacaagtatccactcctaaaaatgagaagaaaaacctatctctgaaaatgcaatgttatgtgctattttacatcacagaatgaattttcaaacactctttctgtagaatctaagaagtgaaatttccaaacctgttaagcccttataggaacatatggatattcagtcttaaaaactagaaacaagctatatgtgaaaatgcattgtgaagtgctgttttatgtcacagactggtccctgtgttttgattcaccaaagttgaaacactcttttggtagaatgtaagaagtgatgtttccaaacctattgagcttctataagaaaatatgaatatccagccctaaaaactagaaataagatatctgtgaaaacactttgtgatgtgctgttttatgtcacagaatggaacctgtgttttgagttgacaagttccaaacactctttttgtagaatctaacaaagtgacatttccaatcttactgagcccttataggaagatgtgaatatccagtcctaaaaatgagaaaaaaagctatgaaattgcattgtgacatgttgctttatgtcacaaaatggaatctttgtttttattcaacactttcaaaactttttgtagaatgtaagaagtgacattttcaaacctattgagcccttataagaaaatgcaaatatttagtcataaatattagaagctctctgtgaaaatgctttgtgatgtgctgttttatatcacagaattgaacctgcattttgatgaaacagcttccactcacttttttatacaatctaaaaggtgacatttcctagcctcttgagcccttattggagcatatggatatcctgtcttaagaactagaaacaagctagctgagaacatgctttatgacatgctgttttatgtaacagaatggaacctgtgtttttagtcaacaagttccagacactctttttgtagaatcttaggaagtgacattttctatttttattgagcccttataataaaatattaatatttagtcctaaatattaggaaaaaacctacctgtgaaaacgctttgtgatgtggtttcatatcacagaattgaacctgtgttttgacaaagcaactttcaaacactgtagaatctaagaagtgacattactgagcctattgagcttttataggaacatacaaatatccagttccaaaaactagaaacaagctcttggtgaaaacgctttgtgacatgctgttttatgtcataaaaatggaacctgccttttgatgaaacagcttccaaacaggtttttttttagaatctaatagttgacatttctggccctattgagcccttatagaaacatatgaatatccagttctaaaaactagaagcaagccatctgtgaaaatgctttgtgatgtgctgctttttgtcacggaataatacatatgttttgattcaacaagttcaagacactctgtagaatctaaaaagtgaagtttttgaacctattgagacttgattaaaaaatacgaatattcagccctaaaagctagaagcaagcaatctgtgaaaacactttgtggtatgctgttgtatgttatggaatggaacctgcattttgatgaaacagcttccaaaacacttttttgtagaatctaagaagtgacattttggagcctattgaacccttacaggaaaatacgaatatccaatcctaaaaactacaaacaagctatctggtaaaacgctttctgatatgctgttttatgtctcagaatggtactggggtttcaattcagcaagtttgaaactttctttttatggaatctaaaaagtgacatttgagaacctattgagccgttataaaaaattcaaatattagccataaaaattagaaacaagctagctgtgaaaacgctttgtggtgtgctgttttatgtcaaagaataatacctgtgttttgatttggcaagttcaaagcacttttttttctagaacctacgtagtgacatttacaaatctgttgatcttttataagaaaatatgaatatccagccacaaaaactaggaaaaatctgtgaaaatactttgttatttgcattttatgtcacagaatgaaacctgtgttttgatgaaacaacttccaaaccctctttttgtaaaatctaacagtgacacttatgagcctatggagcccttatagaagcactcaaatacccagttttaaaactggaaactgtctcaaaaacactttgtgaggtgcttttttatgtcacagaatgaaacgtgtgttttgagttgaacaacacacaagtttccaacactcttgaatctaagaagtgacattttcaaacttgagcccttatagaaacatacaaatatccagtcctaaaaacaagcaaaggctatctgtgaaaatgctttgtgatatgctgctttgtgtcatggaatggaatctgtgttttgattcaagtttgaaacactctgtagaatctaacaagtgatgttttgaacctattgagtcattataagaaaatgcaaatatttagccataaaaatgagaaacaagctttttgtgaaaatcctttgtgatgtgttttctatcacagaattgaacctttgttttgttgaaatagtttctaaacatacttattgcagaatctatgaagttatatttctgagcatttgagcccttataggtacacatgaatatcagattctaaaaactagaaaggagctatctttgaaaactatttgtgatgtgctgttttatgtcacaaaatgataaccatgttttgattcaaaaagtttgaaacactctgtagaatctaagaagtgacatttctgagcctattgagcccttagtaaaaaaacaaacaaaaaacgaatatccactcctaaaaaccagaaaaaagctatctggtaaaatgctttgtgttgtgctgtttcatgtgacagaatggtgcctgtgttttgattaaacaagtttgaaacactttttttttgtagaatataagtagtgatgttttagaatgaattgagcccttataagaaaatgcaaatatttaaccataaaaataagaaacaaacaacctgtgaaatcactttgtgatatcctttttttatgtcacagaatggtacctgtgttttgatttaacaaatttgaaacacactttttgtagaatctgagatgtgacatttacaaaccaatcttaagccagttagatactctgatgagccagctgtgtgtgtatgtgtgtatgtgtgtgtgatctttgattattaaaactgaaaaaataatcgtatattcatgactagtagacacagtgttttaaaactgattctgaaagatttgagggttaggcttgttttaaaaacaattgcataggtcctggaaacaccaagaattagtggcttctcattcctagtcacatgaaaaatattttactactcttgtgaatggccataaataatatgcagaattttttctgtgtcctaaccttttatataattggttctacagtgtacatcactgtgtgcaactttgttttgtgtgctcagacttacattttccagttttctccactttgatacaattggtctgtgtttcatacattttgtattttctatagcgttcctttatatgactctaccacattttattgagtctcctcatgctgacaggtaagtagatgaattaataaatgaatgaataaataaaaatgagagcaaatttcaaacaggtgattaatttagtgattgtaaccatggactcagcaggttagaaataaaaactgaaagatttagaatgcaagcaggcacatcataccttctaatagccattggaactatgacccacaaaccattagcctagaatgatgggacatatcttgtctctaaaaaaaggtcactgttcagttctcaaagaatggatataaaaatggcagataccattccacattattctacttcctttaacctctacgcataaaacttgagctgcagggaatgttacctcctgttcttaaaaagacttgtagttcagtgaggaactcactcctttcttcattcatgtgttcaaataatatagggaaatgaatggaaaagtgaagagaagttgaagactattatggggatagcacaggattagtcagcctcatggtattattgatctgccttattccacaaatatttaccaagcacctgctacatgcaatttgtatactaggtgctggggatacaggagataacaaagtccctgctgtcaatgaaaggggtcagtcctttgattcatctttagttaattttaagcacacaacaactatctcaaactttcttcacactttccaagctcccgatccttcatgcactcttggtagatgcctgaccttacctcttaccttactagaacctaagaccacctggtataaaatcccttaagcacactcagatttgcgtgattttacaatgatgtctgttcccaaagcatcctcacttctcttggagctgagggtgaagagctcctctttcttcccatccgtgatcttggaacatgtacgactacacttgtgacagtaaatgcttaatacaggcagaaggtttgttccttatttcctccctggggcctccctccagtgaatatctcttctagcattgtcagttgtatccaacagaaaagcagagatctctccattggtccaaaaacctaagatggactctcactgctaaacttctcaaatgaaaattcctccactttagtcctgattaccactcaaacactgttagactgggcaggtcactacccctgcctagttctgtttccccatctacataacagagaaataattgcgccttatctatcctacagaagtgtgaagaggtttgatgtgacagcagtgaaagcaatttaaaaagcacagagtgctatacataagaagacattttcataattattccgctctaacatgatatctgtattcatacgatctcaaagtacttacccaagcatggattctaactcttgtgtatgtaagcaaaggtgtaagtctgtcaccctccatgcaaatagaatctcccctcccttggcccctgcatctcaccatatacaggaattaactcaagatgaatcaaagttttaaatgcaagaccgcaaactatgaaaatcctttaagataacctaggccatacccttcttgacaaaggctttggcaaagcatgtgtatgtctaagtccctaaaagcaatagaaataaaaacaattattgacaagtgagacctaatacatgaaagagtggctgcacagtagaagatattaccaacagagtaaacagacagccttcacaatggaagcaaatgttcccaaactacatctgacaaaggtctaatatgtacgatctaccttaagtccttaaatcagatcaaaaagtccaattaatggttagagacatgaatacacactgctgaaaagatgtaacagccaccagtaaacatgaaaacatgctcaacctcgttaatagagaaatgcaaatcaaaagcacactggtcaaaatggtgattataacacagtccacaagaacagataccagcaggacagaggagggcactggggcaattgatcatgattcttatggatagtcatttagtgttattaatgaatttcataacaaaatgatcaccatacaaaaaatacaaaatgtgttttcttccctgagaaaggaaaataaaaacttggaatgccgattcactatgccaaaaggaaaagttaagctgaaagctgagtcatgcaagaaactgcctttctttttttttcctgagcagacagctactgataaatagttaaatttctccacaggtagctactctatgttcatctcatcttacttaaagtgctgatttactgagcaggagaaaaatatataactgactattcctttacctgtttgttttctcttgcaacatgtggattcagcaacgtgaccatactctccctcttttccccgcagcctgcttttctcttctaaacactgaaaccctaaaatatttttggagaaaggcacagacctctgtcgcccagccatgtctttaaccttggaagaagaaacttctaaattgataagagatctgtctcagacactttttcgtttacatcccgttatctcagaaagcaaaacaggctttgttccaacccaaagtaatttgtgaatattcaagcggtatcattctgatgtaaaatttacataaattcttgggtttaccaaaatgcaaatgggcaagcagatcactatttacagataatggcctaaaaaatggtaagagtaaatgctgtggagctaaatgtttctgagtctgccatttcctagttttgtagtttctctcgggcaagttacccaaagttgctgtatgttattatcttgacatttaaaatagaagtaataactttattataaataatagttaataccatagggtcattaggaaagtgtctggcatatatagtcacaacccagtgaatgccattattgtttttgctattatcagtataataattgatactaattttgatgctgaggtaaaataatatctggcagcttttaatttgctaatgttaaataactgaaaatagctttaaaaagtgaaaatatccaaatcaatgacaatatttgatttatataaaataagcttcattttttttagtttttttgctcctaattattacttcactcatcacactgatatctgagcactttttaaaacatatccacccttctcagttgtactacttattcccttttcttgtaatcccagccttcaaagatcctttctcatttttctaactcatttcacgactccctcaccttgacccccagttatatctctcttgaagtcaattccattgaattgactacttggcccaaacttcaccccaactcagtctctcttcaggaaggaaagtccccacacaaaaaggaatgtgtctttcaactcatgcgccctttttgaagaagctttccagacagcttccttacagtgatctccgttatccatcctttagatcgctgtggagtcctacaggggcgcaatgtggacagtcattcaaatgaagcacacctaagtgcttgcattttctaaaggcccattgattcatgtaactcccgtacttgcacagataagatgttcctgcctgaatgcagcagatggaaatgaaaattgtattctctgtcaaggctgattgtattacagcttaatgatttgcattttaaaacttggaagttctcataaatattaaagtgaaagaacaattggctacattattaggtaggttcggctgttcgtataacctggtgctaactatctaacctgcctgagtgagcctcagtcttcattactgcagcatttgtaagatatcaatgcctgcttgaactcatgtcttactaagattatggccaggattgagtaacatatggatataaaagcacttgacaaatcagagtatttcataaatgtaataataatatgctacatttataacatctatactcttttcctgtgtctatcttcatttaaaccttgcagtttctatcataatcaaagattttgtaatcaggttacaatgagtaggatttaacccataagcaattttcaaatttcctagatatgttttcagttttcacatttatgttggtgacaaaattctgttttcagttttggtgtttgcatcttctaaaacagtgtcttgggtacttgctctttgatgagacactgtgcagacataaagagtgtaagaaaacagaacagtttatctcagctttttgtggtctagataacctgcacactgctttcttggctcactgcaacctcctcttcctgggttcaagtgattctcctgccttggcctcccgagtagctgagactacaggcatgtgccaccacgcccagctaatttttgtatttttagtagagatggggtttcaccatgttggcccggatggtctcgatctcttgaccttgtgatccccctgccttggcctcccaaagtgctgggattacaggtgtgagccaccgtgcccggcctgcacactgctttttaataagctgatctgtcttcttgtttacataggctgtgctatagtcatttaaagttcaaaattactgctaaaaagtaattaatcctttactgaaatattcctgctatttcatgagctgtcttacaatttggaggaatctatttgtcactgatgtttaaaaaagaaagtcacagcagggaggctttagcttcattgaggaacattattataaaataaaatgatcgagggtaatttttttttgtccttgtggtactgtttctgcagatctacattaatctgagcatttaaagtaataataaatttgttatatcctctttattattcacttcaccatggtagcccctagtggtaaaaggagatgtaaattgctcagtgctcacattgcagggaattttttcctcagttgaataaaaaggagttaagcctctttggaaatgagggctatagcctgtcaataactacatatattcctgtttttaagaaatcagaattctggtgtccagtaaatgtagatgccagcattattaaaaagtgattgagcagagaaatgaattgaatttttgacccactctggcttccagctttcatgggagcctatacagggggatgatgaagagggatataagagaataaatgattgctctattaatctactttaattgatactaaaatctgacagcgaattacaagttccaggcagtaaggcttaccaattcattggtaatttcaaggttctactttgctttctttttgccttcagctccttgcaaaggacacctttttttttttttttttttttgagatggagtattgctcttgttgcccaaattggagtgtaatggcccttaacatccgcctcctgggttcaaatgattctcctgcctcagcctcctaagaagctgggattacaggcatacatcaccacgcctggctaattttgtatttttagtagagatggggtttctctatgttggtcaggctggtcttgaactcctgaccccaggtgatttgcctgcctcagcatcccccgcccaaagtgctgggattacaggtaggagccaccacacctggccaaggacagccttttatagttcagtttctcagtttatctttgactattcttaattaagcttgacctggttctccaccactgacgctattggagttgcaaagcattttgctgttataatgatagctcccttgatggctgttcattattaactggttttcaaaagtgctgcttttaactttcattttataaatatttaactcaatttttataaaatgtgcatagactatagaggttctgcttacctgtttaatacagtaaaaaaatcccttttgtaatcttatataatattaagaatgtgtccttaattcatgcttaacataaattcttacacaactagcagtatctcaaaaaataaatgatttaatagtttatgacccttatacatataattaattgtagtaaaatatcttagaaaatagaatgagtattttttataaagataaaaaatcctgatttttttttctggtcttaatataaaattaaatgtgttaaagggaacttataaattacatagtagttcattgctcaggaaaagaaatgacaaagtaattaagagtgtaaaattaaaaggattaatttttcttaaaggccgatgagttaacaacacgcatcaatctctcttccttctccaaacttcagacaaatgatggcaaagtaatttttaagaagtcaatttatagaggcaaaaaacctgaagtacagagagtaggaaagacagtaatagaattgagagcagttgacatccataacattcctattattacctccattttctggataagaatatggagaagaggaatcgttaagcaatttgctgattgtcacatattcagtaagtggcaaagttagtattgaaacccaagtagtcttgttttaaagtcatacactcaatcactgtgccataattcaataaattgtgaaggatgggaagcagatggagaagtgattgatgaagcaggactgagaaagtgctgcctatgtgcccacagtgtgaagaccctacaagacatcagaacatcatccagtgaagctgtgagcagctcaccacttggaaaaactgagtgttttggaaggcagggataaagtgcagttctgaaaagagaaaaatccatcaagttctaaacggtcgcgctctcttaccccacagtgggcaatggtctctccattcatcattttcttttccctgagtcccttgaatcttaaatatactattctgtgaattaaacatggtaaacattagactttgaccagcgctattatcagaagttcacatacctaatcaaaggacctgtaaccttcttcccctccttagtttctacaccaccagtagccaattatactatcccagctcccatcctaaaatccccttctaaaatagaaggcaaaagatcatcagtcatttgagcaaaatttcagcatgacagcatgagtagttgagacctatagtaacaactaaaatggactgggataaaacaaataatgtttggaatcaaagaacaggaaaaatacaaccgatattggagcaagaaaaaataaaaaagaatatgaaaaatagataagaaatagctattggaaaggtacaagaaatacaattttaaaaccagtggaacataagacaaaccacaaaatgagaaaattctattaataaaaggtcgggggtcggggaactgtattctttttttttttttttttttttttaagacagagtttcgttcttgttgcccaggctggagttgcaatggcgcaatctcggctcactgggcaacctccaccttctgggtttaagctattctcctgcctcagcctcccaaatagctgggattacaggcatgcgccaccacgcctggctaatttttgtatttttagtagagattgggtttcaccatgttgatcaggctggatggtcttgaacccctgacctcgggtgatcccaaagtgcagggattatgggtgtgagccaccgtgcccggccactgtatcttttaaaaatgtaattgtcatggaaggcaagaaaggtttaggaggctttccatattgaagaggactgaggagacatggcaactaattgcaatacatgattctagactgcatgcaatactggaggaaaatcatgctataaagaattgactcaattgataaaatcagaatactagcagtagattacatcaaagtatcgtatcaatgttacatttactgaatctgactaccatactatagttaagtaagagaatattcctatttttaggaaatacagaagtgtttagaggtaaagggtcatgatatatacaacttaacaaaagacttagacaaatatggggtatttaaataaaggagaatgacgtgcaatctgagaacaagaagtccaacagagaaaagcaaaaatagggagtcagcgagcaaccagtgagatgggagcagaaggatggaagggtggaggagtgacatctaaacatattaagaactcaaatatgttgattattttgtatatctgaagtttgaaattatcactgacaatcttctaaacttcaggaaaaatgaggatactgtgctacaaatgtaaacttaagaacaatatttacatagtcatcataatgtaattatgaaatactgatttcaccaaaaccaatttgatttaacacatcgagagaacagtgggaatagagtcctgtaattggtgcacctgtcctaattcctatgtaggtattataatagaaagttaataggtaatgtttaaaattgataaatcaagataacaatatcagcatgttaggttaaaaacaaggtaattaccaaaagcaccagataaaagagccaaacattgctttctctattgaacgggactacagcatagagaagtgttaagcaagctgccattattcttttgctcttattataagcctcttaatactatttgattactagctcatgagctcctatttataaaaataaaagcaaattttcgaagtcagaacaattcatgctgctacaaaatccctaaagtcatttcaacaatacagcacactgatgattatatagacatttttcttgtctgagttctttgtctagaaactttttaaaagaaacgtggtcctgtattacatgtagcatgctttggaagaaaaactatctccaatcaaaaagtttttaaaagagcccagatgttatcgtcctttgtatctctaaaagcaattgcttttataaaattaggatctactcttttttgaaatttgaatgctgaagttttgtgggtttcagcaaaagataggcataacatacatctctacattttattaaatatgatggtgcagatgttaaaaatatgtttgaaatgcagtaccttctgttcttgctttcaactcctaccctagagtaaatgaaatgctaatcacctcttgtgttagtgatagaatttgtgagtttccacagataaaatatgtttactgtaatttccaaatagttgatagccagtagcaatatcttgacttcagcaactggtatgtaagggtctatattaaagtgtttatattatgactagtataacagatggtattatttgttacagcaggtcataacactaaaaaataaaactattacacatctacaatttgatcacaaattttagtggcagtgatcacttattttatgaaagagaggcagtaattgccgaagtactgcctaaaaatgtaagacaattctcattacagggtaaggtaaaattattgacttattaaccagaaattcacatctatcccgctacaggaaaaaaagtgtacatttaatatctactacagtcagttgagttttcaaagtaatctgtcatctctaccatgaatatggggaacaggagaataactgctggatttttggcatttgacacctaatatatagaactttaaaggaggttatctattatataaataatctttgaagaagagcaatttatgtttttggacaaccaaaaaattacttgtttagcttcacaggaattttaaagcatgttttcacttattattaaacagtaacattgaatatactgctcttttatcagttctcatttttttcaacattcagtagatgactttaaagaactctcaccttcctggttttctttctaaactgagattatttcttctctcacttatgcacctattttctaatggccatgtctcaaaaaatttttattctagcgtcttttttccttttatcttggttttgctgtagtgctagatagatggttacttgtgagactttcaaatctatataccaggctccaacttctctccctctccctctctttttgagtaagggtttggctccatcacccaggctggaaggtcatggctgattgcagctttggactcctgggctcaagggatcctcccacctcagcttcctgattagctgggactccaggtgtacagcatcatgactagcaattccattgtttttagaaatggggtcttgctctgtcgaccaggctggtctagaactcccagcctcaagcaatcctcctgcctcagcctcctaacgtgctaagattacaggcgtgagccaccacacctggccaacttctaagtttcagtgctgtagttttaaattgtttctcatacttatctaatattttttcccaccatgtcaaacccttaaaaactcagtatggacaaaataaatattaacttttttgagattgataattgtatgatagtgcttattacctcaaaagaattactggggcagcagtataatccagtagatgggggaaatagtggatattaagaccgaaatgggatcataactttttagttgtatttgcccacattaattgttttaaagggggtaaaggcctggaatatgaaaacaggaggatataaaatatatggaggttgtgaaagatgactcagaacttgaaacaattgtttcactgcagtaaatacatgttgaatgcatagaacagagaaaaacagaagaaaagaagaaggaaaaacaaactccatgatttaaaatattgatgaatgtgacaataattgtatctttaaaataactgagaaatggtagaaataaaaattataagcttcaactgtatattacttattcttgacaaagatgatagttgcaagctgaagccaaaatttctaactaggactaatgcaaagatttcaagagaaactttaataaagaattattgatgcaagcgctttcagaaagcaaaggtagggactaaccattagctcttgtttagaaagataaaggtcacaaataaaatttgtgttttaatctatacattttcagcattatgtcatcataaatttgcatgttgtttattacaaatgggaaaaggtttcctgtaatatatcaagatgagttttaatagtttcaaggaccattgatttgtaaacttaagactattatagtgttgtggaaaattaaatataattggtgttttaggaaaagttgttcattgaagtttccattttatgtgccttaacagattaattttgcttattaattctgtgatatttaagcactgctgtaagcttcacagatttggcaatagccactatatacttaatgagtacaaactatggagtatttccatattaaggtagaagaaatatttaaaagcacttctacttgtgatgtcattgggggtgcaacacaatataaagtacgcacattgctggaggagaagcataaaataaagaactcacggggcagaaacttaagacacacctaaatcaaatctttgttttcagcattatctttcattactattctttgttacaaaaaaacattgctatctgtccttttctatatgttctctacattaaaacttattatttgtatacatactgttccctacatctgcagtgccattcccagctcacatatctgccctcttaaatttatatcaaattcaactcccttcaaaaagccttctcagttgctttaacccaagccagtagtctgtcttctagaaaacagttgatgccgatgcctccttttcctttagcaactgaaaataatattatagttatttaatgtgtgtgtgtgtgtgtgtgtgtgcataacatcatactatttagtagtatctatatctatcaagtatctgctacagtggatgatagatgacttaaagacagaaatatgttattcatatctacttctcacaggtctagtgctgttgcaggatattttttaaggaatcagagagactgatggggttcaggaggatatttattatttaggtgcaccagcccagtcggattaacatccaaaggactgagccctgaacaaagagttaagttaccttttaagcattttgtagggtgggaggagatctgtgcagggggaagcatgttagagaagtgagaaacaaagacagttattcaattaattgagaaatgcgttacatcatttcttacttttcaaggaaaaacatgttttgcgacttttgtttatgtgtctagtgactttgcagctgcccagctagggaatcagggtcttcacaatgcctgggaatggaggggagagaaagctcattagccacagaaaaataggccgttagttttttaaaggactctagctctttctctttctcagggggaattggattttcttacatacaactgaggttctgcttacacattctttaatttcttttaattcctgttccagtgcagtgcaatgttcatagtagatgcttaatattttttgaattattgtatctttagtcattgcgagccatcattttgagagtcagtctcattcttttagccctagattatttttattttcttgagatacgtgaataaagggcacaggaaaaaaacacagttgagagttttggataatagtaacctaattcacccagattttacttcatattggttggaactctaagttgggtgcaactaacatgagacttgttttgatttattgtaaacatattcttgaatgactaatgaacagtgcttcatgtgaacaaattttcaccttctgataatttccaatattacactttgaaaaacattcccattgtagtgctctagaaaatataatttcaattgttaaaattcaatattactgtaattgaggatattaaataacttgttgttacatgatgctagctgcagcttaaatttcagatcatgagtgttgttaatattatatagttggaattagttctgagatcaatgaatcaatgctgtcttactgttttgtctttaatttttataccacatttattttgtgagtggatttcataaaaggaagttgctttatgttgccaagctcattatcttgggtttttgtccagagctgaattccctttttcatcaaaggacagagagagcccattataaactattgagtaatgctgatttgatgggtaggccacttacctttaagtggaaaggaggccaggcgcggtggctcacgcctgtaatcccagcactttgggatgctgaggagggcggatcatgaggtcaggagatcgagaccagtctggccaacttggagaaaccctgtctctactaaaaatacaaaaattagccgggcgtggtggcgggtgcctgtagtcccagctactcgggaggccgaggcaggagaatggcgtgaacctgggaggcggagcttgcaatgagtcaagatcacaccgctgaactccagcctgggtgacagagcgagactccttctcaaaaaaaaattacacaaaaatgttagactaataaatattaataaacactaaaggaagaaatttagtggaacatttatcagaggcaacagaccaggaagttatagttaccctgtgaaaaggcatcatctaggattcatagaaaacatttgcaaattggcaacaaccaccaccacaacaaactaaaacaaatgaaagaaatagacatttatacagggaaaatataaatagataataagtgtaataaattttgtgactttccacttgaaaacaaagaaatggaaataaaacctatgtaaagaagtggtggagtgagccgagctggggtgggaggggtgggggcatcccaggcagagggaacagcagatgcaaaggtctggaggctggagcaggctgtgaggggtgagagcagcaagtacatgaagtctagaccacaaatcgatgcttcaccctcaaaaatagcctctcactggccaccactcaggcccagatacatgtgtaaggtgggcagccttcaggaaaagtgaccgcaaaagtgcaccacattgggaattctgaggtgtttgagaaagttatggatgaagggtgaggtagactctagtggggaatgtcctcttgccacttggacttctctgtctatttcatgggctattatcaacttctaaagagccagtggtttgggtgcacatttaggtgtaagtacctcttgcctcaagccttaactctctttccaatgagtcaagtgagctgttgtgtttaagtaacttctctttattgtgaaatctttcctatcactttaagaaccttcttcttcagacccaagtaatcccaaggcacctataatgtccctcctggagaagacaaaagggtgtcttctatttctgtgtggcccgatatttcagggcccctaaccaggttagttcaaggtgctcagcataaccatgaatctgctacccatgtttctcaggtgggtcataggccctggagggattgtggctgtggaccaagcagggggtgctgtgggctgttctgagaaggagggttttggagtgtccaagctgagaacatagaggccccagatgttgtatgagtaaattttcatctgacagaattatattttcctaactgaaaacatgaaacagagatgtaacaactgtgcctctttggctctgtctttgcatgctgtcatcagccactgaacaggagctgagagggaagacataaagaacagaaaacccatgagggggatggtccatgtgggtgtggaagtgagggtgagtggggatttggccaaagaggcctaatccacaggagtagagtctcatgtgtgactttcagaatgagcaggagtgagataggtggagggggagtgttggaacatctcatcagaggtgagaatccatagaaggagacactggtcattacagtcagtgagaaaagtgactttagcctgagcctaaggtcattggatcaaggaaggggccaggaggagctccttgaagggaagctgtgagcttgagaggcaggctgaggcagatcagtagaatgagcccccgagaagggctcacagagtcactgaaggactgtgaggtggcagggacaagctcacatggcctttggtcagtgagtctccagctgtaatgagaatgaaatggggaagatctgggacaggaagacaagctgggggcgctggtaccatcatggggagatgatggtgggtggctctaggttagttagagttggaatgaagagcagaaagcagcttcgtgatacctttatgtcataaaatacatttggcatggagaggacttggactttgtgcatgaaggatatggatgtttctaggctgactcccaaatgtttctaggctgactcccagaaactaggatgtttctaggctgttcctggctgagaatttggatggtaactatagtccaaagaaacaaagaacactgaaatcatatcttattttttttaactcacaaaatagaggcaggtagatatttatatgtgttttgttggctcaatgattttttttagtaataaacatatttacttagaaactactgggtgtctgtatgctctgggatttttttctcctgtcctgatgacatctctttcctttctctgggttcaggagttacttcccaggttgtggtgacacaggaacattcactttccacaactcctggaggggcagtcaccttcacctatggctccaaaattggggctgtcatcagagcatctcgacagctgggcccaacagaacatctggcaatgtccccagggcaatggtgggcacaagcagtcaggtcctgggacccctgcacaatcccctggttctcttcatgaagaaaaagccactctggttataatgaggactagaccaagaatgaggcccagtgttacatgctcggtgtggtgatctgaaatatcaccacagggacaaatacaaaaatacaagtgggaaactacactcaaacccttggatcaagcctcagtcctatgcttctgaagcaaatttcttgtttttggagtctggttttcaaccactgtagactcagatcatttattcttcaggcccccaatgggatcatcacaagcactttttctatcaatcatggcagtcacttgagatcaaaggtgaatttcttcttcctcaagttataagcaacactttggcatatttggtgaacttcaaagaaaatggctaagatagaggatgagagacataagaggcttcaggaatatttcagcagatgcaaagcagactacagggtaactcatttcccatatgatttgattgattgcaaaatgtgaaattaaatgcatacaaaggggaatgtgtgtcatttttcctcttaatgacaaagtaaaaaaaaagcaataaaacaaaaacaagcactatttcatgtgtcttgataaacttgtagaaagtcttataatatccacaatatctaggatacagtaaaataactttccatatgaagaaccagaagaacacaacttaaatgagaaaagacaattgatagacaccaatactgaaataatttaggtgctgatgttatgtaactgagattaattaaggagtaattatacaattccttcagtgagcaattttagacattattttttgaagttttaggttcaggggttcatgtgcaggtatgttacgtaggtaaacttgtgtcagaggggacattcttgaaacaagtggaaaagaagcaaatcccgaaaagaaaaataagtcatagaaacaaaccaaattaaaattagaaaacagaaaaatgcaataaattaaaaagaacagtctggagggactctggaacaggtaacagtgaaattaaagttcaggcattagaggaattatttaccgttaagtagggaagaaagtacaaacaatagccatctaagcccagcagagggagctgtggatcttctcagaggtgagcaaggccggaaatgaactcccggggctctcatttatggctcctgggtccatactcactggcccgaattggggtttagagcaggtgctttctcccaaagggcaaactcagagttcccagcagcccatcctccctgacagagcggctgctgcctggctgagcactcagaacttagggagccggtggttttggtagaggccccatgtttgcataatgtcctaaccaaacacacatctacccggggaggtgacgaggagttagaggaactgtcccagggtccagaagtagccgggggttctggggatccttggaaagtccacaccatagcttggatgtctatcctcccctctctccctcctcactgcccaggttcatgtagatttcaaagacaggactttggagggatctgtctgctgtgattcctcacacataacatgtatctgttttagtttcttggttcagttctcaggctgtggtgactcaggagccctcactgactgtgtcctaaagagagagacttattctcatgtgtggcttcagcaccacagcactgaattcagcagaagcctggtcaagtcctcaggacattgatgtgtaacacagataacaaacacccctggatgcccacttgattctctggctccctcctgggggaaagctgccctgacccctcaaggggcccagcctgaggatgaggctgagtatactgtgggctacaccacagtggtccttagcacagtgagagacccagatggggaagcaggacatgaacgagcttttggctgatccggggtacaaacatgaacgtaggatatcaggatcacgtggccagacacctgagctctcaaggacacctaaattttaactatccgtagagagaaaggtgggtggagaggtgtaaattgattcctgtatctgtttgaattttaaagtggaaaatatttgtgaatcatttgggagatgcagattcccaaaaagaagaatttatgtttatattccaaacagaacagtaatagtgagatcaactctaaagactaaggtcaaacacacttcatccagaaagatggatctcaaaagattttgttgttgttttgcctattaaaagctaagagaggaaattatattaataaagtttatttcatgttctatgttaatagtgtgtatttcatagctttttaagcattaaaaattataaaagtgttaagagggattctcttctctaatgttatataagaaagtatccacctaggaaaatattttgaaggtctaacccccagtacttctaaatgtgaccttatttttaaaatagtgttattgcttatgtaattcttaggatgaagccatcctagagcgaggtggcctcttgatccaatgtgcctggtgtccttataagatgatggtagtaaggagattggaagacacagagagaatgccgtgtgacgacgaaggcagagattgaatttacacagctgcaagataaggagcactaaagattgctggcaaaccaccagcagccagaaagagggaaggaaggatctcccctcaggtatatatggaaacattgccctttctatgaattttgggaggctagcctccagaactgtgagacaatacatttgtgttatcttaaccaaacttgtgtttaatacattctgacagcagttctaggaaaccaatacaccagacaataaattacacaatacttctgaaattgattgtacttctttcattttggcaaccagtttttccatgaatatgattatatctgtgctcatatttctaactttataaatatgcttgtaatttaaggttaagataagaaatccttgtgtcttaaaaatccctaaatatatgagaactgaataataatattaacattatgagatctaatggaaaattgtagcttttacataattccacttgttcactagtatcaagatgtgaaggtgggaagatcaccttgttattaacaaaacactcctggtcatctctgtggatttgagagtgcagggggagacacctacatattgtttgggaagtcacaaatgcagcatgcccagagcatcatgtacaacagtgtgagtttgctggacatgtgggcaggaagcagaacagactggggcatgaggaaccacctatcaccaaacccaccagcgccttcctccctggatcagcccagagctgctcagacttgaatgtgcacatggatcatgtgggatcctggataatgtggattctgatcagtgggtctggactgtggactgaaattctgcgtttctagaaggccccttcttccaaagatccacatacatgttttaatattaccatattcataagaatggtgggaaataagggaagccactttcagacagaaaccaaatagaaatttatctgagagggagctaaaggattatgatcaaagagaaatccccaattccaggcagggagctgatcacagagggcagatgggaagttgggagaggttctatttttttttttttaagaaatagaaatgaatgcaaacacaactcaaacctcctcttgatccaacatccctgctggctcctgcccaatttctgcactggcttcttctccagtcttttcccaagcatggaccctcctcaccctctctgcttccccatctcaaactcacaacttcccttctcagttctcctgtttctctccctttcattccacttccttcttctctgtgacctccttagacaatcaccaaaatatttctagaagaaaagccatgggtatttttcatcttttcttgaaagttgtcactcacattccctcttcgttcttcagcctctcttaccccttactacaaaagatgcctgaggccactgtttctcttttccatcccctcaaatagcttctccttccaacccgtttctctcctcagttactagagcattcagtgaagcactcagtcaggttaaaggatcctcccaaatgctcaccctgctctctatgtgtgatctcctgaagaatcaagtagggagagaaacatggcttcatgagtttgtggggaagtgggtgcatggctgaactgtccttgttctcagcaaatgtactttatttcatgcacagtttgtatatgagacaaccttctcctgcggactccttataaaatgggaagaattatgtgttgtgttttcacagaggaagcccaaatattccatgctcatgggtaggaagaatcaatatcatgaaaatggccatactgcccaaggtaatttatagattcaatgccatccccatcaagctaccaatgactttcttcacagaattggaaaaaactattttaaagttcatatggaaccaaaaaagagcccgcatcgccaagtcaatcctaagccaaaagaacaaagctggaggcatcacactacctgacttcaaactatactacaaggctacagtaaccaaaacagtatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctaagaagaaaacctaggcattaccattcaggacataggcatgggcaaggacttcacgtctaaaacaccaaaagcaatggcaacaaaagccaaaattgacaaatgggatctgattaaactaaagagcttctgcacagcaaaagaaactaccatcagagtgaacaggcaacctacaaaatgggagaaaattttcacaacctactcatctgacaaaggggctaatatccagaatctacaatgaactcaaacaaatttacaagaaaaaaacaaaaaaccccatcaaaaagtgggcgaaggacatgaacagacacttctcagaagaaggcatttatgcagccaaaaaacatacgaaaaaatgctcaccatcactggccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaaccattgtggaagtcagtgtggcgattcttcagggagctagaactagaaataccatttgacccagccattccattactgggtatatacccaaaggactataaatcatgctgctataaagacacatgcacacgtatgtttattgtggcactattcacaatagcaaagacttggaaccaacccaaatgtccaacaatgatagactggattaagaaaacgtggcacatatacaccatggaatactatgcagccataaaaaaggatgagttcatgtcctttgtagggacatggatgaaattggaaattatcattctcagtaaactattgcaagaacaaaaaaccaaacaccgcatattctcactcataggtgggaattgaacaatgagaaaacatggacacaggaaggggaacatcacactctggggactgttgtgtggtggggggaggggggagggatagcattgggagatatacctaatgctagatgatgagttagcgggtgcagcacactagcatggcacatgtatacatatgtaactaacctgcacattgtgcacatgtaccctaaaacttaaagtataataataattaaaaaaaaaaaaagagagttaaaggctgagatgaggtaggaggctgccctgaggaagggtctcatcctctggcatctggtcacagacacgatgggcctgggcctgggctgcagagagcacaatggggctgctggtgggggctctgtgcggctctcagctgggaaataaagtccatgaactttgttttgcctcacggctcactggggccagcagctgggtcctctctgggtgcttggggagcttcaggccaagctcagcccaggctgactcctcctagtagtgtcacccagccacagaggctgtacacaggcccagggagagttaggttaagcaggggaagaggagcacatttgcatgaagggcccctccctctcctttgaggctagagggtggataagagagacctgcagcgtggctgcctcagcagagctctggggagtctgcaccatggcctggaccccactcctcctcctcttccctctcctcctccactgcacaggtcaggaggaccctcagcatcctcatgccccagctcactgacaccatctcccaaactcataccagaaatgttgtttgctcttgtccttccttcaggccataatgagcgtctctgttttcagggtctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactcacacagtgatacaggcagatgaggaagtgggacaaaatcctcaacctgctgaggctattgttcagtgacaatttttaattttaaaacattttctgtatgtaaaaaatctatctggatgcatcctctgatttagaacaattttactcacaatttcccatttaatgtttcagaagtctcagaagaaattaaaacataaacaagaacataagcctcctgatgacactgagatgtctgcttatccttatgggctgataccaaagtctgtgaagctcaccttttctcttgaaagaaaaaaagaatgagccttcccttgagcaaatcttgctcagagcccaaacttcaagcccacaaatggacagtcccctgcagcatgggctcttgttcttcaaggggtcaatgaggagacctccctttcccaccccaggtgtctgtagtcagggctgcctgatgttccctgcatcctgggactaggcactcaggtgtgtaataccccagaggacaggcctgggagtaattccaaacacagagctggcctgattcactttcaggttcctttattttaagttaaaatgtcaggatagaaagaagttgggtatggggttattcatgaaactgaggccagaagatgtctttgtgggctgtgagagggtgacatggtggctccaccattgctaggggaatgttgagtgagctcctaagaagtttggggaaatcggtcttgtgagtgtggcttcccttcagctcattccactcagaaacatgaggacacccatgggtggatttttctgaactcacaaacactgacttgtgtcctcttttttcttatcccattggagatattcagtaatctactctgtgagatggggtctacaggagatcatggagaagaaactcttcaacctgtgcaagtgaaacttccttgtgtgaagctcttgatgtgtccagattccaaggtcaccttctcctgcacaggggtcagcagaaacattgaatattaccatggaaactggcccaatggctccagagaaatcctgaatttgtgactgagaactgcagtaatcaaccttcagggatctcagcctgattctcctttttcaacttgactttccttgactgtgcagcccgagggtcaggatgactatcactgtcagagctgaatacaacccgatgctgccatgagctcccattccatggggaagtgacataaacatctgtcctccatttcccccatcaaatccgtcactgccctgtccctgcctgtgaccgacacctgctcaggttgtggattctgctgtcacttgtgattccagcaagtctgatgcttttaacttggtgcatcattattagggaagccactccctctaaatcctcagaagatgcccccaaggagttcccggatcccaaggtgcaggatcaacctcccagtaaggaaggctctctgggccccatcactgttcatctgttctactttaatcctaagaaccttgagccttcattatttcccctttctgcttatttggctggaacgttgctggaatgcatctcagttctttggggactagagggataaaaagcacagcccatagaaagctttcacctggttaagtagcatttcctaagagccacgagggcatctgctcactgctcactgctcatccttgcatcataatgggttcctggaccctgggctctcctggctcattgagtttaccaatccctccacactccactcattgctagggctggctagagggaaggatagtaattgtccaatagggagatagttttaggggggattacagaaactactccccataatctttgttgataacatcttcatcttgatgtttgctccccaggatctgattgtgacagtggaagtctgacacttgaagaaatgtaggtttacccttctgaaaggcctggccctggcttggcctagggctggaaggaagaggtgctgagctttgggcaaccaaggcacagctgtcaaggggctgagctctctgcaatgtgggcctcctgcagagacatccctagggaggctgagacctgacgatgatgcagaaaagcaaattgaagtgagcaggggatggtctgtgggggaatcagatgacaggtggggggccagatgtgatacagatggtgcaacatgaagaaaagtgtcttttgtgattgttctgaggagaagggctcagtgctagagcagtgataatgaggcaggagctgggtcctgaagccacaggggaaccaggtcttgggtctttttctgagggtccctagggaagatcacatgacaaccaagtcccatgttatatgtccagtgctcggtatcccagatgctgtccctcccagagcctctgggtgtcctcgtcccactcttccctgtgatctgttttcagctccaggagcaggttcatactctgtgccaagagtggggcttgcatggctgagtggagaacagatttgcaagaagatcccaccttgcagtctggctctgtgtcctgggtgtgggtggtaactgaggagatgtaggcatttgggctccactagagaccacagggagcagagctcacaggggctccccacaacccgggctcctcccttcatcctcctcccattgccttcctcactggggttcgggccaggggagaacccagggctgcttcaagggccctgctctgcaaccatggtctttatccaagtcattgtctccaaactctgtaagggctttctctgaaactgtaggagcattttttttccatatgcccaaggcaggcttacagggtgctgaccccaccccttaaaagtgctaatagtctctcaatgctcaagacaggagggagaattaggaatcaggagcctacccagagcttccctctttcctcactttcaaaattgcactgtgtctagacatagaatttatgcctgggttgggaaatatttatttacttattaatgtattcattcattaatctcactttctgcaatctgtgtaagtgaggggcagaagggaagaggggcacagagggagaggttgaacccaagggcaggtcctggcagtctgggcacaggctctgatcagccagggggaaggaagagggagcagctcctggtgccctggagggaggggatgccctgtccctgctgggcctcccacttcgttgtacccagggaatgcttttcagagaggcagagctcttagcagagtcccgtaaaccatacagtgagttgggcaggtgagtccaggggtaggggctgtgtggagacctgagaccaggtgtggcctggcatggacactgcccagctccattcttttagggaggacaaagtggacagaggaagagacaggagacatgggtgtgtctgagctttgggcagcaggggatgctgtggcctagccctgagggctgtgctgtggatcccagctgggagccaccccctggtcctggcctggagccctctgtcccctgctcactgggactagcagctgtgtcctcacaggtccctgagtacccacagaatagccacacccaggtccacactctcccggggttagctttccaggcagaggtcaagagtcagaacccaaggtggggtttagacagcccaggagaggaggctggtttgcaagtccctcctaacccccttcgccctgaactgctggaaggataggagagacttgaagaatccaggcccacctgagggtcctcaggacacagctgtgtggcgggtccccaccatggcctgggctcgtggcctctttccttttctccttcactgctcagctggctggggccaggcgtcagggctgaggatgaagggaccaggattgctgtgtgtgtccctgtccactaacctgtgtctcttactctttgtctgtcatgatattcagggtcctgggcctgttctgtgctgactcagccaactgcagtgtccaggtctgtgggacagatgaccccagcacctgcactgggagcagcaccaatgatgggagtatgcacgtgttttggtaccagcagtctccaggctgtggtgcctcagaaaccctcctagtcaacaacaccctgcccagcaggagcgggccatgctctgattgcccatctggggtagtgtcagtggggctcagtgagcagctgagctttcaccccaatatcctcaaccaggcgagcatggcagggctagtttgagctggtttatcctcccatccacctatgcctgattttggcagggcccagtcaggaactgaatttcagcccccatccccagcaatgagttgaatgaaatggtacaaggcagagcacaccagccctcagtattccctccctgaacccagactctggtggttatgggggccagggaggaccagagctttgtctcccacctggcaatgagaatactggttggggatggaagtcagtgtcgttggcacacctgctgtccccctccctgccctggtgtcagtgagtcctctttttctcatgaaagtgtcagcagcactggagtactgagagccagcgttctgcctttgctttggcagtgggaagctgaacctacaaacctgtgtccttcaacaactcaacaagaagatcacctgataaaagggagattagtggtgcctagaggctcaaaatacagtatttaaggtgtctagcattcagttcatgaaatcattgtcacatcaagaattaggacattcagaacccaaatgaaagaagacagtgacacgcatggacactgaagcaaactcagatgctaaaatcatatgacggatttttaaagcaacaaccacaaaatcccttcaatgaataattaaaaacactcttgaaacaaatggaaaagaagaaaatctcagaaaagagaagttataaaatcaaaccaactggaaattaaagaacctaataaactagagcacatttaaaaagaaagttaaggcaggactcaagaactggttacatttgagattcagtcactgggtgaggtgttccacacgacataaaaatacagtaaaaataagtaggtaaacacatgaaaatcaatgattctggtttgacttgggaaacattaaagtggaaaatataaagaataaaatagcatttatttattgaaagaaagaactacctttagctttttatcgtttccccattaatactctcttgaagatgttcccaggggacactgtgagtcttctcagaggtgagaaaagcctgaaataaactcccacgaatctcatttaatgggtcctggggcccatgctcactggtctgagttagaggtgatagcaggtgcttcctctcaagtggtgaaattagacctcacagcagcccagcccccctgacagtagagctgctctctcagctgaaaacaacagaagcagatggtgttggtgatggttttggtaaagtgcttattaatgtgtgaaccaaatatatgcccttcatctagggagctgcataggagataaaagaaccatctcagggtccagcagcatcttagagctctgcagatttttggaaagtttacatcatgccctggatgcttctcctccacttccccatcctgttcagtctttgcccaggttcatggagatttcaaagaccagcccatggagagagccctctgttcttccccattcctgtcgtgtctgtttcggtttcagtatccagttcttagggtgtggtgactgaggagccctcactgactctttcctgaggagggacagtcactctcacctgtggctccagcaccagagtggtcaccaacaatttctatccacactggatgcaacagaagtctggccaactttttgagacattgatttatgatgcaagcaacaaacattcctgaatgaccacctgattctcagaccttcctgggagcaaagctgccctgagcctctgggggacccaatccataggctagactgagtactactcaagctacacgacagtgggggttactgcagtgaaagatccagatggggagccaagacgtaaccctgcctctgacagcctggggagaaaatgatcacgtgatatcaggatcacatgaccagaaacctgagctctcaaggcggtctaaatgttgcctatccttaaagaaaaaggtaaacagaagggtctacatcaatatttattcctgtttgtgtccaaaagttgaggaaatccatcaatgaggaggaactgttccagaaaagcggattcctaatattttgtaatccaaaaggaatagtattgcctacatcagatccaaggaataaatttaaatatatttttttgcaggaggaataatcttcaacgatgtactttgccagctaagaacgaaaggaagaaacgttctttggtatattaataacattttttattaggttgtaattaaggtgtattgcacaatttaaaacatattaaaatgattttttgtaagaaattcttttttctatatgttatgtgttgtattggactctaaagaatatatgttaaagccctacaccccagtattcaagcacataaaatcatttgaaaatcggatcattgaagatataatagttaagatgaggtcattctggagtagggaggtctctttatcagtgttcctgggtccttgtaggaagtcaaccatgagaagacagagaggcacagggagaaagtcatgttaatatggaggcatggagtgaagttactcagctacaatacaaggaacaccaaagattactagcaaagaggaagagctgccaggaagaatcccaggaaggttttctctacaggtgtcagagggaacatggccccgccctatggatttggatttctagcttccagaactgtgaaacaataaatgcctttcattttaaatcacatgtgtagggttatttttatggcagctcaaggaaattattacaccaaacagtcattgtaactatttctgagtttgcatgcattctctcatcttgtttctcagttttttcaacaaatgtgaccatgtctgtcttcgtatttcttccttgtataactggcattgaaggttgacgtaagttattctcgctgtcacaaaaattatataaacatgtaaataaggcttaattttattttgttcgtaggtacaaatgcaaaactaattccaattgttttgtaagaaatttttgtaaatatttttctcatgtaaattagaagggtctcttgagttactgaaacacttctggccatttctgtgatcttgtggtgtcaggatgagatggctaccatgttcaatgaaagcttcaaatacattattattttttctaggtttttaaaatttaatacagtctaattaaatagtaacagcagtaactaaatgcactgaaaaacagacaggtgcctgcctatatctggaataaaattacatcaaactagtctccatggtaaaaaaaaaaaaaaaaaaagacaactgctgatatccatggttagacaagtcaaggacaacttggaatttctaaagccatttttctaaaaatcaacagcaacagggacacaactacttcaaggggtaaaatatctatatctacattgttttttattaacgaagattgagttgcacctaaacagcatggcattcttatctttagccttaaaggaaaagtgaaagtattttccatttgcaccagtttgaaatatttctgaaataaggattacttcaaatgaattattacattacttatacacataagagggtctcacatatagtgaaaaggcaaacccaggattttaacgtcaaccttttaaagttgatttgattgcataaaatgagagagaaattctcacacgcataatctgtttaacaaaactcctcggtgaatcaggatgcaaaatataaaatgttctaagggagactctgatgagcaggcatataaaattgaagtgaaacccatgtcagcttcgttcctcccacttctttggtgcttctatgaggagctctttctctactgcaagagcctggacttttgacctaatggagaagaacctcaggaaggcaaggcattctgataaaatgccccttgagaccttttattttttaatttaaagggatcaactggtcttgttcagccttaggaaagaaagcatcactcagataaaagtatttggggaaactttaaatacctggctacctcttgatatatttaaattagattgacttcagctgttcttagaaagcattctgcatagttatccagagcagccactgaagttctggttctccttacatggctgcattcagaggtactccacatgaggcatgtttagaaaaagaaggacccttatacttgggagtttttgttcttccacgtaacctgttagtactgttggtaaaggcagtccccagatggcaccagtgcattttgtcaatggtgagtctagacagtgttgcaggggtgttgctgatgagtagaacagtgagcagataaaggtgagcagtgttgatctaaaggctttggggtccatctgcttatccttgcacacctgaacaaagtcatcagatgtgccacaccatcaaactgttgaagcttggacttgatacatgatagagttccatgccaattgcccatcttcatattcaacttgcagattagttggtccagctgatattttaacagatactgttagtagatcatctgaatgtgaactatctctaaccaagaaatttccttctggtgtctcttttaacttttctttggcttcattaacaatcatccttccccagtgccatcctgtttgagctcctacggggacttcaccagatgcaccacctccagggaaggttcctgtgctgaccctgctcctcactggctctgcatctattccctgccattcccagagggctggagacaccacagggtcatggaagtaaggtcactgaggcaaagacagatggccacccaaactgggtgagaaaggagctttcatttttcctggaagtcagtgggaacccccccaatcaaccctatgggtttctgaaatggtggaagatggggaaggaatgaaaagctgcctgtttttctcaacaggtccaggttgagggatgacaaagttccttgcagatgcatcacccacagatcaccagcaggaggatcctgaggctgcggtcagtgccctggcacaggacacatgggccatgtcccatgcagcaccggtggctccgagtgagagggcttatgctgcaggggaagccaaagattcctgagccacagcggtaagacatgagatgacttaaatatctgtccctcaagtatattattcttaatatttaatgcacaaaatagtgaaagaagagattagcttgcagtgcaaattgaacagattcagtatagcttgaggcatgagaaacaacagctctattaccatttaccaaaaatacaccctgaatggacagggggtgcccgtgagctggagatagggtgccccaattgaggaaatataaatactggttatcagttaaatttgaattcatgtaaacaaccatttaatagatttttatttttagtataattatgtcctatgcaaagttacttatctttaattctaatgtaactggatgtcttgcatcttgtgagataccattcccagcattcccagctgggctctgacatctgagtctatgctatttacctcaaaaacagagttcctgtaacaaagttatccccaagtaagtacttcggttagaaataaatatgtctgggctgggcacagtggctcatgcctgtaatcccagcactttggtaggccaaggcaggcagattacttgaggtcaggagttcaaaaccagcctggccaacatgatgaaaccctgtctctaccaaaaatacaaaaggtagccgggcgtgggggcacctctgcagtcccagctactggagaggctggggtgggagattcacttgaaccgggaggtggagcttgcagtgagccaagattgcaccactgcacttcagcctgggtgacagggcaagtctctgtctcaataaataaataaataaataaatacataaataatttataaataagtgtgtcatcccatccacctcaaggctgtaaaacctagcatgccttatccctcctcactttcttttttttttttttaattatactttaagttctagggtacatatgcacaacatgcaggtttgttacatatgtatacatgtgccatgttggtgtgctgcacccattaactcatcatttatattaggtgtatctcctaatgctatccctcccccctacccccatcccatgacaggccccagtgtgtgatgttccccttcctgtttccaagtgttctcattgttcaattcccacctatgagtgagaatatgcggtgtttggttttttgtccttgcgatagtttgctcagaatgatggtttccagcttcatccatgtccctgcaaaggacatgaactcatccttttttatggctgcatagtattccgtggtatatatgtgccacattttcttaatccagtctatcattgatggacatttgggttggttccaagtctttgctattgtgaatagtgccgcaataaacacaggtgtgcatgtgtctttatagcagcatgatttataatcctttgggtatatatccaataatgggatggctgggtcaaatggtatttctagttctagatccctgaggaatagccacattgtcttccacaatgcttgaactagtctacagtcccaccaacagtgtaaaactgttcccgtttctccacatcctctccagcacctgttgtttcctgactttttaatgattgccattctaactggtgtgagatggtatctcattgtggttttgatttgcatttctctgacagccagtgatgatgagcattttttcacgtgtctgttggctgcacaaatgtcttcttttgagaagtgtctgttcatatccttcacccactttttgatggggttgtttttttcttgtaaatttgtttgagttctttgtagcttctggatattagccctttgtcagatgagtagattgcaaaaattttctcccattctgtaagttaactgttgtacttagttgtactgggtttgatcgtagtttcttttgctgtgcagaagctctttagtttaattagatcccatttgtcaattttggcttttgttgccattgcttttggtgttttagacatgaagtccttgcccatacctatgtcctgaatggtattgcctaggttttcttctagagtttttatggttttaggtctaacatttaagtctttaatccatcttgaattgatttttgtataaggtgtaaggaagggatccagtttcagctttgtacatatggctagccagttttcccagcaccatttattaaatagggaatcctttccccatttcttgtttttgtcaggtttatcaaagatcagatggttgtagatgtgcggtggtatttctgagggctctgttctgttccattggtctatatctctgttttggtattagtactatgctgttttggttactgtagccttgtagtgtagtttgaagtcaggtagcatgatgcctccagctttgttcttttggcttaggattgtcttggcaatgcgggctcttttttggttccatctgaactttaaagtagttttttccaattctgtgaagaaagccattggtagcttgattgggatggcattgaatctataaattaccttggggagtatggccattttcacgatattggttcttcctatccatgagcatggaatgttcttccatttgtttgtgtcctcttttattttgttgagcagtggcttgtagttctccttgaagaggtccttcacatcccttgtaagttggattcctaggtattttattctctttgaagcaattgtgaatgggagttcactcatgatttggctctctgtttgtctgttattggtgtatgagaatgcttgtgatttttgcacattgattttgtatcctgagactttgctgaagttgcttatcaccttgagattttaggctgagaggatggggttttttattttattttattttattttattttattattattatactttaagttttagggtacatgtgcacaatgtgcaggttagttacatatgtatacatgtgacatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatattttactgagaatgatgatttccaatttcatccgtgtccctacaaaggacgtgaactcatcattttttatggctgcatagtattccatggtgtatatgtgccacgttttcttaatgcagtctatcattgttggacatttgggttggtttcaagtctttgatattgtgaatagtgccacaataaacataggtgtgcatgtgtctttatagaagcatgatttatagtcctttgggtatatacccagtaatgggatggctgggtcaaatggtatttctagttctagatccctgaggaatcaccacactgacttccacaatggttgaactagtttacagtcgagacgatggggttttctagatatacaatcatgtcatctgcaaagagggacaatttgacttcctcttttcctaattgaatactctttatttctttctcctgcctgattgccctggccagaacttcgaacactttgttgagtaggagtggtgagagagggcatccctgtcttgtgccagttttgaaagggaatgcttccagtttttgcccattcagtatgatattggctgtgggtttgtcataaatagctcttattattttgagatacatcccatcaatacctaatttattgagagtttttagcatgaagggctgttgaattttgtcaaaggccttttctgcgtctattgagataaccatgtggtttttgtttttagttctgtttatatgctggattatgtttattgatttgcgtatgttgaaccagtcttgcatcccagagatgaagcccacttgatcatggtggataagtttttgatgccctcctcactttcaaacagtacaacagttaacatttcctaaccattggagatattaaagcacagatcttttatatgagattagttaaaatttttatctttaatgcacaagagtttgggaacattaggaatttgtacatatgctaaattatatgtaaatgaaatgatacgatgtttggaatatgttttaaaattagttgagtgtgtggagtgaggggtaaagagggatgtaagatgaataagacaattttatgttgatgatgatttagttgggatgctgggtccaggacatgcaatgggcttttctccatagatgtctgcaacttcaaaaacatccacagtgacaaatgtgtaaaaaaaattctgtgaactcttctgtggtggtgtgtgtattgaggtggataagggaccccctattaagggcctgacttctccccctgaagcacggaaataaaggagaatcttgagtttcttcaagggaaatttcaggtacctcactgtccctgagaagaaaacctgactagcaaaaaggttaaaggagcttaaaacaaccaaggaagttagaggcatgggatgtctgggtccctatagaaactaaaaacaacaacttaacatatgcccctgagttgtttttcaaacactcagaccacctccaaaagtctcggctgtcagtaggcctcagataatgggaaactgaggactgaggtctgactgcccttctttgttctaagtctcttactgaggggccctgaggaaatcacgcccatgagccagagctaacatttctttctgttgaccccaattttttggacaaagctttacgaccttaaccagttgcaaatcaggaaatttctaaatctacttacctttgatctgaaagcccctgcttcaaaatactctactgttttaggccaaatcagtgtataacctctatatattgatttacagttttgactatgacttctgttttctgaagatttcccctgcttttaaacacctttgctttcaggccatcagggagtttgggtcttaagcatgagctgcccgattctccttgcttgatgcctgtgataaatgtctcattctcttgctgcaatcctgatgtcagtgcttagatttgtatacctggtcaatggattcaagtttggtccattaatagtgtgtcttgcttttaacagacactcagagttgccagatggtgtgcctccaccctgacctccagttgaagctcatctcctccccgcacacagaggaggacttggtgagaaggccacagaatggaaaggagctcagggtttcccaggaaagagaagtgagtgatactggaggccccagagcaagaggaagggctgtgaggtaggcaggggccataaagtgaagggcatgctggtggggctgcaaggtccagggtttatgtaaacagcaatgaagaaccacaaaaggagtttaagcccaggagtaagatgaacaggctgaatgagaaggatgtctccagctgcctcgaggagaaaggcctgagggcaccaggggatcctggtcatagattattcactaagagaacctgtgagtctagaagtttgaagactatttgcacagttaaagcagatttgcatctgggatacagtgaagaagtgataatttctgcattaatctgtccagtcattcaacgtttctgcagaaacattaaaaggtcacacttatctttcttagtaagccatgaaaaaaatgtaagtagggaaaattaggtttagaatataaacaaattgtattctatctaaaacaaaattctattgagaagtagatgaaacagataagcagaaaaataaaaaggtaggaagacaaaactcacttcataaaataagaaatgtgttacaccatgaactggtaaatgttatgcctacccaactattattttttcacaaataaaatctagtgagtatcaacatgctaaaatcatggtgtgacttaggaaatgttttctgggccaggtgcggtggctcacgcctgtaatcccagcactttgggaggctgagatgcgcggatcacgaggtcaggagatcgagaccatcctggctaacatgatgaaaccccgtctctactaaaaatacaaaaaaaaaaaaaaaaaaattagccaggcgtggtggcaggtgcctgtagtcccagctactcaggaggctgaggcaggagaatggcatgaacctgggaggcggagcttgcagtgagctgagatcgcaccattgcactctagcttgggcgactgagtgagactccgtctcaaaaaaaaaaaaaaaggaaatgttttctgaattgctggatgttaaatctatcactgaggtgattcctgaaacagtccccttctatgtcattgccttgaacaaccccttcatgccactcaagtcagcacaactgtttcagcatctgtggtggtgccatagtgacgtatgcaggtcacttagctttttctagaatgtactcttggggcactggcaccttaaaaggttataaaatttttaaacagttataaacgaacatatttgctcctctcatagatcaagactacttataggagtgagatactggctaggcatctagtagaccacgtcatcatcacaggatataggattcaggacacagatgtgtatacagaggaatagtgtcctggtgagctgcagagatcagctgggctctctggtctctgagccatggggaggtgagtgtcctgctatcagcaggctgcactgtgggacttgcctgtggtgtctgcacagctgctctttaagaaccattcattccaaggagcctaggtctaggggctgggccttgtgctcattgatggggactcggcagctgtcttctctggtctggcagagtctgctgaacagggacctgtgtatggtctcagcaggtgatatctcctagggcccttccaaggagggaaagcaaatcatcttcctcagtctgcagtgtgagctgggctccagccccagggctcaggaagggactgggcagtccctgcatagaaacacatttgcatgagcagcccctcctctgctgggggttgggaagaaaaggaggcctggggcagctcaggctcactgtggtggtcaggggctgtgtccaccatggccagaacttctctcctcctcctgatcctctttcactgctggcctgaacttctcttctccttatgctcctctctcactgcacaggtaaggacaggcctcggagatcaggactcagttttcagcctgcatcagtccctcaggctcaggaacccatgacaaatttcatcctcatcttaaccctgtctcttatttgtgtctgtgtttacaaattccctctcccagcttgtgctgactcagctgtgtcctcccccctacttcctgtatctctgggagcatcttccagactcacctgcaccctgagcagtggctgcagtgttgacatttatctcatatcccgctgtcagcaaaagccagtgagcccttcccagtatctcctgatctacctctcaaaagtcaagtaaaactagggctctggagtctccagctgcttctctaaatccaaagatgccttggccagtgcaggcaatttgctcatctctggggtccagccagaggacaagactatctgttctatctattactgtcagacctgggatattgatacttcagttacacaggcagatgagaaagtgagacgaaactcagcctactaagaatggaactatggctctttttccaattgtcaaataattttcacatacacaaactattttggaagtagctactgattcacaatggttctctcaatgtcccattcaatgtttctgagtcctcaggcaaactaacaacaaaacaatgataaaacatatgacaaaacatatgataacactgactctttccctgctgaaccacatgtaataaaaccagaggagctggtttaataaaacctgaggagctgacttttcttttaaaagaaaagatgacagtcttttggagtctttttcttggtcaaaatttcctagaccatcccagcaggtggacagtcccctacagaagacacgatcctgggaggaatcccaggtacagagctggcctgcttcacttgtgggtacctgccccttcaattgtgaaatcagggaggggagagtaagcatagggggtaggtgaggatcaggaaaggggcaaggccactacatttcattaaccacctttggactccagtgcaagatagaggctgatgatcccatcacacaggtgactacaacctccttgtcatcaacagctcctgcccatggggaagcgaaatgaaaatctatccccatccctctcttcttacatatccctgtcctgcccctgccggtgaccaacaccagctcaggttgaattttgttttgtcacttgtgctattaaagaaaataactccttctcttactggtctcctagttcagacagaatcagtttgtttccagaaatagaaaacgctgctcacacacatgagtgtaaagtaaggatgacaaaaagaaaaaatccaggctatgtggcccagagacccaggtgccctctgattggcctcatagatgtcccctcctcctggcccaggtttgcttgtcattccttaagctctggaaccttgaactacatgggttctgtcttcatagatacagaagaaaaccctccccaagaaggagatggttcccagaaccagcacatgctcacttttctctgtttaattccacacatctgacttatttttgcttccatgagcctttgttgaagatatctctgaatacctctcatttctgttaggtctacagcctatggacctatctccattatatttgtgcttatttttctaacctttatgactgattatcatttaagcttaatatgagatatgcatctatattaaagatatataaatatgtcatcaatggtcaatattattaaagttataagtagtaatgcaaaattgtagctattatatcatttcacttgttcactaacattaatatgtgaagtgagaagatcactttattaatcacgcactcctggtcatgtgtgcggatgagtaagctcaggggggatgctgccatggtccatgggaagcctcaagaacagcagacctggcacatcaggcacaacatgggacacagggagtgagccatgtcagcagaaagcagaatagactgaggcatcagaaacaacccattgccaaactctccactgccttcctgcatgggtcagaccagagctgctcaaacataacgtgcacacagatcatctgggctcctggaaaatgtggactcaggggtctaggatgaggactgagattctacacttctaaagatcccttctcctacaaatccacatatgtgtttctgtatcacaaaattagtaagaatgggggaaaataagaaggaaagccatttgtagacaggaagcaaagaaacatctttcgcggagagaactacagaattttcatgaagaaagacttccagttgaggcaggcagacaaccagagaggacagccgagaagactgaggaggctcctctttcttcacaaaacaaacaaatgaaagcaaaaagacaccaagcctcccccttacctgccctgccctctggctcctgtccaatctccccaccagcttctccttcagcctcttctaaattgtggaccctcctcaccttcccttcaggagatgccctgagtccactgcttctctttcccaaccccactagcaccttccgctacttcctgggtttctcctcagctaccagagaatgcagtgaaccatccaatccaaataaattatcctgttaaacattgaccagtaggtctcctttgtgcggatctgaggaatcaagcagggagaaagaacctgactttgtgagctgcctgagaaatgagttcatggctgaagtgtcccttttctcagctaacatgttttatttcatgcacagggtgtatacagagacaatcttcccctgaggactccataaaagatggggagaattgtgtgtccagttcccattgaggagacacacacagaaaactaaaggctgaggtgaggtaggaggctgccctgaggacgggccttgccctgcccttggtcagggagtgagcagtgttcaagaccctggtggggacaggaggctctgtcaggaccccggcatctggtcagagacacggtggacctggacttgagcagcaggggatgctgtggccctgctgctgagccctctgtggggctgtcagctgggaaaccagaaccctgtgtggtctgtgctcagagatcactgggccaagtagctggatcctctgtgggctcctggggagcctcaggccaggctggatcctctgtgggctcctggggagcctcaggccaggcccaagttaggcccacccctcccagaaatgacacagccattgccgctgcatacagccccagggaggggtacggttgggcagaagagagacaagtttgcatgaagggcccctctctctcttctgggactaccggatggataagagggacctgcatcatgtcagcctcagcagagctctggggtgtttgcaccatggcctggaccccactcttcctcctcctcaccctcctcctccaccactgcagaggtcaggatggcccttagcaccctgatcctgcagctcactcacactgcctcacaaactcataccaggaatgtccttccctcttatccttacttcaggccataatgggcgtctatgtcttcagggtccctctcccagcctgtgctgactcagtcacccactgcatctgcctccctgtgggagcctcggtcaagcttacctccactctgagcagcaaatacagcacctacattattgagtggcatcagcagtagccagggaaggtcccttggtacttgatgtatgttaccagtgatggaagccacaaaaatgggatccccagttacagttctcaggatccagctatggggctgatcggtaggtcaccatctccaacatccagtttgaggatgaagctgattgtatctgtggtgcagatcatagcattggtgtgacatatgggtaaggcaaagtgaccccagtgaatgaggaagcaggacaaaaactgttttctctgctccactatgaaggctgccacgtggccctgagaaacagtgcctgttttccttactactcaagaaagatagatagatagataggcagatagctagctagatagatagctagctagacagataggcagatagctagctagctagctagctagacagatagataggcagatagctagctagatgctagatagacagatacctagatagctagatagattttttgctttgggttccttaggaacaagtttgctaggccaagctcctaaggagtacacaagtctgtattaatgtggccaatattaaggcagatcctgtcaccccctgcatgtcgatacattgtcaccacatgggaactgcaaggacatttttccctgtggatttaaacactggaactctgctgcatggcacacccctgccacatcaagtttcattttaacaatcacccataagatataacttcttaagaaaattttgaattctaacaaaatgctagaaatcacactgttgatacacagcgatggaaataatgaaaatttatagacagtgaaataaaaagatttaaaatttttggtggtttataaaggttttctcagttgttcagtgcgtgggttttgggattaggagaaaatgaggagaaactgcctccaccacattgaacatgacaactgatttgcaataatctaacaaagaagaaggatataaataatcattaatgtcatcctgacagccctgatcctaaatgtcagaattttatttcttaacttttttctccaaaaaaaaaatgtagcttcagaaaaacttctggaatggtggtatgaggccatcagaaaacctgattcaccatacaagcaatgagaacagcagtaaaaatgatataaatctacttttcagaactctgtacattaccaaaagcttacaaaattctgggaatcataaaaaatagtaataacagccagacatggtggctcatgcctataatcccaacacattgggagctgaagcagagcgattgctttatcactcctgggattttgtgatcagactgggcaacagagtgaggcctcttctctaaaaaacattttaaaaaagtagctatatgtggtggtgtgtgggtgtagttgcagctactggggaggctgaaggtggaggatcacttgagtctgggaggtggaggctgcagtgggctgtgattgtgccactctacttcagcctgagtcataaagcaataccctgtctgaatcaatcaatcaatcaattaaaataatgtggaatctctgtaagaatctgaagctttgtggtgattttatttcttttgctctctcccaagttccacagtagccttaaaaaccaacagcctcaaatctcctggatctagggaaactagaaaaatagcattcactgaagcaaccaaataccagatctggaattttctcaaaagccccattcccgtgcgactgtcattatttgagctttccaaagctcagaaaagcttcacgctctgtacttttctaaatgtgaattgtctcagagctcgcttggtttaaacagcttcatcctcaatacatttatcaaaacaatcagtgagatctgttaaggtcctgagtcagtgatacaagatggggtcaataaaaggctgaccaaaaaccttgagagaaaaaaactgggtgtcagaatctgtagaagattttgatgagctctgccatattcctggaaagacagaagatcactctcatgctcagagttatgtgcatggccaggtaaaaattaggaaagtccttaattttcgacactggctgaaatcaacaaggaaggctaaaatagagttgtaaagtggcggggttttgcagtcatgacccaacccctgcacagagcattcggcaaatgctgaggaatgtgttgttcgaggcgtttaagaacatgtctgtccaataataagctaatgactgatataattgagcagagactgcagtggctgcacaagcaaagaaaacagacttagagaattattccagtaccgtgaaacaataaatcatcatcaacaataacaactacaacaaaaccagaagcaattatgacaaatattttaaggaaagaatctgatttccagaatcgtcacattgtgtgactgagaagctccatttggcaaagtgaaattttgaggcagggacacagcaaagtactgtccatacacagggttaaaaaggaaagcaaagcaaaacataaaaacaaacaaacaacattaaaaataagttgacaaaatgatgtccagagatgcatttggtggttactacataaaaacttcaaattagcttttgtaaatgtggtcaaataaataaataaaacaacgttaacaattgttaaggaaagtacggaaagaatgcctcattacagagagaacattggcggggtgcagtgcctcacacctgcaatcacagaactttgtgaggccaaggcagacagatctcttgagcccaggagtttgaggctagcctgggtaacatggccaaaccatgtctctacaggaaatacaaaaaagctagctgggcatggtggtgcatgccagtagtaccagctactcaggaggctgaggtgggaggatttctggagcttgggaggcagaagttgcaagagcaaagatcatgtcaatgcactccatcctgggggacagagcaagagtctgtctctaataataatataataataataacaatagagaatactaataaagaggtatagaagaaaggatcattgaattaaagacagataaattgataattattctgttccaagaatagaaaaaaatgacaaacagtctgcacaacctgagagacgatgtgacaccaatcaaatgttccaatacacacatagtaagtttcagtccttccaccatgtgagctcgcagtgagaagatggcagtctatgaaccagtaagcacatccttaccaaacaccgaagtatctgcttgtactttgattttggaccttccagcttccagaactaaactctgacctattttttttggacatttgcatagtgtgggcctcagaaggaagctggctggaatttgacatcacagccactagtagtctgtgggttgtaaccccacagcataacatggggcttcagctgagcgtagtgacagaggatggagtccacatccaccctctagctgcagacctggtgggcagagacagcacttaggctatgcagcccttcatggtggctttcttcaaagtcattgtggtccatgtgtgcatcaccaggtcagcctctggctggcgttgacagcagagttgtactcactttacccagtcccactacgtggctcaagtctccagtacttcagattacatcagcagcaaattaaaaacagcctgcaggaagcatgagctatatgtgagcttccaagacctggatggcaggactggttcatcgcacccaagggctatgctgctaattactgtgatgtagaatgctccttcccaatcaatggacatgtgaatgcaatcaaccatgtgatcattcagaccttggttcaccttatagatcctgaatatgtcccaaagctgtgctgtgtgccaactaaactcaatgccattttggttctttacttcaatgacaattccaaaatcaccttgaaaaaaatacagaaatatggttgtaagagcttgtggatattgctaacttgaaaccagatgctggggacacacattctgccttggattccttggtcatagctgccttaaaaaacatacagaagcacagtggaggtggagggataagactttgaaaccatctcatgctgatgccttactgcccgagaaaaattttaacggaccttgctaataatttgctcacttggtaagtaacatgagtagttgttggtctgtactaagctgagtttggttgtctggtaactacagaaacttaaacttaaaaggtaccccccaagcccaccaaatttaattttagctatagttcaagctatttgggttattagtgagtaaatagggaaaataatctcaatggagttaaatgtattcttgggtaaagtatcagctggtttattagtgtctatcaaaggtacattttacagatagtgaaagttggggaagtaggaataactcctctattcacagatttcattcccaggaaggcaaattttatactggatccacagtccaggccatagcccgggctccttggggatgcctctgtctcagtctttgctgttatgagtttgtgctggagttctgttggtgtgaaaatatacttatttcagtcaaaacaaaccatatcattttcacatctcagtcctccatttgctgtattctttgctagtacccaaagtagactgattaaactttgaagtgaggcttagaggagtggaaagcatttgtgacaggctccatggtaactgtgtaacatgtgaaagcaatgctgcacctcttctttattggaatgactttttgaccagcacattaacttgaggactgccgactctaatatctatttcaggaaagcggtgctttgtctttttactacagagcataccacgtgattgggttagaaccaacaaaggaaataaaatgggaaagggtgccccacctttaagaatggctttagggggatgagtgtgccatttatgaatggaaattatgattttctcttgtagaaaggaaggctcagattaaattttagaatatttttaaaatatctttttcaccaacatgtactgggaaagcaatttcatactaaactgattaaatgatagttttataatctataactgcagtaatggttttttgtaaatatgaagtataatttattttatatctgttttgctgtaacattgaaggaaataccagacattttctttaagtgtttatttagaaagtaccaggagatggttccaagatggccaaataggaacagctccagtctacagctcccagcgtgagtgacgcagaagatgggtgatttctgcatttccaactgaggtaccgggttcatctcactggggcttgttggacagtgggtgcaggacagtgggtgcagtgcactgagtgtgagccgaagcaggatgaggcatcgcctcacctgggaagtgcaaggggtcagggaattccctttcctagccaagggaagtggtgacagatggcacctggaaaatcgggtcactctcaccctaatactgcgcttttccaatggtcttagcaaacggcacaccaggagtttatatcccgcacctggctcagagggtcccacgcctacggagcctcactcattgctagcacagcagtctgagatcaaactacaaggtggcagtgaggctgggggaggggcgcccaccattgctgaggcttgagtaggtaaacagagtggccaggaagctcgaactgggtggagcccaccacagctcgagaaggcctgcctgcctctgtagactccacctctgggggcagggcatagccaaacaaaaggcagcagaaacctctgcagacttaaatgtccctgtctgacagctttgaggagagtagtgattctcccagcatgtagcttgagatctgagaatggacagactgcctcaagtgggtccctgacccatgagtagcctaactgggaggcaccccccagtaggggcagactgacacctcacatggccagatacccctctgagatgaaacttccagaggaatgatcagacagcaacatttgctgttcagcaatattcgctgttctgcagcctccgctgctgatgcccaggcaaacagggtctggagtggacctctggcaaactccaacagacctgcagctgaaggtcctgactgttagaaggaaaactaacaaacagaaaggacatccacaccaaaaacccatctgtatgtcaccatcttcaaagaccaaaggtagataaaaccacaaagatggggaaaaaacagggcagaaaaactgaaaattctaaaaatcagagtgcctctcctcctccaaaggaatgcagctcctcaccagcaatggaactaagctggacagaggatgactttgaggagttgagagaagaaggcttcagacaatcaaacttctccgagctaaaggaggaagtttgaacccatcacaaagaagttaaaaaatcttgaaaaaatattagacaaatggctaactagaataaccaatgtagagaagtccttaaaggatctgaaggagctgaaaaccatggcacgagaactacgtgacgaatgcacaagcttctgtagccgatttgatcagctggagaaagggtatcagtgattgaagatcaaatgaatgaaatgaagagagaagagaagtttagagaaaaaagaataaaaagaaatgaacaaagcctccaagaagtatgggactatgtgaaaagagcaaatctacatctgattggtgtacctgaaagtgatggggagaatggaaccaagttggaaaacactctgcatgatattatccaggagaacttccccaacctagcaaggcaggccaacattcaaattcaggaaatacagagaatgccacaaagatactcctcgagaagagcaactccaagacacataattttcaaattcaccagagttgaaatgaaggaaaaaatgttaagggcagccagagagcaaggtcaggttacccacaaaggggagcccatcagactaacagctgatctctcggcagaaactctgcaagccagaagagagtgggggccaaaattcaatattcttaaagaaaagaattttcaacccagaatttcatatccagccaaactaagcttcataagtgaaggagaaataaaatcctttacagacaaacaaatgctgagagattttgtaaccaccaggcctgccctagaagagctcctgaaggaagcactaaacatggaaaggaacaaccggtaccagccactgcaaaaacatgccaaattgtaaagaccatcgaggctaggaagaaactacatcaactaacgagcaaaataacaagctaacatcatgacaggatcaaattcacacataagaatattaaccttaaatgtaaatgggctaaattctccaattaaaagacacagactggcaaattggataaagagtcaagacccatcagtgtgctatattcaggaaacccatctcacgtgcagagacatacataggctcaaaataaagggatggaggaagatctaccaagcaaatggaaagcaaaaaaaggcaggggttgcaatcctagtctttgataaaacagtctttaaaccaacaaagatcaaaagagacaaggctgttacataatggtaaagggagcaattcaacaagaagagctaactatcctaaatatatatgcacccaatacagaagcacccagattcataaagcaagtcatgagtgacctacaaagagacttagactcccacacaataataatggaaggctttaacaccccactgtcgacattagacagatcaacaagacagaaagttaacaaggatatccaggaattgaactcagctctgcaccaagcagacctaatagacatctacagaactctccaacctaaatcaacagaatatacattatcagcaccacatcacacttattctcaaattgaccacatagttggaagtagagcactcctcagcaaatgtaaaagaacagaaattataacaaactatctctcagaccacagtgcaatcaaactagaactcaggattaagaaactcactcaaaactgctcaactacatggaaactgaacaacctgctcctgaatgactactgggtacataaagaaatgaaggtagaaataaagatgttctttgaaaccaatgagaacaaagacacaacataccaaaatctctgggacacatttaaagcagtgtgtagagggaaatttatagcgctaaatgcccacaagagaaagcaggaaagatctaaaattaatacccttacatcacaattaaaagaactagagaagcaagagcaaacacattcaaaagctagcagaaggcaagaaatgactaagatcagagcagaactgaaggagatagagacataaaaaacccttcgaaaaatcaatgaatccatgagccagttttttgaaatgatcaacaaaattgatagactgctagcaagactaataaagaagacaagagagaagaatcaaatagacacaataaaaaatgataaaggggagatcaccactgatcccacagaaatacagactaccgtcagagaatactataaacacctctatgcaaataaactagaaaatctggaagaaatggataaattcctcgacacatacaccctcccaagactaaaccaggaagaagttgaatctctgaatagaccaataacaggatctgaaattgagacaacaattaatagcttaccaaccaaaaaaagtccaggaccagatggattcacagccgaattctaccagaggtagaaggaggagctggtaccattccttctgaaactattccaatcaatagaaaaagagggaatcctctctaactcattttatgaggccagcatcatccttataccaaagcctggcagagacacaacataaaaagagaattttagaccaatatccctgatgaacatctatgcaaaaatcctcaataaaatactagcaaactgaatccagcagcacatcaaaaagcttatccaccatgatcaagtgggcttcatccctgggatgcaaggctggttcaacatatgcaaatcaataaacgtaatccagcatataaacagaaccaaagacaaaaaccacatgattatctcaatagatacagaaaaggcctttgacaaaattcaacagtccttcatgctaaaaactctcaataaattaggtattgatgagacgtatctcaaaataataagagctatttatgacaaacccacagccaaagtatcatactgaataggcaaaaactggaagcattccctttgaaaactggcacaagacagggatgccctctctcaccactcctgttcaacatagtgttggaagttctggccagggcaatcaggcaggagaaagaaataaagagtattcaattaggaaaagaagaagtcaaattgtccctgtttgcagatgacatgattgtatatttagaaaaccccattatctcagcccaaaatctccttaaggtgataaacaacttcagcaaagtctcaggatacaaaatcaacgtgcaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacaaaataaaagaggatacaaacaaatgggagaacattccatgctcatggataggaagaatcaataccgtgaaaatggccatactccccaaggcaatttatagattcaatgccatcccaatcaagctaccaatgactttcttcacagaattggaaaaaactgctttaaagttcatatggaaccaaaaaagagcctgcattgccaagtcaatcctaagccaaaagaacaaagctagaggcatcatgctacctgacttcaaattatactacaaggctatagtaaccaaaacagcatggtactggtaccaaaacagagatataaaccagtggaacagaacagagccctcagaaataataccatgcatctacaactatctgatctttgacaaacctgacaaaaacaagaaatggggaaaggattccatatttaacaaatggtgctgggaaaactggctagccacatgtagaaagctgaaactggatcccttctttacaccttatacaaaaattaattcaagatgggttaaagacttaaacgttagacctaaaaccataaaaactctagaagaaaacctaggcaataccgttcaggacataggcatgggcaaggacttcatgtctaaaacaccaaaagcaatggcaaccaaagccaaaattgacaaatgggatctaattaaactaaagagcttctgcacagcaaaagaaactaccatcagagagaacaggcaacctacagaatgggagaaaatgtttgcaatctactcatctgacaaagggctaatatccagaatctacaaagaactcaaacaaatttacaagaaaaaaacaaccccatcaacaagtgggcgaaggatatgaacagacacttctcaaaagaagacatttgtgcagccaacagacacgtgaaaaaatgctcatcatcactggccgtcagagaaatgcaaatcaaaaccacaatgagataccatcccacaccagttagaatggcgatcattaaaaagtcaggaaacaacaggtgctggagaggatgtggagaaataggaacactgttacactgttggtgggactgtaaactagttcaagcattgtggaagacagtgtggcaattcctcagggatctagaactagaaataccatttgacccagccatcccattactgggtatacacccaaaggattataaatcatgcttctataaagacacatgcacacttatgtttattgcggcactattcacaatagcaaagacttggaaccaacccaaatgtccatcaatgatagactggattaagaaaatgtggcacatatataccacggaatactatgcagccataaaaaaggatgagttcatgtcctttgcagggacatggatgaagctggaaaccatcattctgagcaaactatcgcaaggacagaaaaccaaacaccacatgttatcactcataggtgggaattgaacaatgagaacacttggacacagggtggggaacatcacacactagggcctgtcgtggggtgggggtaggggggagggatagcattaggagatatatctaatgtaaatgacgagttaatgggtgcagcacaccaacatggcacatgtatacgtatgtaacaaacctgcacattgtgcacatgtaccccggaacttaaagtataataataataataaaaagagtcagccccctagcctggcagtgctgctctacaggcaccctcagccctgatcccttcactgcacctaggggacacagtttacaggactgagtcagtgggacaccctgttcctttacattcccagtcatgggctcagattctgcacttgtctcactgctggagggaggagcctgcatcagtcaccctcaaagaagacatgaagttatttcacctgtaaaggcaagaaactgttcgcagcactgggggcaggcttggggaagatgaggtttgtgaggatgttgagaattcatgcagctcatccttcagccctatagctttccagagaagtgtataatgggggtcactaggcatgtgagtaactgatttggtgaaagatgccacttcagatcaaaagtgcatttccccttccccaaggtgtcagcaacactgaaacatatttgactaactttatagaggaagattaagatagaggatgagagagacataaggcctcaggaatatcttagccaatagaaagcctgctggaagatgcatttccaatatgattagactgattgaaaaccttgaaactaaacacttccaaaggagactgggacccatttctcctgagaatgacaacacaaaaaatagtagaggaaaccaacaaaccaaaagcagacactgtttcagatctattgaaaatcctcaagatagtctcataatataatattcaaaatatctaggatacaattcaaagaaacacttgttatatcaagaagtagaaaaattcaccatttgaatgagaaaaggcaatccagacatcaacgctgagatgatttagggctgaaattacctgacagatatattgaaatcagccaccataaaatcctgttgatgagcaatttcaggcattcttgaaacaaatgaaaaaggataaattctcagaaaaaatagaagtcataaaatcaaactaaatataaatacaaataaaataaatgaaaaatttaaaaatacctctctggagagactcaagaacaagtaactatgaaactaaaatccacgcattagagaagacacttaacactgttaactagagaagcacaaaccatagttatcacagcccagcagggcgagcaatcagtctgctcagaagtgagaggcctgaaaaaaaactcctggtgtccctgatggtgaaatctggcccctgatcccagggttcctccctcttcgtgctcagagggctagacctagcagtgaagggttcccaacctcaccctatgcggcccctccagaaggcagagcccattcttgctgatattcccgatctccaataacacaaagtgaaagagaatgtcttaaccagagtactgagtcttggcctatctgaacatatttcaaagtttaaatgtacagtgagcataggatgctgagcagaggccccctggacagtggctggagttgggagcagtgcaggatggaaggacaggtcaggggccctgagcacctgtacctgcacctgcacctgcccagggtggacatgactcccgcatccaccagagggcgttgtggtctaagcaactaatcagagctccccagatcctctgctgttttccctccacctgctggtgtttctgtgccctccagatggtgttgctcctcccccttctatgaccacttttcagccataaccttgtctgaggtcaaaggagggggttgtgcaaccttcagaaagggagaaatttgcatggagccctaccactctgaggatacgcgtgacagataagaagggctggtgggatcagtcctggtggtagctcaggaagcagagcctggagcatctccactatggcctgggctccactacttctcaccctcctcgctcactgcacaggtggctgcctgcaaggaattcagggagcgttcctggatgtcacctgggctgatgatctgttcctcctgcctgggaaccagtcttcatctctcccgactgatctctgtgttgctctcttcttgcaggttcttgggccaattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcacacagtgctccagacccatggggaagtgagacagaaactccccagagcatctctacctgggccagtctcagcctgtctccaccagagagggtagctctcccatctctcctgtctaagtgcttgaggtgaactttgcttatgacttcctcttttccttttcaaaataccaatctgtttttccacaccttgatggctgattttctgatatgtgcacgatcaattgtgggataaatgtagtttataatcgggtctctgagccacaccatgattgatgttctggttggggctgccttgcacagtataagttattgacttgcatctctggcctctacccttagatactattaacaccctcccctcatttgtgacaacaagactgtcttgagacactgccacatgtcccatgcttggggacaaaatcagcccaggttgagatactcagttaaagagcatgtcttcagctactaagaagcttggctttgaaatgtgtttatgccattctgctgagcatgaggctggttttctaatttttgtttctggttcccatctatgagacaaaacaataacaccaaacttcaatgttttgatggttgaatggtttttccaagcaacaagaagtcagagattgtgctacttagaggtgtagaagccctaaccagatcctgtaacacagagtttagctctgactaggacagcacacaatgccttccatcaatctccaacccacagcccgcaggctgcatgcagcccagaaaggctttgaatgtggcccaacacaaatttgtaaactttcataaaacattatgatttttctgcaattttctatagctcaccagctattgatactaacagttagtatcagttttatgtgtgttccgagacaattcttcttccattgtggcccagggaaatcaaaagatgggacacccctgctttgcacttttgtacaatgcacatggaaatataatagagccttcttccttctaaggtcatgtgactcagccattgaaaggtggaagtgctgaaatgagctccatatgaacggaccttgaaaaattatgctcagtgaaaggaacaaatgcaaatatctagaaatgaaatgtctggaaatgactgtatttataacaaatgtccatgatacgtaaattcatggaggctgaaaagatcgagattatcctcaaaccttgtgataatttaggtgaaaaggatgatttcagaattggatagaaagtgatctacttcaaaaataagctggaaatgcctccacgaacagaggcgatgctttgcggaatcctaggtggagaagtgtatcaggtgcagatgaggtctttaagaatacttcttgttttgttttgtaaaattaaatatgaataagaacactgtgggccaggcgcggtggctcacgcctgtaatcccagcactttgggaggctgaggccggtggatcacgagatcaggagatcgagaccatcctggctaacacagtgaaaccctgtctctactaaaaatacaaaaaaattatccaggcgtggtggcaggcacctgtagtcccagctactcgggaggctgaggcaggagaatggcgtgaaccagggaggcggagcttgcagtgagctgagtttgcgccactgcactccagagcctggctgacagagcgagactccatctcaaaaaacaaaacaaaacaaaaaaacactgtgcttgctcgcttacctcctcctcaggtcatttcctgcagtctctaagaacagtccgcctggcttccccatctcctccctgagcgccagcatctggggcgtgaacagcacaatcaaggccacacctgtgagaccctcagtgcgtcagcagagctgtgtcctggtgatgtcaagggacacggggtcagcaggggacctgtgaggctgtctcagggggtgagcatgtctggccctgccagctgggaaggccctcaggaggttgaggggagctgagcacacagtgagctcactgagctgagatgggaagtgactgcagctgtcaggaccttcagggacactcagtctaggatcaggctctctcaccctgtggggcctggttcaggtcaactcctcatcctcctcttcttcctccagacaagagagacattgcctatggctgaggggtcctggaggtgatccgggtgcagggacttatttgaatgtaggaaattctctcccagtgagacctgtagagactaaaagagcgttaggaacattcactgttacggctggagtcttagggtgcagatctcttgagcacctgcaccatggcttggcccctctgctttttgacctcttccctccctgcccagctgaggcacatcctgctctggggagaagggtctatgcggtcctcagcccacctctgctccactccctttctcacagggctcattgttttctctttctctccaccctcctgggtctgtggtccacatggcactgacagcctctttcactgaccaagcctccgggactgacaattacaatcacccaccctggaaacagccataatactgtcaatcaaggcacagcttggattcaggagcacctgggacatgtccccaaacctcagacccagagggggtaacaaccatccctcagggacctcagggaatttcccagccccatgttaggcagtttggcctccctggccatctctgggctccaggctggcgacggtgctgattttcactatttagcacagaatggcagcctcgctgattattctctgattatctggatgctctgtgactccttctgtgcatctctgggatcatcattcagactcacctgcaccctgagcagtaacatcaatgttgtttgctatgacatttactggaaacatgacagggcagggagccttccctccctggtatctactgagattctactgagattcaagcagaaccagggctcagggtccccagcctcttctccgtgtgagtgggtgccgtcgccagtgctgaggctttccatatctttggtctcaagcttgaggatgaggctactcatggcacagtagtgcctctcacagtgccatggatgggatgttctctctaaaatagaagtctttttttttttttagtttggcccctttgataagtagattctataataattaaagaaaaaaagtaatgtcttttttggagagtagaaacactggtgaaagagaaaccgggaaggacttggcatggggggtgggtgggcttcaggccacggctctgacccccacgaaaggagagaaggaagggggattagtaggaactgccccagcccacaggcaggtcagacctcagacaaagcctcagccaactgagtgggttctttcccacgggtgcccattacaagtgccctgcttcctgcaggaagacctgcctggagggaccctggggtccccattgcctggagccagcccacgggcaggggacatgttagtcacttgtggtcctcctgcacgttctcccaaagaggcatctgagtgggacacttccacagccgccaccagcactgctgctgcattccccctcaggacaggggcagtgccttccttccccggctcatctacctgagccccatgtgaagtcaaagcttaggtgtctcagggctttcctccaacaggccctgcagccactgagacccttatataccctgagctgcatgctgtggagagagggtctgtggaagaccttggctcttagccatcgactcctctggggaacaccatgaaatcctcagactggggatgtcctctggagccatctttatcctcttcttcttcccagtatctcctgctccatgatctgggtcctgtccctggccctgttgcatctccagtgtctgatccatgccagcccttccttaaatatgtgttgaacccatttcccatttgcccaagaaatgagtgctggcaatgagctgcactttttttttttctaaatgggaaatgggtcaataaatgaatgaatgaatgaataacaacgcaacctgagtctcctgtcacatggttattttaagacctgcgtttttctttacccaggaggaaaatgagtacctgcagccgttattgcctctgaattgagctaacttgtttctacactgtcatgccatggtcacagtgggacagatgtacaccaagcctaccatagctttcagccctgcccttccacccgccccacctgtggcagtgatggcatcaaggcttccctcagagtcggcctctacccaccacacactctgggccatctcctgctctccaacagcctggggttcagtgatccctgtccatgtgttctacctcagagacacctgccactcctccccttccctaatttctctgccatcctgtttctccagcctcccaggaatgtcccctgcccaatctcatgtctcaggttctagaacttgtcctggaacttccccagagctgagtctctaataggagagctgatgacaggcacagccgtggtcaagccctctagccagcagatggaggagaatcagcctgagggccctgtgcatcctccctgctgcacacctgggcccatagccccctccaccctccatatgctcctgcagcccccacctcagtgtctgcctcagtgtctcctcccagcaccttcctcaggaagggcctgagatcttgcatggtgtgtttccccttggtgaactcctagtcacagcagcatcccgagtaagagcctcctggtgaagagatcgtcttggtgctccaccctggcattgtgtcctcagctccagggcaggtcacacgctttcctggaccaagattacatgcaggccacccctgctggcccctgccccacagagggaggcccggggtcaggggtggcaccaagaccacagctccattgatccctgtaggaattcttcctgcatgtttgaaagacaagagttacagaaacaaagcagagggaagattctgggtcattgcaaaaggagaaatttgcctgcagaccagcaggggacgcggtgagaccttctctgtgtatttctgcaggacaggtgctcacagctggggagccctcaactgacagaggcccagggctgctccttcatttcctcctgggactctgcagccttgtcccatctgtgcctggcagagtcctctacacatgaccctgtgtgtggtcccagcagctgctgctttctctggtcccacccgtggggcaaactcttgcttcatgccagcctccctgtccaagggcctggtccctgcgagtgcacctgggggagaggcaatggggaaacacatttgcatggtcagcccctcctctgtgagcccagtgacgctgggataagagaggcctggggcagcccacccctaggtctgtggcctcagaggcagctgtgtccactatggccctgactcctctcctcctcctgctcctctctcactgcacaggtagggacagggctcagagcccagggtggtccccagcctgatctgtccctcatggctcagatccctcagcagctgcgccctgaccctgctcctcactgtgctgtgtctgtgtctgcaggttccctctcccggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaatcacagtgagacagatgaggaagtcggacaaaaaccaaggttttaagcttgtcatttttactgaactggttaagaacttcagtggttaataaaatcacattaaatacaggattgttgttaaaaatggtggcacattataactctctcccatttttttcacataatgcccatagtgactctaagcagctaaaatcaaaacacaaaaacttataccaatactaagaaatactaacattactaaccaatttccactagtaaaagagttgtgaaacagctgaaatacatccagatggcataatacataataccactatatacaagagttgtataaaattatgtatcatgtatatataaaattatgtatcatgtatatgtataatatatgaaataaaatgtcagcagacattaccgtcttcccaccagtagccagcaattctgccctgcctctagaataaatggttaccacgggttgaataggcgaacagccctggcagctctgcaggatgactctcactgtttgttattgttttatttttaagattgcttttctttcctattttttttgaggcagagtcttgctgtcagccaggctggagtgcagtggagtgagctcggctcactgcaacctaagcctccctggttcaaacgattctcctgcctcagcctcctgagtagctgggattacaggcgtgcgccaccatgcctggctaaagtttttgtattttttagtagagacagggtttcaccatgttggtcaggctggtctggaactcctgacttcgggatccgccgtcctcggcctcccaaagtgctgggattacaggcgtgaaccaccgtgcccgacctcttttttttttttttttagtttggttttgttagtttagttttgttttatctctttaacttgacagtcagagatgatccatgtggatctctgcatgggtctgggagctgcaaggctcctggtgcatggcccggtcccgcctgccttggcagggctcctccacctggctcctggaggagcagctgcgcccgactaccctgcatggagcccgcggcttagcggcagctcgggaggggcctgatagaaacttccccctgagcaagcagcgccaaacccaggccgccacccaggatggaggctgcatcacccccggggagcccggatcctcgccagggtccaccaggagaagagcacatggcggagatgagcctgcggggctgggagagagagaagacacggcgaagctgcaggtgaagacgctgcactaaggccccacccagaggctgaggttccccgaccagaccagcagcagcgaggctgcccagagcggcgccagcaaggtggttctctccaggtcggatcacaggagaagctagccttgcacctggcccaggcaagaagcaggacatgggcttacgcagaagaatcagcaccgattccacatcattccccatggcaacggcctctacggtgctgtcagcaagacccagtgctagacccgagcctgcaccaggagctgcggagcggagggtgcgccccatcccgatcgtctccaccactttagctccctgggtgagggtgacacggggaagcttattatcgcggctgcccaaaacggggcgtggctgggtaccctgtgtacatagggtagatgctgaatgtgaatagcactgaactactagagggaggctggagaggcccacagtgtctatctaccatgattcattatttgggcccagaggattgcctaaggcctagtatttggctcagttggctcagtaacgggcactaggatgcagtatttgatcactcctatcctaaccaagtacgacaactggtgcaaacagactcaaaagcaaaggcaacgcaatgaataacttgctcactctggggccacatatgctgaataaaatgcctacccttgaaatgtctgaaaaccttacaccctgggaaaattgcatacagaacttgtgcttggagaatgacatgaactctaatcagggtaataacacttgtaaagttcctaacagcttttctttccttttttttttttgtttttgagatggagtttcgcagtgttgcccaggctggagtgcagtggcgcgacctcggctcactgcaagctccgcctcctgggttcacgccattcccctgcctcagcctcccgagtagctgggaccacgggcgcccaccaccacgcccggctaattttttgtatttttagtagagacggggtttcacggtgttagccaggatggtctcaatctcctgacctcgtgatccacccgcctcggcctcctacagcgctgggattacaggcgtgagccaccgcagctggcacttcctaatagcttttctgtgagtgtaacgccataatcatcttttaaaatgttttctcggaactaaaagttgctgggcgcctaaatgatgttgcatgatagttttgggtgattttactgcatctgtaattttctgtttaagtgagcaccgcttaatttgaaagctaatttctcacagtgtaaatctgttcattcctggtagtctattttctacaaaagtgtatttttacacaacattaaaaaatggtgtaccttcatctatgacagtacattacttttgacaagcagctttcaggcagaaattaagagaagtgttttatataaaatttattattttgaacagagtttgtgatttggtagttacgctgttgaaatttgaattttacaattcttagaaacttatattgatgcattcttgttaccaaatgattggcccattacattttgatacaaatagatttgttgttttggaaccattatttgtttagaaatggtcaatcttttagagagaaatacttaacaaaggattgtgggaagttttttttttcttcttctttaacggattgtaccaggtcttacttgaatgaaagtctgatgcttgctgatggcagagtgactaatctgcactagattgatgtttagagcagaatgttgggtgatctcaattgtttttatttatgtttgtgattttgttttaaggtaatcttaacatggtataagactctgtgacaagctaaacctactgcaatatagcatgttggagtcccctaagagttttaaaagctaatggcataaatgcctggagccaacctcggcagttatttcatagcagaagataccgtcttaatattccttttaaattcttttaaaaggcaaaataggatcatcctattttataatgtacaaatgtctgcagagattgtatggtttgttgtgttaatgtttcccacctaaaatctatcatattgccactttgcctaattgtagtcacatttattaagtaatgcagtttgtactttttattttgtaacattctgtgatttttgtacaacattgtatttgtacaatacagcaattcccagttgattgaatgaataaataaaatgtaaaatcatactttataaaaagatctatgtggctgatagaattctgacattcccctccaaatggaaagtgatgtgtttctttaaagtaaaggtagaggagtcttaaatataggtgttcctgcccctattgagaggttttcaaaacatgctcttaatttaacgtttaaatataccagagtcttagaatgtgagaataatgaaattggtttgttttaattttgtgataatattaaatctactggaaagaatattctcctttgaaaagattctcagctcagtgatcatagaacctgtacttgcgtttaattcaatgaggaaagacatagaaatgccacgttaatatcctcatttaggtggtttctcccttcactgatcagcctatgaatgtgtcaatgcagtactccccagtttaggcttaggtacttattgaaaggatgctgcctgagcatttttaataattgctatttcaagatcacattttggccatgaggcaggctgccactcactttaggctctgcctaggcaggaatgggtcctggaagacacatgttctctctctctctctctctctttcacacacacacacacacacacacacacacacacacacacacacacccctctcttctctctgggtacacattattctggacatcttcagtttccaggattctctatgtctccagctagaagtcagggcttagcctgtggtgatccagccaccctcaggttgaatctcgatgaagtcacaggaaccaccagtggcatggagggtaagggatcctgctatcaggttcagccaggaaatgctctggacacctgctggtggaagagtttaatgctgggcaatcacaagtcaggtcccttcttccagtcggcagttcagcctccctgactttctctgggttccagtcagtgcatgaggatgatggtgacatttattcaggggcagcacagcagcctcagtcaccaccaacagtcactgtcatatgagaaaattagatagaaattggccttccaactcttctgtcagatccatctttgccctttttctgcctgcttgagtgaatacgaccaagaccagctcaggtttttgctgatgctatcacacgtgctcctaaaaccagaaggcttaatggtattttctgtttatctttacggattcaatgaaaagacaccttttcttactggtctcccaatgaaaacataatcactatgtccacagtaacaaagatagccctcgttgttgtctgctgggatgagaagagcagcagaagtttggcaggtatggccctcatgggcttcacatgtccctacatctggccctggctttgctgatcaccctttgggctctgaacccacagggaagttaggtttctctttcttttgagattgcctctggaagagctgctctgttcccaggtgcagggcagcccctccgcagtaaggacccagctctcagagccatgaaggcctcaagcctccaggttgactccacatttctagtgcttgtctctggttctttggttggaaagatgttggatgaatagaagttctctgagacctaggctttgtgaatccaacccccattaaatccagggatctttttaacgaataaaatgaatcagggcccagtgatggtggggaaatgggacgtgagggttcctcaggccagtagtatggggagaacatccaaaaagaaaggaggggttccacttttgagaattgtctttttatatccatccacatattgacgaaaattataaaattagactaaaataccttaaatatataacatggtcaaaagaaaagaggtattaccaggataatattaaatagtaaaagaagtcagaggcgaaacagagcaagagacactttttttctgacagcatcattcttatgggctataatgccaaggcttgtgcagtaggagctgaaggaatctcacaggcgaccctcacgacaataatgacaataacaaaataagtcaacctctaaaagaagcccatgtagaattatccccaggtatgaaccacctggaggctcagcagaacattaagccttagattgggttcaagatgaccacagactggtgatgaccacaggcccctgggagcaacacactcacacgcctggtgatgctgatatctggtaaatcatcactgtgcatcctgaaacacattctgtgattagctctttgcagaccataactaacatgaaagaaataatgcctcagctgtaaacactgcagagaggacccactcattctactcccttaggtcatgagttgaaagatccatttgcaatggtcaggatgtccttccagaagagctgggtctgttctgaggggccacccgacttgggatcggagcccagcagggggtgctgttggactgttcctgagagggcagggctctgggccaggccacataggaaaatactggttctcatacacttgagcaagcagtgtcctcactgaagtatgacttcctgcacctgcaccaccgagcaggagccacttcctgcacctcaggagccactgagcactagactcacacgccaatgcttcctattttatcctccgccctcatggagtccttgtccaagcctgcccttcaagcagagacaaatcacacagcaggaacaaatttgctcaaaggaacttgaactacaatgtttcctgggcacagaatgagaaacacttggaattggggaagttcccatcctaacaacttagactcaggaagaagaaccctggagcttctccagcatggccagaatctcagtccacttcaaaatcctcagtctttagatcaggagttcttttagggatgaggtcaaggtttctgggtgcacattaccactgcctttcagtcctatcatctgggcatgaggagcttgttatctcgttctatccattatttctaaacctccttgtagagggctgggttagagagtgctaactgccatttatacagtctggacctttgtataaaattataaacacacacacatacacacacacacacaaacacaaacacacatacttattttgatgttccagcgaaagagtaaaactaaactcaacagaaacagaaacagatttgaataatacaagacaatctcattaatgaacatagaagcaaaactctctcagaatattagcaattagagtccattttatatcaatgaaggattatcttgagcatctgggaggatgtgggttgagacatttgcacagtcattggaagacagtgaacatgatttttgaaaaaacagcatgtttagagatatcaaccagaggtcagatgcttcaatcagagaaagatcctctgagttctcagggctgcttccctgaaaagctacgggagaaggaaatggagtgactggacacaatgccaggggattcattgaccctttggcttcccatgggcagcatgcatcagcatggtcttacaaggatgaaaaagggcatccctcaaaaaagaccgaccatttccccagaaattaataaagaaatatcatggccgggcgtggtggctcacgcctgtaataccagcactttgggaggtgggcggatcaggaggtcaggagatcgagaccatcttggctaacacagtgaaatcccatctctactaaaaatacaaaaaattagctgggtgcggtggcaggcgcctgcaatcccagctactcaggaggctgaggcaggagaatggtgtgaacccaggaggcggagcttgcagtgagcctagatagcaccattgcagtccggcctgggcgaaagagcgagactgtctcaaaaaaaaaaaaaaaaaaaaaaaaatcacagtattttcaccagtgcatttctgtttgagcgaatatgttgggtgaagaaatatataatatatacttttctaaatgaaatttttatctcacaaaattgtagaattaaatttttgttttggataagaaatcaagaaacaatcacacacattcttatgatctcatgaaaaccaggtataggaaaggaagtgacgaccccaaaattcatctaaaaagtgaaggttttggttcaaagataagagggttgtcatgttcaagacaaagtcactaccattcgtggtatttaaagctgttggtacaagtgcctatcattgccgattcccttcaaatttcttgtgtatgtttggatcttaaacatgagcacacacaaaaagagaaacagcaaaactagaaaacagatttacctttttgagtttccaactggaggagaaaatgaacaaagagtaagaatatcacatgataatgggaggaggagtgttaggaaggtgatgaggagcagttcagccttcccagcttggggacagtcttagtggagcagagaaacctccttcctgctgccacctgactctctagagtagatgaagaataaataactaaacataaaaagcccttaggaaaaagattgtcatgatgtcagtgctattaatagttcagttaataattctgtaagaatatgcaaaaacttactggctttttaaaaatttttatttatttatttcttttgagacggagtctcgccctgtcgcccaggttggagtgcagtggcgcgatctcggctcactgcaagttccgcctccagggttcaggccaacttactggcttttatatttggaatcacaacctgaaaggctgcagaacatgaaaggaagaaaactcagattgcagtgttcattctcttttatattatgagtttcctgcaagagctacatctgttattatgcaaaaacaaacagataaggaaacaagaattatccagcctcaagagtggaataaaacatgcactttttttgcttgtaggcataggtgagtaattcagacacggctgctgtgggtgactcatttccccttatgatggagcctcagcaaaaaagcttcacagattggggctgatttggtatgaaggggttggaatcgactgaaggtgacctcattgagagtctgcagtgaagccggccttggctgaatgacctacctgaggcctcccatgtggcctgggtttccaggaagctgggcagtcccagagaattcagagctctgacttggtttataaagtgtcacttccacagaaactgtcagtgccgagagatcactagtgccagatctggttaacagggaggggcctgatctcacccctcaacggaaggtgacgggaaaacaaaggaaaagctgtcttcacatcaacatgggcagataccactttaaagcatattctgtagcagggttcccactccagaagctgtggtacaggatgtgtctcctatggcatgggccaagggagggtaaaggtgagtttgacatctgtctcagtcaccatgaggtttttctgacaactaaatataaatatgtaaggtgtctcacagcacaatcatgtgacaataaatgcagtgcgtgccttcaatattgctctatcaaggaggctttccctccactccaggtgtgagcacgtggcttgcatgtccctccactccaggtgtgagcacgtggcttgcatgtccctccactccaggtgtgagcacgtggcttgcatgcccctccagcttcctgcactgtggtcatactgctgctgcctcattctcagcctgagcatccctacacaggcacaaactctatggctcaggctggtcatcactctgggtccacagtagctggtcagagagaaactgtcttcagccctgcccagcaggagaaaagagcattccagactgatcagctgggttcctgccatccagaagtccttgtctgtctggaggctcaaaacatgactgtgattcctttgaggactcctcccatacccaggctgtgggcttcgctgccctcctcaggacccgtgcagcctgttctatccctgcctcagctgcaggcaaagctgcttgccacaagctccctgctcataggatgccggagtcctcccaagggctgctcttcctggagaagaaggagaaccaggcagtaaggtctacctgagcatcatgggaaggaagtgatccgattctgactccggtgggcgcacacccttggtgctttgtgtctcctgctatcccagccacaggagtgggggaaatgtgtgagttgtagtcctagccgggaataatccataaaaggtgaaggtgagagaaggacactatgcatggtgtcaccttgttttcctcgttgtttcagcggcctgagtcctgtgtttcctgaaagatctgtggctcgaggtgacacgccctatcaggggacaggaatcaaagaggagaatctctgatggaaaaattcacaaaggaagagggagataaaaattgggcaacatgctcagggtgagaacgatggctttttgtccttgtgatagtttgctgagaatgatggttttcagcttcatccatgtccctacaaaggacatgaactcataattttttatgggcaaggacaaacaaccaaacaccgcatgttctcactcataggtgggaatcgaacaatgagaacacatggacacaggaaggaggacatcacacaccggggcctgttgtggggttgggggagtggggagggatagcattaggaaatacacctaatgtaaatgatgagttaatgggtgcagcacaccaacatggcacatgtatacatatgtaacaaacctgcacgttgtgcacgtgtaccctaaaacttaaagtaaaataaaaaaaaaaagacggctttgtgtcaagggctatttatttagtgtctctcgttcccattattaaataatttaacaacaaaaattgccttttctatgaattttcaggaaattctaaccatcattcctttattaaatatctagatatgtacatctacacatatgcatatacatgtgcatatatagacatatattatattatatatatttgtgtgtatgcatgtgtgtatatatttatatatatatacatgcatgtgtatatacacacacaaagacaaattaagaaatatgggaatatagtatacttctttaatttcttaataatgtccatttatatctaaaaaaaagatacccctaaggttgaaccactagaatcattttatttttaatgtggaacaatagaaagcttatggcccataaagatattggataacatatttttctagcaatatgagaaataagcaaaagtgtaaaacatttaaatacaataatttaattcaaaaatatgaaataatttgtattttttagttgctatgtttatctaccaagaaggcattatattattctgatgttcttacacattgttgaattaaagcttgttaaatacaaatgttatcatatgtgcaaatagcatatcaacatttctttttctctcatatattttcagaaatcactttaaaatgtagcagttcataatgttgacaaaatatcaaaatctataaactctgggtttaaaaaacaatgaaatacacagtacacataagaaaatagtgtcaaagctcactactataagagacaatgatcaatattgaaattttctcttacatgaagacgctcaaaacattttagcagtgactagtgaggttgtatccattctcttatgtttatatttatgtttaaaatattgtccttgagaaggagtgtaggtaggtataagcagaggtggctgtgcggatccaagattctagcctgcccccttgatacagcccattaccctagtcccatccaatctcacacatggcccatcatcatcttctgacttgagcggggagagagacggtgggtagagagggaggaaaggagttagttcagagcataggagacgtggtcagagagttggcagagggagggagggaggcacattctgtgggttcacgtggtgctttgacaactgtggatttacttctgaatgaagcatgaagtcattgagagtgtggaacagtaaaatgatattgcaaaataaaataaactaagattccagtgagcatgttgggaatcacaaacactcacagctgggtgaataaacaagtgctgccatctggagaaaagttcctcagcacacaaggagaagtgtgtttgcctctgtcaagcagaagtccacctatacagagacacaaggaaatgtttataaagagatccttattcggagcaaagtattggaagcaacataggtgttcaacacaagtggaatttataacacaaggagaagataaaatgctagccagttggaagtaatacaacttcttatgcgacacgaataaaaatataattatcagttgaaaaacaataacaacaaactcccaccaaattaaacaaaatcaaaagctctcaagaaaaaaacaatgtgccacttattttaaagcagaaacatgcataacgaattcttcaagcttatataacgggctttttggaaagtagactggaggcacattatttcacataaatgggtgtcttaggaagagatggagacacgtataatggctaaaaaatgaaataaatccatagagaggtttttagtgtctagtgataaaagtactaataatattacgtaattaaattccaaaaaattaatacagaaaaatattcttgatttgggggtggtaacagatgattaagtaaagcgagtctacatgagctgctgatgcagtggatgacaagctctctgcagctcattgttagtgagaaggcactgctttgccagaaaccccttttatttagatttctcatggtccctgggtccctctccaacaccatgagcagcttcagaagaggatcaggataaccagtgactctctggctaccatggcccagttgtgtccgagaggtaagaaaggtttgggatcttggacagagtgggacagtgggagaaattcctgagatggccccaaccagcctggaaaccactcagaacctgcattgaagtttagccatcagggtgctcttgagactcggtttgggctgcaacacagacctgtggggacaggggtcaccataagccaggccacctccacccctgggtcagctcatctcctccctctctgcttcagatctttgagtaaccagcacatggaggcccgggaaaagtcagagagcaagatcttatttaaatgctgtgactccacccccatgaaggctttgggagctataaaaaagagacttaggggagcccagtctccaaacagagcttcagcaagcatagtgggaatctgcaccatgccctgggctctgctcctcctgaccctcctcactcactctgcaggtgagagtggaccttacccagggatctgcacccacctctgctccagcttctccactccctggctcagtggactctgatcctgctctcacattcctttctgtcccctctacagtgtcagtggtccaggcagggctgactcagccaccctcggtgtccaagggcttgagacagaccgccacactcacctgcactgggaacagcaacattgttggcaaccaaggagcagcttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcattggacagcagcctcagtgctcacacagtgcctcaggccagtggggaagtgagataaaaactcaagagctccctcggcctcactgaacaggcctcacagagcactgtttaaactggaccacccaaaagacaagggatgcattcacaatagtgtacactatttaggactgttaaaaataggaacatgaagtgaaattagcaagcctgccttattaacaaatgtgtgtagggaacatcattgtttatatattagtagttacatatatataatactagtgcatgaacatacatatgcactagcaattagtaaaaaagaaacactaggtttaactaaggaaatatttattattccagagttttcttatccattccatttgaagatgctgggatcaagtcaccgagggtgctgctctctggccttgagaatccactcagcagggccaccagcagcccctcccttctgtggcctgctcatgccctgtcttctcattagaatccccttccctgctgtcacagggatccctggactcctccagatccaaatatgtccaatacatttggttgaggcctcctgggccccacattactgtgtaatctcaacacccacacactcaaaacagtgttcccatgcgtattcttctttcgactcatcactgtcctctaacagccatgggcagtgtgtggagagagcaggtgaagttggagctttggggtacagttgacagagatgttgacattttgagaaaaagaaaacacctatatagctgttttcaggataattttccatcaagataaaaatccacgcatgagagcatcactcttccagtgatgaatgcatggaggatccttctcactctattgttgggtagtgacacctgggaaacttactgtgttatttagtgtgcagacagctggtaaaccactcagctgactctagggaagttgaccaaacagtgtccccactgatgtgtgacttttctccacccatgaggccccactaccctgtcacctcctgagtccacctttcccattgcgttgctttagatttgaggcatctctctcttacctctttaaagtctttacccaagtctggttcaggaagtgctgatacacggtgagaacccagggtgcatatggatggagtgattctgtgcctaggagagcctggccaggggatccaacacagcttgtggccatcctccccgcagtggagcttctggagacagagctctgaggtgtccccaccacaccctggggcctttctccctcagttctttataaaagggatatttgtcatgggcttaggggaagaggccgctgaggtcacacaagacctgccttcttgctctggctcacaaggcacaagtgagctgtgaccctggactctgtgtcagtgctgtggtcacttggtcagaactaagggaagctggagaaatgtgggtagctttgatgcagtctggcaccagaagctccatcctgaagcactctgaaggtgctgatggctgttcactgtgctgcaccctgagcaggaggatgatcatcatcgcagacctagggtgacagcctcagagctgaaatattcctcctggccctgagaaaagtgggctaaagttctcccttctgcgtgtgttacccagtggtttgcccccctttcatcacctgtgaccaacatgggctcattggggatatttgtgctgtcatttctggcacaagaacccaaagatctaagaccataaaatgcatttggtctttcatactgtctattcccatcagggcagacatctatccattaatacattttatttaattttcttgtcttatattttcagagcaatgatgagtaatgagtgaggtaaggggtacctttgcatttttttgatctcagggaaaatgtcctccatgcagtaagatgatgactccggaccaagacaggtgtgtgtgtgtgtgtgtgtgtgtgcgcgcgcgcgcgcgtgcgcgtgcacacgtgcacacgcatgtgtgttaccatatcataaacaaatttatctgtttctgtattcttacgtgatttttattagggatagatattaaaatttgccaaacacattaaaaatctattgatacaatatgatctttggttgtgatgtaataatatggtattataccaaaacttttattaatgttgaacccaaccattattttaagtataaatcccacttgacaatggtgtataaatgcgtaaatctggtgttgaaatcagttcgttcctcaaatttcctggttcaagtgatcctcccacctcagctccttgagtagccgggattccaagtgggtgtcaccatgcctggctaattaaaaacaaatcttatttgtctcaacatattgcccagtctggtctcgaactcctgggcacaagcgatcctcctgcctcagcctcccagaatgagttaacattttattttaaaattttgcattaatatgtttattttattttttatttttaaaatttttaacttttattttaaattcaggtggtacatgtgcaggtttgttacaagggtatattgtgtgatgttgaagtatacaattttatctttttaaattgctcttaatacatatttttaatttaaatttcaacttttattttaaatatagcaggtacacgcgcaggtttgttacatgggtgtattgcacccgggttgtgagcattgtacccaacaggtagttttttacaccattccctcctctccctccccctcctagcagtgcccagtgtctattgttctcatgtttatgccatgcgtgctcaatgtttatctcccacttaaaaatgagaacacgtggtatttggctttctgtccctgtgttagttgcctaggattatgtccccctgctgcatccatgttgcttcaaaggacattattttattcctttttatggatgcatagtattccatggggtatataaactatattttctttatccaacccaccactgacgggcacctaggttgatcccatgtctttggtattgtgaatagtgtggtggtgaatatacaagtgcatgtggcctttgggtataatgatctatttgtctttggatagataccctgtaatgggattgctgggtcaaatggtagctctgttttaagttctttgagaagtcttcaaactgctttccacaatgcctgaaatacggtgtatacgtgttttctttactctacagcctcaccatcagctgttgtttttttactctaattatagccattctgactggtgtgacatggcgtctcattgtggttttgatttgcatatcttgatgattagtgatgatgagcatttctccacagttttgttggccactaatatagtgcagttttaagttcatagcaaaatacagaagaaggtagaaagatattccctatcctccctggctccacacatgtccagccttcccccttatcaacgggtcccatcagaaatgtacatgtcctgtaattgatgaaccacattgacaggtcattatcactacaagtcagtattttccttaaggaatttttctcgctgatgcacatcctatggctatgggtttgtgcaaatatataatgacatatatccaccattacagtatcatgcagtgtatttcccttccctacaaatcttctggctttactgattcatctctctctctcccctaacctttggaagtcgatgacttttctacttttttcctttgtttgactgtaatacacttgaaattatttccccctttttggactgtaatatacttggaatcacgtatcatgtcatttgcaggtcagctccttttacttactaataagcatttaagtttcttccatgtcttttcgtggtttgatagtgtgttgtccataaacatgtagaatatattaatataaagtactttggagctgatcacatcactggccattcaggtttttcaattactgtttgttgaatgacagtgaccagtcagatgacaggaagtcttagaccccctgagaacacagaagatggactgaggatgtcagggtcaccgaggactgcactgggtgctctcatggagggctcagtaggggtgtcctctagttccagtgagcctggactgtgatgggcactcagagaagggtcctctctagcctagcagagcccctgctcacaggcctaccagctgtcccagcagctttccctcccaggtccttccgtggggcagacagagtctcactgcctgttagcccttcctacccacaagaccctcagcaaaagatccttattcagtgctcagggagaggtggggcagatagcagctggggccacacctgcatgaccagctcctcctcgctgaggcctacagcaggtaataaactcaatccatcccactggaccaaagggagctgtgtctaccatggcctggacccctctcgtgcttgtcctcactccctgcacatgtagggaaaaggcctagagacctggggcagttcccagcttgtgtcagcccctctggctcagacttgccaacagcttaaccctgacacctgctccaacaatgtaaatgtttgcatttccaggttccctcttccaggctgggctgacccaggtgtcctcactcccagcatcttcatgcagatcaaacactcacctgcactcagagcatatcggctttcatatcggtggcaaaaataccttcttttccctacagaatccagggagccctccaactatgttctgagattatgctcaggctaaaatgagtaccaggcctctggggtccccagacaattctctgggttgagaggctcctccagagtctcaagttatttggtcgtctctggccttcaccttgaggatggagcagatcatctctctcagatgggctgacagggcatggcttacactgtgctctaggccaatgggaaaatcccctctgcttgtgctgcctgggctcccactaggcccctgctgtttgtgacaacagccagcactggtggtgacgcttcagccatgtatgccctacggtgagagtctgcagcccttccacgcaactatcacttgcagaatgtctgcatcattgctaatagcacattctgagcctcctcacgtttctgtgggcaacaatttccttcccaagacgtgcacatgatacaggagatttatttaccaaataagtttattaggaatccaattataattagaagatattcatcagtgatcgggggaaatacctggtataattaaaatagaatttgatgaaaatataaataaagaactaaattatgaaggtgtgggcagagagtctggacacc

SEQ ID NO: 911 - DNA, 257086 bp, Homo sapiens
ctgtctttccattgtctcgtgacatgacaccattgcttcaaactcagactgtccacaggtggctcctgtctctacctgcactgctctcccttcctcatttgccttctcctggcactcggaccactggtaccaccttaggccagctgggaggtaggaggtgtgctgccccctcccccacaccgccactctctaccctggtttcattcatgtcccctgtggcgtctgcccccttgcctccctgcaacagcacctgctgctacctcttcactcctgtcctggtcccatagcaatggagctcatcttccaggtggccccccatccccacagccagggcaggcagaggctgaaggagcccccacattgccaacagggcctgcaaccttcactgtcgcagctcgcccttccctccctggaagcacaccgggtatgggatgagagcggtacctaattcggcctctgtggcagacttcatgggggtgatggggggatggtcgccggcgtcatggcctttccgcgggcggttgataccttctgctaacaaccgcttcacctgagggagagaagacagagcagagtctgtggctgggctcggctgcctgcctgggtttggctgacgtaccagacctggtcccaaggcctcagtgacacacacacatgctgaggccggcccggctccactcaccgtgtcggcccagtaggggtggttggcctgctgccgcagagagcccttcaggtcaaagttctcagggtagtgggtggtctctgtccgtgggtagctgatgtagccttgcgtgtagagccgctcagccgtctgcatggcgtgctgcggccccatgcctgcgagagacaggaggttctcagagggccaggtacgtggggatggccagctgcctgccctggcctatgcactcaggctcccccattgtggccggcccctcctggagggtgacggtggctctgagcaggcacagctggagtgcaaagctgctggccgggtgggcacctatgccacacagtcttgtatgaggctgaatcccgcacccgtaaggctgaatcctacacccaggatgggcctgatgggaaacgccactcactctaccccacggtgcatcctcatggggctcatggccatggggatgacacatggccttcagagcaccactccccatgcattgtccatggagccataaccatacctcggggttggctgacgacagagttagcacgcagccccattttgagcccttgggtgtttctgtcctcacagcactttggggccactcaggggggctcgtcctgctactccctgaccagcagaggcaggcgcttagctagcaaccactcccagcattgctgccctctgaggacgctggagccaccactcagtgtccactgagaggacactgcccatagttccctgcgggggtggggggcaccaatgcctaggggctgacagctgccagagaccaccagctttccagcccaaccccctcctcgttactaaggagaaaagactgaggagatgaggctgaggggcgacgttcacactggttccctgaaggtgacatctggctggggcctctcccctcaccagggatagctgctcagggactctaacatcaggaggtcccctcaggtggtgaccaactttaccacctttacaacctaaggataagtgaaatcctcctgaggctcagatccccttgaagccttgggcaccatcctgcaaccctgggcactcgctgctccaggctgaacctgcctcaggaagccttctggtgacttgagagaaatgtccctacatacccagagaagagctggccacacgcagcatctccacagtgttcagggccaggggcctctgcttggccttttctttcctgcttgtggcctccacctggaagacaggacagtcaatgatttggggaaggaggaagacaccaccatagagggaatcaagatgtgtggacgaagggtctggtttcattcatctggtctccctgtttctccaattcattcttcccaacagtctaaagacttgattgaatatttattcaggaccaggaaaggaaaaagaatgaaaattcttttttaaaaaaaaattttggctgggtgtggtggctcacgcctgtaatcccagtactttgggaggctgaggcgggtggatcacctgaggtcaggagttcgagaccagcttgaccaagatggtgaaaccccgtctctactaaaaatacaaacattagctgggcatggtggaacgtgcctgtaatccaagctactcgtgacgctgaggcagaattgcttgaacctgggaggtgaaggttgcagtgagctgagaccacgccattgtaatccagcctgggtgacagagcaagactccatctcaaaacaaacaaacaaacaaacaaaaaaccaaattttgttttttttaagagacagggtcctgctctgtcgcccaggctggagtgcagtggcaccatcagagcttactgtagccctgaactcctgggacaagtgatcctcctgcctcagcctcctgtgtagctgaaaccacaggcacacaccatcatgtctgaccaattttttttttcaatttcttgtacagacagggtcttgctatgttgcccaggctagtcttaaatgaactcctggcctcaagtaatcctctcgcctcagcttctcaaagtgctaggattacaggcacgtgccaccatgcccgtctactttttaaattatttttttcagagacagggtctccctgtgttgtccaggctggtctcaaactcctggcctcaagtgattgaatattcttttctggagaattttctagggaaagagaaaacctggaagattgaggaggagtcagaagggctgcagatggaaatcctacagaagccagcatcagccaagctacagggatggcaagtggggcccgtcccaggggaagtaccactccttgttgtggggagggctgctgcctgcacctgctagtattgctacctcttctgatttttcaagagaagctagaaggcagaattttagtatgaaatctcgtaatttttaagtgctggtaactattctggaatttgtgtaaacaccatgcaggttagtggagtgcatctatgagctgtgctttgttggggtcctgccactctctacctctgctgaacacttgtcggaagagacaactctttgttttgcctatggcaaaaacaatccaaacaactcaaccccaggccctggcccttgccaatcccacgtaggctggtcagggcagtgccttctgcattccagacagacagatgtgggtgctaacagaggccagttgttatgtgaagctgggctccccagcgtgaggcctggaggtggcaacagtgtctctgcaggaatgtgatcaatgctgacagcctggagcagctttagaagtttcagatgcctgagacgatagcatggcgggcaacagggcactcaaggaaggccagagaaggacaaggagaaggcggctaaggaggccaggctgtgtctcgacggatctggtagctgtcatgcctgtagcatgtttacttcaatagccacagatgtgtccccaacccatgcagccaggtcacctcaccgttttcctaacagccaagcagcatgtcctttcaattcatagaagccctgagtaagaaacataatcccataaaagcacgcaagctgattgcaattggaatctcaagactttcccctgctagctgtgaccttgggcaagttcatcagtgtgcaccaaggtccctctacagttgttagtttgaatctctgtgtgaaatggagtcctgccacacggaggtaatgcctagcgggtcacgtggaaaggggagagtggaaggggtccgacaaggtcacaggtgtggacagtgcctggtatggagcgggcatgcagtacactgtgactattgcactgggcagaaatatcttaggagtatatgagggagtaaccattcagctttccaaaaagatgtctgtgtttcagaaagggggagaaagacgtggactaggatcacaggctgttcctccagcgggaggcatccaagggccaccctcacccaaggcaactgtgatagatgtgggtggagcaggcacacctgggcttccttctccagctttgtcatgtttaaaaacatctgtgcgatctcccggtcaaacactcttactcggtcccagtccaaaaggagagatctgtctttgtcagtgttaacctgcaggaaaaaggataaagggtgaacgcacaagaaaaagtctccaggtgagcccaacgccaggaagaaccaggacagatgaagctggtccttgtctgggagccaaatagccctggctgtaatggctcacagctgtacctgttcaggtgggcagatacgcaagctgacatctggccctctccaccacttgccccaaaaccaggcagccagtctcaggaaggtggcccaaagctgaggctgatgtgtccctaagaagcacctgagcccctacttctcacaccacccctgcctatccccagtgcctggccagtggtaggtatggccaccgccagggtcccaagccccgtgtcagccacagcagctccaagacagtgtctcactgtgttgctaggctggagtgcagtggcacgatcgtagctcactgtagccttggactcctggcctcaagcaatcctcttgcctcagcctcccaggttgttgggattacagacatcagtcactgtgcctagctgtattaagtcttacagtgagcttctgtggaggcttttatttgaagaaagggttctaggaattttaaaaagtttgaaagccaatggtctcagtccagtgcttggacctgaccactgaagccactgattcctgtggggtgacctcaccctgcactgccagagctgaactcattcccacttatccagattcagcatatacaggcccagtctcttcccactgcccccatgaaggctggggtccctcagccctaggcaccacagaccacttccaggtacagccgtccacacttctgccctcagcccggggcctgccggctgatgatgatggaagactctcagaatccatgccccaaacccagaaagccccagcatgaatagagaaaggcaaggaaccttggcctgcagcacccagtaggtctctggtttgaaggactggattttatcatgtctctccacacagaatcccagggttggagtctgacacggcccaaaggagatgagagagctgtctaaatcaccgtatttcccctggaaatatttagtctgaaacctggagggagtggaaagatattttggtcactgattcactcaagacactattatggccacccatgtgagtccagcccaaggccaggggtggtgcatgaaggaggtggcatcaggtggtgtccccacttagaagccagtgggagcagagtgggcatagccttagggaggattcatgtgtgtacatgggtgacagagccagtgagagaggagacagaggtttctactgtctcaggccagggagccttctattctattccatctactgcacactctcctcaggacccccagagcacagacaaacacactttatcaagcagggcatatgtgatctctgtcagctaaataaacaattttctttaggtctcttttgtttttgtagagacagggtcttgctgtattgcccagcaggagtgcattaatggggattcacagatcattgcagccttgaactcctgggctcaagtgatcctcccacctcagcctcccaagtaactgggactacaggctcacaccaccacacccagctaattaaaacaaaatgtttggacaggcacagtggctcatacctgtaatcccagcattttgggaagctgaggtgggcggatcacctgaggtcaggagttcgagaccagcctggccaacatggtgaaaccccgtctctactaaaagtataaaaattagccgggagtggtggcaggagcctgtaatcccagctagttgggaggctgaggcatgagaatcacttgaacccaggaggcagaggttgcagtgagctgagattgtgccactgcactccagcctggatgacagagtaagactctgtctcaaaaaacaaacaaacaaaaaaataaataaatttttgtttagcctgggcgcagtggctcacatgtgtaatcccagcactttgggaagccaaggtgggcagattgcttgagctcaggagtttgagaccagcctgggcaatacagtaaaaccctgtctctacaaaatgcataaaaattagccaggcatagtggtgcacacctgtagcacctgtagtggaaggctcaggtaggaggatctcttgagcctgggaggcagaggttgcagtgagctgagattgtaccactgcattccagcctaggcaacagaacaagactctgtctcaaaaaaataattttttttttttttttttttgtagagatggggtcttgttatgctgcccaggctggtctcaaactgccaacctcaagcaatcctcctatcctggtctcccaaagtgcagggattacaggtgttagccactgtgcctggccttcttcagggttggtgaaatcccctgttgctcatcctggctcgaggaggcctaggggccccggagggggaccagtagaggcaggtctctggctgagggagagtgagggtgtgcccaggactctgcgggtgtggccagcacctggtgaatgcacagccgattcgcaggtccagctcctggcgagcatccactgagagcgcctcgttgtggtcaggctcgcctaggcaggccatggcattacagatgtctgtgtccgtgatggagctaaacctggcccggaacacggtcttctcgccaccatgggccttgttcatgacgggcagaacagcatcaagaacctgggggtggggagtggccagctgtgacccacctcccagatccctgccacagctccccaccccactgtgaagcctggttccttccaggaaagaacacgtgtgctcggctccctctcctgcccctgccagaccctcctctatcccctttcctgcacctgccagaccctcctctatccccctgcctttccagaagccctgagcactccacaacaccccaccacatggcttcctttactcccatctagaaacatactcgaacactcccttcttactcccgccctctcttctaatcctctgctttcatccccaccaaatcaggaaatgctactgccaagtacatgagggacctcttagtccccaaacccatcccatgtgacacgattccctgccttctaggagggagggtttggaggggtgggtggaaattttaagaggctgaagaaaagacagggaaggaaaaaagaatgaaggggaaaggaaatgggcaagagcaggaaggccacgggtggtcctagcttgtggtgggggcagctcgggctaaagcacagcaggggtcctggagccgagactcactaggaaggccgtgcagtgggactagggtcgccgccggagcctggccacgcagcttccttactgggaataagtggcttcatttctgaagggagaaagccccatgagctgcccccattctccattcccagatgcaaaggcccccagggaggagccgccctgcaggggaggagagggtatctgggaagagacagagtgtgatcgcatttgctgagggtgctgtactgcaacgccaggtgcctcagctctgtctcactgaccagctcttgagccacgggtgagagctgggggtacaggagcacgggggcgacccatagaacaacagtctgaagggcaccaagtgagaccagcagtcatggccactgtgagggcaccatggccggggcaagcatggggcatggggtgtgcacagggagcagctgccacctgcttctctgcagggctcccagggttggctggaggcaggaggcatcctggatgaggcaggagatgagcagagcgaggcctgcaaaaggagctcagtgctgaggtcgggaatcaaccagcatcaacccaaggtccctgagaagtcacgctgggcacaagatgctgaacaccaagctgccccaagacaatcccattctgaaacctgcatccacccagacaatttggcccctcctatgttcactcataccgttgaggcctcagcaagcggaggaacaactgaccacctttaatagagcctatgcagttaaaagtatctgtggagtttcagaataaagggaggggagaggtgtttttaaaccggtacagtttactccctcctttggccccaggagtgatgtgactgactgctggtgtcagtttggggctggtgtcagaaaggccaaaagtgaggaacaaagtgagcctcacactcacctcaaagcagatgttctccccctccttgtcgcagtccagccacagcacgatgtagtcgcagcctctgccctccacctgccacacagcacaggttcacacgtacctgctgcagacccggtctgtgccacccgcccccagtgctcccatccaggacagggcttggtcccaggccctgaacctcagttaggaggactggtacctgggctgggtaaggagctggctgtgttgaggctggctcagccaacagaaaagaattgagtttataattgatgttttttggaccaaaaaaaaaagtataaatgcaacatgatcttataccccaaaactgcccagaagaagggttaaaatgaaataaccctaaatgataacagcagtcgtcttgggtaatatgattatgcataatttttctgtctttctacttatctgcactttctaattttccataatctgtatgcatttgttttaaaattaaggagaaaaaccccccgaccaaacaagctattttaaaagcagaaggcctgctctccaggactgagggttggcaatggcaactgccttgtgtgttgggggtgcctgcaggtgcctcgtgggccagcagggggcactcacagaaaaagctagcaaaggcccccctgtccaagggggattaggactcaagcaagggtgggcaaagacatggcagctgtggagggtggggagccccggtgtgctcatgcccaggccagccccacgcacctgcaggaacttcaccatgttcagcttggggttagcttctttcttctccgtgggagcttggctgaacagttctgcggggtccactttgtcccatttgttgtattttcctacaaaccagtcacagtgacattgagtcacaggagctcagcctccgagaccatcataaccccaggaggatgttggcctcatcccacaaatgaggaggggaaagcttggagaacaatttgcccagggtcatcctgatgatcagaggcagagccaggatgtgggttcaggcctttggtaaccccctcccatccagcctcctttctgctcggctgctgagcggacccaccacaccccggccaaccacaggagccaagcaagctctcggggggctgccactctggcctcacttccgggactttccctgtggctgggagcaccattcctgggctgggtctctttgcctgagcactggaccccacaatggtgccttcattgacacttccaacctgagtttctggaactttgtccttccacccagcactctgtgggggcacacatgtgtgcagtcgttcctgttaaaggaccatctttttgagcctcatgcccagcacattcacctactcatctacagagacccggttcttgcatgctcagctgtctggctttcttttaggccccatttctttttttttctgagacaggggtctcgctctatcacccaggatgaagtacagtgatacgatcacggctaactgcagtctcgacctcccagcctcagtccatcttcccacctcagcctcccaagactacaggtgcgcaccaccatgccagctgatttaaaaagaattttgtttttttttttttttgtagagacaggggtctcactatgttgtccagactagtcttgaactcctgggctcaagcgatcctccccaggccccatttcttgcatcctgggagaatggggtcagacagagccaaattcaaatcccggctccccacctgccagttggagataaaacttggggtccaaatgctcagccacacaactcagtcaccatcattgtcatcactgtcatcaatgagcagcaagaacaagggctgaggctttgctgtgtgtcgggccctgtgctgagtgctttgccctcactgtcacactgaatccttagccttgggaagcagatggcattgctgtgagacccatttcactatgagaagtgtaaactcagaggccgtcattgcccacatccccagccagtgagccggcagagcagggggaaaagcctggatcagactcttgccaaccacatggccccaaacctacacccagcaggtcactaatactggcgcttccaaggtaattgataacagtaacaatataggaatgacaacgacagccaccaaatgaccgacagatgacggtcaacttggcaacagcagcagccttctcttaaatgcctgcacaggtcaagcccttcctaagataggtgctgccactttgtctacataggaaggcacacagggaatgcagcgactaaggggtgccgctatgatggggacccagggctgagttccagagcctgggttctgggcaccgcaccagggaccctctcattgctacttcatgatctgctggccttatgactcatggagttgggacaaacttccctgcctagaggcatctcctggcttcaactggaccctggccagtgccatgcagaactcccttcagtaggatggagggtagaggggcttacccaggaaatccagggtcatcacgtgaccacagacagacgtcatcttgaagcgcactggctggccagcaaaggtcccagtgtactcgtggactgagcaggccccgttcagccctttgtgtgaggacaggctccctggggatgaggaagcacaaagtgactggctgcttcagctgagctgaagaccctgtggagaccccagcccggatgccacctcccagagggccagagtcctccttccccagagtggtgagtgacgacattccgcagactggtgcgggtagttgggcactgagaggtgggacggcgctcagggaaaacagcatctgccaacaacctagcacagagcactctcgatgcagagccccaggctgccgggagccaggagcaggcaggggtgggctctttctctgtatttatgttttcactcttcaattccatttttgcctcacttcattgaaacgttattcatcgtttactaaaacagactccagatctactctcggttaccagggaccttctaattatcgaattctcaccctctccactgaccatactcagctgtactttctcagcttctgggcaccgggcaccacttttggggcaccgtcccctgcggaccatgccttctcagctgaacgagggtctcttcccctctcaactgctggaccaaggggaggccaggtaggtgcctgtcatttctgggtacccagcatctaaaactcttcctatttggagggaattcaaagatagggggaaacagcaccctaccaaccaccccagtggccagagttgggggtgagtggcagacattccctctcgagctccctggtgtctcagtagtgcctgtggccatagctcagtccattggctactctggagtgacgtgaggtccacaggacagtgggagtatccaggggtgacaatgcctggggcatagcctcatcagaccttgactggggtgtagtcctggctgcgtctccttccttccagggctggtttctactacctgtacctaatagccccaccaggcccagcatatggataatgactgtccttcaatttcattgtaaattgtgccttgtgccttatgggaaccccagctttggcacattgccaggagtggaagcaaatgcaccccactgtgacatactgagatgcttcattaccacctgccgacccgaaccaaatctaccccagccagggtggaatcacattaggaaaaaatgtcctgtaacacataaacgaccgtgcttacagaccaaagcagggctggtctctcctacctctagagaggattttggcaattgactgtgccaaggacggcttttcagcaaccatgagcacagtcttcattttgtctcggtccttcacactccagtttcggggcactggcaatgaaaaagtttagactccactcttccgcagcacagcactattaccaatgctgactcctaaagagaagaaaagacactcaggatagcaatgctgtcaatagaacctacaccactacaaggaaaatcactttaacaaagaaaaaacaagaccaacctgaggcaagaagaagaaaaattagggaattagggaaacttgaagacatctgagattaaaaacaagaaaaaactaccaggtcagctgaagtggctgagatgatcctgggaatgtggctccatttgggggaaggtgaagtggccccagtgatctcaggtcaattttattcctaaatccatgctaggaagatgctggggcctggggatctggagtgatgggtcaggccaggtggatgcctggccctcctctctggactggctcttccacctacaggtggactcacctggaaagaggaactatcgtggccgagagcagcacctcccgctcagcaaagcacttggacgccccaggacactttacaaaatgcagatgcccaggctgggccccccaggtccttctgatccatgatgggcctgagaccctctggctagtcggtccagccccaagcagacatcaggactctgtcacatctatctcccacctattccactccaccttttgctttgcaggtcatgctctggccaaattaaatcaaatatcatcatcgaagcaaacacgcacttgaagcctctgtgcctgcgcttccctgcctgagagaaagctccgccaggcctggaggatgcagctggatggcccacaggcccagctcaagtctcccaacaccactggcagggtaagtcagccctcctgtgcccacagctcttgggctaggtctccattccaacccactcacatcatgccatcatcagcgactacttcacccccaaaataggacacgatgggctttgtgtctgaatcactgttggtctttgcaacagctttctgtgcctgacacatgacattcaatacctgctagccaagtaaaagaaaaccacatgaaccctttttgttttttcagtcattataaatgtagcactgatgtttataaacatagcaccgtattaaaaaagaaaaaaaagactcgtattgagacaactgggaaatctgctgtgaaaaaaaataaagttagactcctgcttcctaaatcccactaaaaccgattccagatctagcaaaggtttgagtagaaacaatgaaaccagaaaatattaggaaaaacatgtgcttttaaaataaatctcacaagccaggtgtggtagcacatgcctatagtgtcagccactcaggaggctgaggcaagaggatcgcttgcttgaggccaggaattcaaggctgttgtgtgccatgactgcacctgtggatagaacagccacttcactccagcctaggtgacagcaagaccctgtctcaaaaaaagtaaaagcaaaataaaataatctcagcataaagaaaaactaccacctagatgggcacagtggctcacgcctgtatcccagcactttgggaggctgaggtgggtggaccacttgaggtcaggagttcaagaccagcctggccaacatggcaaaaccccatctctaataaaaatacaaaaattagctgggtgtggtggtgggtgcctataatcccagctgcttgggaggctgaggcatgagaatcgctcgaactcaggaagtggaggttgcagtgagccgagatcatgctattgcactccagcttgtacaacagagcgagactccatctcaaacaaaaaaaaaaaaaaaaaaaaaagggaaaaccaccacgtaagtacctttgtggtatcacatcatgtccaacaacactcgcagaagaaactcagaactacaatgagcttgtgcttatcacatagggagagactcaaagtcgttgcacacacagcagatgagggcatggggaagttaaatgggaacaacctctatgtgcagcaattcagggatccctctcaaagtccgagtgcacatcccagcaattccactccttggaatgaacttaatagtccagttatttattgagtacctactgcatgcttggcctagtccaggatgcagggaatacagcacaaagcaacaccaggtcctgccctcccagaactcatgctgtagtatgggagcaggggagggacagggcagggctgggtgacacctgggagaagagtccaggcagaaggagcagggaaggtgaggtccttggggaggatatggctgggcaggggggctcatggggctgagggagggagcaggggtgtagaatgtgggtctgctctaggggtgctgggaggcagcagagggtttgcataggtgtgggataatctgacttcaagtgttaaagggacctctctggctgccacatagaagaggatgaatgggccctgggtagcagtggtggaggatgcgagggaagtcagaatccaggcagacctgggatggcgggacatgggagggggaggggaaggtgagtcaagaatgacctgaggcagagctgggcatgggctcacacctgccatgggctcacacctataatcctagtgctttgggaggcgaaggcaagaggaccacttgaggccaggagtttgagaagagcctgattaacacaatgagacctcatctttacaaaaaagcaaaaggaacaacccatggctttggcttaggcatgacaggaagggactggcagtctgatgtgggacttcaggtgtgttaaacgggacctgcccattggacagcctgggtggcctggaggaggtggcagcaatgtggaaggagcccaggctgggggtcgggagatgaggagctagcagggtgagtcaggaggggtaaggtcctgaaagccacaggaaagagcacttcagggcagttatcaccatgtgggggacactgacaggccaggcgagatggcagctgagacctgactgtagggtctggcaaacagagccctgggtaatcctgatggggccatgtggtgagtgacagatgaaagctgcatggggtgagctcaacaaaacctgggagatgggagaaggctggtgcactgtcccctcttgtttcaggatggtggctgtgccagcatgttctccgctgatgggactgctctggcgagaaggaaaagagaagctgcgtgccggaggggaaggaactgctgcagtgatggccttgggagggtgaggggcaagagaggcagccggtcagcatccaggcgatgcagagctgccacaaggctgcacttctcttggtggaggaggaggcatggtacggctgtccactgagggaggacaggtggtgatgctgcgggcaggcccacagcagaggaagcactggatttagttagatgggagagtccaggtgagtaggagggagagggagtgggtcagggttcgaggggagagattacaaggacagaacctgactctgagttgggtgaagagggaggtgagggttggggagggtccacagagggtgtgctctgtggggtccaggaagtgaggcacaagagcaggaagtgggagtcaaagaagcaactcccagagggtgggaggctcaaacaggaattacagaggggcctgggtggtggcatgctgacccagggagggcaagggctgtgagacaggtagagagtgaagtcacctggggagactcacaggagtcagtggtgggccctgacaagactgtccatgtggactctgagtccccaggaggtaggacagggcagcgctggagtggcctcaggctgggcacggtggtgcctgtgatgaaccacatcactggggagttctctgcagcattatcaatcatgataaaaggttagaaacaagctggtgtctgtcaacagggaggtggttaaataaaagcatggcattctctggccgggcgcggtggctcacgcctgtaatcccagcactttgggaggccaaggtgggcagatcacgaggtcaggagatcaagaccatcctgactaacgtggtgaaaccccgtctctactaaaaatactaaaaattagctgggcatggtggcaggcgcctgtagtcccagctactcgggaggctgaggcaggagaatggtgtgaacccgggaagcggagaatggtgtgaacccgggaagcggagcttgcagtgagccgagattgcgccactgcactccagcctgggcgacagagtgagactccatctccaaaaaaaaaaaaaaaaaaaaaaagcatggcattctctacagtagagcacctggcagcattacaaaggaaagcatctgcttggtacatactaacgtggatcagatcactgaaataaatcatgctaagaaagctgggcatgtaacggtgtgtagagagcactgccatctgtgatcacacatatgtgtgcacacgtgtgcacttgattatgaagaggcgatatgtctggatggaacgcaaaacaaacagtccaagcaatcacctggagtgggtgttagggcctggaggtcagggctgggggtgcctcctcaccacattcccttttgcaccttttacatttagcgcctggacacaggtgactgagggacaagaactaagacaagggactttacaataaaaccagaaaaataaaggagggttgtaaagggcattgttcagaaaggatgccaaaggaactccctcactaaaggggcttctgctgctcatcatgctgtgcaggggaagaggtccaaggtcggccttgggctgtcaaccttgttccccacttaagagatcacaggactacagtgaaatcagtaatcttgaccagaaagctgtcccaaataaaatgacaatttgcttttttcctcaaaataagtaagtggatgttccccttaaatgtacaaccatcccacagtgaaagagccgaggccttgtggaatgacgacactgtctgcagatgagctctctggcccatgacagctccagctgcatctcccaaggctctgctgcgcacccacctttcctccctgtgcgccagcaggcttcggcctaggccacttttcccccttagtctacttgctctgacccctgcccctcccctcctgaagactgcatctggcgtcagcagtctgtctctcccacaattgtcaggttcattgccatatttctggcacccagcatgcactaaatgcctgctgagggaatgaatgaacaaccaaggtgattatgactggcctctgctctccgttctggggaagttttgattctaccaaaatcagaggcccagaagtgaggtttaaaagagatttagggactccccttctctcaccctgggaagccagaggccaaaagggaaaactcgcagcagaggggcattgttctgtgagggtctgagtttcccatctcttccaaagtaggaaattttgtcctaaaatgtttcctcagattttctcatgtctatgccacagagtagtcagcaattatgtatgacataatgaggacacaccagggaccaggcagtcctgccagcatcctaggcagggatgctaataggtgctgccattttattggcctagactgggactgtggggtcagagagaccagagctccagtggctggacttggttgttctagaacccgtgccccaagcctgatcctgtcctgcctctgtgagcactctgatggaacagcagcccagctttgcttccttgtagcactcatcactacacttggtacagcttccatctacttattcagctcttgtcttacagctcctagaaagtaagtaagcagcaggagaacacgggttttgctttgtgcattctcacggtaaatagacagtgagcaaatactttgcgaggctgaggcaggtggatcacccgaggtcagcagttcaagaccagcctggccaacatggtgaagcctggtctctactaaaaatacaaaaattagctgggcgtggtggcgcatgcctgtaatcccagctactcaggaggctgaggcaggagaatcacttgaacccgggggcggaggttgcagtgagctgagatcgcgccactgcactccagcctgggtgacagagtgagactctgcctgcaacaaaacaaacaaaaaaagaaacaagcagatgtggcctgggagtaggcctagcagtggtctgaatagcattaaaattcctaggatttaccacctcagtaactttaccaaatgcttctagaatcaggaaaagagggaaacaaccatttcttaagctcctcctttgtagtaggcacaccatagctatcaacactattcaatctcgccagcaaccccataaggcaggtgttgtaattttttaaaactgtgagtaaatggaggttcagaacaagtcacactagtgtcaggtgaccttggcaaaagaatcccaggactggctggccatcaagcccaagttaggctggcctctcaggtcctgtttcaaaaggtgagaagataaaaaggcaagactaggaacatcttacctttcacttctgcgagaaattattgcccctggattccagctaatttgttcacaaaagtaccctacttcatttacagataacaggtcagagaacctgggtgccctcaaaacccagccagggcctagggggcggcgagtggaagctgcctgggtgtgtaccgcaccgatctgggccccggtggctgcacagcttccctgagcctcagtttccctacctgtgagactggtacagcagatctcaccctaaagagctgtgggagggttcgaagaagaaaagtattaaccacagcgcctgctccctgcaggcacatggcgggcccatctccacctccctgaacccccacagcaagccccgcgggagagtatcacccccgccagggaagaggcaacaagaatgcagagcccggcccgggcgctctcccgagctcgcgggtcctccgccggccaacgttcaggaaacaagccagaaaaatgcgtgcgcttcccgcctttctgagccgccgggcgagggtcccgcagcccgccgctcacccacagccgcaccgcggatccagctccggtccttgttcccggggcggctaccgacaacccctatttccgggtccagccgcttctggcgtccccgcgtccggtgtgccagcgtctgccctccggctccggcgggtcggcgttcttaggttccgtggctcgcggattccgggagcaccccagggagtggcacttgcacgccgcggaccgcagggatccccaagccctgcacccagattcttccccgccacggagagacaatcatgacaattatcattacaatgattatgaaaactggcatgaaaacatttatgctgttaataattaaaataataaaaatgtaccgatgtgtgtatagcaggcttcttttcgatgctgtaaaaaaatctgtggaatgaatgaatgatctgtgtaaaatatatttggaagatgaattctaaaattaagttatttatttatttatttatttatttattttgagacagagttttactcttgtcgcccaggctggagtgcagtggtgtgatctcggctcactgaaacctccgcctcccaggttcaagcaattcgcctgcctcagcctcctaaatagctgggattacaggcgtgcgccaccacgcccagctaatttatatgtgtatgtatatatatgtgtgtgtatacatatatatatattttttttttttttttttttgaggcggagtctcactctgttgcccaggctgaagtgcagtggcgcaatctcggctcactgcaacctccgcctcccgggttcaagcgatgatctcgcctcagcctcccaagtagctgggactataggcgcttgccaccacgcgggctaattttttgtatttttttagtagagacggggcttcaccgtgttagccaggatggtctcgatctcctgacctcgtgatccgcccgccttggcctcccaaagatttctatatttttagtagagacgggggtttcaccgtgttaaccaggctagtcttgaactcctgaccttaggtggtccgcctccctcggcctcccaaaatgctgggattacaggtgtgactcttcacgctcggccaactaatttatttgttagagcattaggattatggaaggtttaaaatacgttttatgatcttattttaaataacatacacacattgcccttgttccttgtagattttcccaacctgctgttttttttttttttttttaaagacagggtttcactctgtcacccaggctggagcgcagtagcgagatcacagctcactgcagcctcgatctcctggcgtcaggcgatgctctcacctcagcctccccagtagctgggaccacaggtgccagccaccaagcccagccaattaatttttttttttttggtagagatggggtctagggggagggtctcactatgttgcccagattggtctcaaactcctggcctcaagtgatcctcctgcctcggcctcccaaagtgctgggattacaggggtgagccactgtcccgggccccaacctgcctttattggaatgatctgtgtaaagtatatctggaagatgaattctaaaattaagttatttatttatctaatttattttgataaataataagtagtctggatagaggctctggaaaaagaaaagttctataggcaaattaaggtttggaaatgtcacaaattatgagtcacggtgagacttcactttcaaagcagaactcctgattccaaacccacaccttggtaggttcttcgtctccaaaatggcaactccatcttcctggttgctcagggacagagcctgggagcatcctggaccacccacaaatcctgccattactgtctttacaatacagatgctcctcaacttcagatggaactacatccacataaacccatcttaagttgaaaatattgtgactcgaaagtacgtttttgacttatggtattttcaacttactatgggcttacccagatgtagccccatcatgagtcaagaagcgtgcagaatgcatactggttttgtagttgaaaaatcctgtaggtggaaattgtcctaaatcgaagactgtatatcggagatcccctcaagtctccctgcctccctgccaccaccctgatccgagctcctcctctccctccaggtctccaccttgccgccctgcagtgtgttctccacataccagccagggctaagattggctctgttgggtgctaccagttggctgaaagagaaacccagaggccctcagctcattccatcaatccagttccagagttcattgtatggagccctaggaaggacctgaggcctgggccagcaggaggcgctgagtggtcagctctgaaggccagggcgtcgggaagtgttcttggtcagagcagagaaactgcagttgccttgtgctttcttcccggagagccctgcagctgaccctctgccagagctttgggtcaggctttctgactgacccttaggttgacaaatgacccagattcagaggaacccttcaacttggaggtgtctccctattgggactccccccaaccccagctccactctgaccagggagatggtggcctaggatcgactcagcgagaggggccgttcttctttccccatggctggggagaaactgactcccctaaagagtagcagcagacttgcctgcagaggcctcctctaaggagtgtgcagaggccatgagagaaactcaggtgcccagacaccgccatgggacttcaggaagcagagccctggggtgtttccaccatggtcttgacttttctcctcttccttaccctcctcacttactgggcaggtgcctggttatggtggatgggataactgagggctcctggacctctcttctctctggttcggcataggctggtccatgattttgataatactattaatagttaacatcatgcagtgcttacttactctgttctaggcactgttctgttactgacacaatcctcattacaacactaggaattagatattattattatccttattttacacataaagaagcaggacacataggccaggcgcggtggctcacgcctgtgatcccagcactttgggaggctgaggcgggcggatcacctgaggtcgggagttagagaccagcctgaccaacatggagaaaccccgtctctactaaaactacaaaaaattaggtgggcatggtggcgcacatctgtagttccagctactcgggaggctgaggcaggagaatcgcttgaacccaggaggcggaggttgcagtgagccaagatcatgccattgcattccagcctgggcaacaaaagcaaaactccatctcaaaaaaaaaaaaaaaaaaaaaaaagaaccagcaggacacaatgatggaagtggcagagcaacctagttccagaagccactttttttttttttgacggggtctcactctgttgcccaaagttctgggatttatgggcatgagctaccgtgcacagccttaaagattacttttttttttttgagaggagtcttgctctgtcgccaggctggagtgcagtgacacgatcttggctcactgcaacctccaccccctgggttcaagcgatcctcctgcctcagcctcccgagtagctgggactacaggcacacaccaccaagcccagctaattttttaaatttttaaatatttttttatttttagtagagatgggtttcaccatgttggccaggatggtcttgatttcttgaccttgtgatccacctgccttggcctcccaaagtgctgggattacaggcgtgagccaccgcgcctggccaagattactttttgaagtttgaataaaagggcaatgaaacctgcgctgaagaacaggaaattgactggctgtgtgctgaggccatccttctcccctgtctgggagggggacttctgtcactctgctgtccccagaagtgggtggagcttaaaacgtcacagaagcccaagtcatttgcagggtacatggagaaacagctcttggcagcctgtcctatgacctgaactcaacatgtcttttttttttctttgagacggagtctcgctctgtcacccaggctggaatgcaatggcgcgacctcggctcactgcaacctcccctcccgggttcaagcaattctcctacctcagcctcctgagtagctgggactacaggtgtgcgccaccacgcccagttaattttttaaatttttagtagacatggggtttcaccatgttggccaggttggtcttaaactcctgacctcgtgatccgcccaccttggcttcccaaagtgctgggattacaggcgtgagccaccatgccagacatcaccatatctttatactcctttcttcacaaaagaaacaactgaagaacaaccagaaggtgccagcatattctgtgaacaccagcaaaaaacccacgtaaataaatggtggcaaaagtgaactctttacacaggagaagctacctccctgcctcgcctaaaatgtcaaaggatatcatagtgacaaacatgaagccgatatccataataaattttattttgcccagtgacataaaaggcaagtcagattactgttggaatgatgaattgtgttgatttcaattctttataatattttcttattttaagaagaaattcttgtagtggtaattttgggatatgactaaatgaatgtgcctttcatgtggaagaataaacaaacaagaatattgggccaggcataatggctcatgcctggaatcccagcactttcagaggccaaggtgaggggatcacttgaggtcaggagtttgagaccagcctaacatagtgagaccctgtctaaaaaaaaaaaaaaaaaaaaaagattagctgggcatggtggcatatgctactcaggaggctgaagcgagagggtggcctgttcccaggaggttgaggctacagtgagctatgattgcaccactgcactccagcctggatgacagagtgagaccttgccttaaaaaaaaagtcaaggaggatgaggagagaatggggagataaaaatgttaccagctagtacaaagccacaggagcccaagacaggcccatgagatagatggaaatgagagaaggaacatctctgagagctcgccgcaatagccatgttggaaaacatctgtccactcatatcttcctttattctcacactcatccagtattttttgggtacctactaatttccaggcattgtggatacgatggtgaatgaaacggaaaaaaagtctgctctcttgggccttactttctagtgatctgtgataattatctcagaaaatgtatatcaaacacacagcacagtgtatgacagtcaacagtcaagggctggccaccactactttgataatcatgttggtttcatgtttgcagtgaccaagagtcaggggttaactgaaagacccaaacacgtatccattactcagataactttctctgtgctccaagctgactttgccaaatagtacaagcaacacccctaatgctgcagggtgcacagtgtctctgtagtgatggcgtgagtggtttctgggggtgcaggcgccacctgcttcctcggttgtttctggggagctggcacatgctgcctttgtgtgtggaagtgggtgtggtgcaggccgaggcaggaggatgctttggaagcagggaatatctgggaaagcagttgatctggccctggcccagagatccctacccaccacagtcctgcttctacagggcaacagcaggcaacccattcttttcctctaatcctactgaaatgtttggctttctccctccctcccttctttttccactctccctctcctctttcctgcatttcctctcttgactgaggcctgcgtggggcttgctggtgcatcgtgcacctactgcttcttcctagggatcccctggagatgactgtccactcaccaccaagatggggaaggacttattgaaaaagacccacatgaccaccactctcccgaagattttccatggatcatttccctgaatgctcccaccaagcctcccagccaggttcctctgaccactctactttgctatgggaactcagaagtgtcccttcttttccaagagggtttactagatgccaggcactgttctcagcatgtaacccttctaaataagtaacttattcaacacacacgtaatggtgtgaggtaaggactatgattaactttgtgattcaaaattcttaaattcatagatgaagaaactgaggcacaaaatagtggatgcaaatcacagtcagctctcctaaccccaacccagaggttgagttttgaccctcggcctggactgcaggaaaccttcaagcaagctctcaagtgggtgcagcaggaggaaggtcttatgatcttggggaaatttggtccagatacttccaggagcaagcatcctcccatatctgactaaagagcaatactgactcaggcaagaagaaagtgagtggtcagggtaaggaggaaagcgaggctgaggtcatggcagcacctgtgccctgacactgctggaaagacatgtcaccagaaggtacctacaggaagcaatgggatttcattcatgcaatctgatcttacgctctgatagtgtcatgtggagcagctgcagttacatgcctgcgtggctgcatcggagagaggcgcattgtgtggatcagaggcaattagccagtcagggtttggggaggcatctgattttttcagcacagcaaggaacggcacagtacatcgagcccccagtgcatttctcggtatctcgatcttcctctacttgcgcttttctgttcctctgcctggaggttttgcctccattctagtctctgctctaacacagaccttgtgtgtactttatcgcaaacagttccctttccacccctcagcagcgggccccactccctttgttttgccctttctcaatctgaagacgtgtcatttacctgccagcttgcttatctgcatggagcccatgctccactagggcacgaacttggagttatttctgctgcatcctctgcccttgcaaaagtacctgtcacctgggaggcacttagcaagtacttgttacctaaatggacaatgtgaaaaatcaccatgctccactcgcaggccaggctgctggagatgactgtatggcctctggactggccctctgagcgtgaccgatacacagaggaaggtgggtgcacaaggactgtgctattctgtaggaatcctatgaggaatctgctgggcactatcacaacctggagtcagggtagttcaggaggcgctgaggctgctgcaagatggctcatgagagcaggcaagctccctcgcctggatggaagcagcactcagcaagcaaggcactgaggacccttccgctaagtgaggctttcttacctatctctggttccagggtttacatgggtggaaccaggatgcctacaacagagcttcagcaaggacaggcaaacaaacagaaactgacaagtggactagcagaatggactgaaggctgctctgtaaacttctcccacccagcagtaatactctggctttctatggccctgtgtgtcagtttggtccaggcctttctatgaagcccctgtacatatcttggtcactcataagttcccctgcgtctgccttctgtctccatctacatcagccttgactatattccacccacatggtgctgggggcctgggcctgtgaacctctgacctgtcctctcctgccagactcaggcccagctctcagctgctgctgttgccgggcccctcccagggtgcctgactccagatctctgccacagattcaggactggactcaaaggtctcctctctgaggtgccttccctgacctgctttggcagccactcctgattcttctgactttgccctgttgtagggacttcctaaacggttgtgacccatgctctccatgtatgcccggtctgaggacagcagcgcctggcccaagcacacgctcgatggtgatcagctgactgatggccgcgtgctctgggtttggtgccaggcatgtgcctccttccagtctcccaacagcccccagagctgttcagacctccagtgcacagctcatgtccaaaggtggggaagtcagctaaggacccacttcattctacccagaagcataagacaaagagaaactgagtgagtggccagaagagggagtgttcgccagggagggctggacctctggggtctctggtgatctggcggtagagccacctggataacgtgtgccgattgaatgaacaggtgaaacaggccaggctttcgactggggaaggggagcgagaggaatgaagaaagcgccagatagttcccatggaagtttattttatgttccttgcaaacaacatgtggcctcagctgtgattccagctgccctctctgacttctgttccctgagcctggctcctgttcttcattcaaactgcaccagctgcataagcaaagacagtggaggggctccactgcatgtcagcctgctgcatggcttgcagctgcttctgtatctcggcctgcaactggcacagcttgtcctcgttcacaggaccccggcagacgccatgcaggtagatgcagcagtcaactgggatgggatagagtacctgcttcagctccatcagccccatggtgtgctccagcaggctcaggaggcaggcactggagatggggttgtcggagaggctcagggaactgaggtgggagcagcggcacagggcgggcaggagggcactgaggtgggcatccttcagccagcagtgtttcaggtctaggtgctgcagtgtccctgagactgccctcagcagggtacccaagggcccagggatcatgtaggacaagtcgttgacgctcagatccagcttcttcaggcaggtggtatgatggctccgggacaagtaggtgatgtcagtgtccagaagcttgcagttgcagatctccagggaatgtagtgggacccacagacagctgaggagagaagggtggctctgtgaggggagggcccaggcaccccacccggaacacctatttgtccatggaggaggctagtcctatggccaccccctcatcagggaagccatttaccagcagggtcaggagcatgtcctttggtgtcccaaggcctggctctctctcaacagacctaccaggtcctccacgaacccttctaactctaagtttctcttcggtgaaagggagatgcacattatccatacctaataagactgctgagaggagccatttgaaagcgcttatctgatgagaagtaaccataggctgaggccattattcctcaggtttgggtttggggaagctgctgctcaggcttccatttaagccagggctgggggtcctgaatgccctatcttgaaatttctaggagacgtgcacagagtggatactgattgtccttcagggctctgtacccacctgtctggggcagtatgagctcagaagaagaggcataacctgtgctgtgtcaggatcttttcttggggaccagcataacattcagcagtgcctgaaaatgtttgttgagtaaataaacatattattaggaaaggcgcaatggctcacacctgtaatcccagcactttgggaagccgcagtgggtggatcacctgaggtctggagttcaagaccagtctggccaacgtggtgaaaccccatctctactaaaaatggaaaaattagccaggcatggtggcccatgcctgtaatcctagctacttgggaggctgaggcaggagaatcacttgaacctgggaggcagagattccagtaagccgagatcatgccactgcactccagcctgggtgacagatactctgtctcaaaaacaaaaaattaaaaaattaaatgaaattcatggaagaccactgttttggactaagctcctgcactagacctcaaaagaccagagcaaaccagaatgcagtcactcgtgctaagtgccaggtaatcaaactgaacttcgaaactggtcagttttccaaaaaacaggagattcacaccaaccaatcagaaggggcccaggatgataaggaagtgccctctgttttaaccccataaggaaagtaaccgtcaactgaccaatctgctttttgttttggcttttttcatcacttttatgcttataaagccagtctcttctgctcagctcatcagagctcttattctattttatagaatgggaggctgccccaatttgtgaatcacaaacctaagccaattagaaggccaggcatggtggctcatgcctttaatcttagtgctttgggaggctgaggtgggaggatggcttgaagccaggagctcaagaccagcctgggcagcaaagcaagaccttgtctctccaaaaaagtttttaaaaaattcgcaaggtgtagtggtgcgcatctgtagtcttagccgcttaggaggctgaggcgggagggtagcttgagcacaggagtttgagactgcagtgagatgtaatcgtgccactgcactctagcctgggtgacaaaatgatgccctgtctctaaagagtaaaaaaaagccaattagatctttaaactaaatttgttgtaatttttttttgagacggggtctcactctgttgcccatgctggagtgcagtggcacaatcatggctcactacagcctcaaactcctgggctcaagcaatcctcctgcctcggcctcctgagtagctgggactaaagatgcactatgcccagctaatttttctttttgtttttgttttgtttttgagatggagtcttgctctgttgcccaagctggagtgcagtggtgcaatcttggctcactataacctccaccttctgggttcaagagattctcctgccttagcctcccgagcagctaggattacagacacatgccaccatgtccggctaatttttgtatttttaatagagatggggtttcgccatgttggccaggctggtctcaaactcttaacctcaagtgatccgcctgcctctgcctcccaaagtgctgggattacaggcatgagccaccgtgcttggccttaatttttgtatatttatttgtagaaatggggtctcactttgttgcccaggctggtttccaacttggcctcaagtgagcttcccacttcagcctcccaaagtggattttattttttatagcaacatgcatctttccccatcaaatatgtttccaaagcagatcccagccatcagctgcatctgaaccctcagttcccaggctgtgcccacaattccatgagcatctaagaataagccccatttcctgtcttgttcccctgacctgacctcacttgggagtattcagaggactcttccgacgcccctgcctacccattcacctgagtatgtaatgtagtttgcctacgaggtaggagtgagacaggtgcagcttccggaggtggcccagcatggtgagctgggagaagaagtagctggagggccgcctgacccatgaggagaaggcccacttgtagtagaagagcttgaagctgcgcaggttgaagatccttcccagctgtatggcagataggtttggctctgccaataccaagaagtctctacaccagtaaaacacctccagctcctggatgaaatccagcctgagtgtcttcaggatcctcagcagactgtcgacggccatcttctcaatgtgcaacttcctacagcagagatgcagggccccgtggctctgttccactttcgtcaggaggtcggagaggaacttatctaacttgaagaagcctcataggaaaagatcaatgtgtatttccactgcttcccatggctgctttcatccttttttcatgttctttgctggcttgggcctggccgtggcctggggcgtctctgccttgactgctgatggtaaccaaaatgggaacttggtcaaggcttcagaagcccctttaccacagtaaaagacttgctcagagtccagggtgaaatccagcatcctcagttctgacttcctgcggggagaggggtgtgatgagatgctggggagcccaggtaagatgagtggcagcagccctgggctgctccccaggccccagcaccagcccgcctcgcctctcctctgcaataggcttttcctccctcactcaggctccttgtcagcccctattcctcatacagcttgtaccaccacccctagaaagtaaaaagccctctccttaaagccttctagctgtaccatcaaccacttaactcagaaacatatagtttccccacttgtccctctagccaatttaacgctcccctcccctggacctcagctcaccctccttctggctctgaactgaggtcttgctcccagcatcccccttacctgggacaagccctgtgggcagaaaaggcctccagcccatccaccacagcttgcaggctgtcttggttgggccactgcactatcagagagcccagatggagaaaccggaagggccaggcctgcaccaaggccttcagagcctttctgtgccccttggcaaatgcagcagtgagtagtggcgggaaaaggttcactgtgagctgttccaacaccagtggaactgaagcctcattgctcagcaggctgtgggctgcaagttccaagaggctgaggggtgctgggtggttcacctccatggacctggagcagaagaaggtagaaatcctcagaagactaatggctcagcatcactcccaggccaatgtgggagatgcaggcctttcgcatctgtcacagaaccaaatgctggctcctccctccattcaagaccaaaactccacaattcaggtcttgtaagcctgagaccctggagccctaagaccctggggacatgggatccagaaccttaggggtttagatctattccttgctaggctgtagaggcttggaattgacccacactttcctcttctgccttcaccattaacatcatgaacacctaactaaggacactgtcccaaaactccacatcaattctcccaaagcgtatgtagattctgagcagttctcatcacttccagttttaccaagccattatctcttgcccccattactgcagtggccttctaacttgtctctctgcttctgtccttgtgcgccctgtggtcaaagtcagatcatgacattcctttgctcaaaactctagtggcttcattttcactgtgaatacaacccaccctgcagctgccctcagagtctagcatccgggcatctcagggcccacctcctgtcactcccctcactattcactctgcaccagcaacctacactggactccatttctctcctcaaacaccagcaacgccctgcttcagggcctttgcacttcctgttccctctgcctagaagtgtcttctcccaaatatcctcatggctggcccccttacttcattcaggtttctgttaaaatttcacatgagaggccttccctgaccacccaagtagaatagcactcccatcccttaattacagctttatctttcctaatctgatttacagcacttcttatatcaccagttttctgtttctgtctctcttatacacatacacatacgcagacacacacatgcgtgtgcacataaatgcacacagtcgtatattatctgtctcccctctgctaaattataagctccatgaaaaaaggggctgtgtctgctttcattactgctgtagtctgagtgataaacatagttcctgacatacaccagacaagcaggatatattttaaatgcatttcaagagcaagtttgcacaatacacgcttaccacaatcccactgatggagttgagggtaatgtggaatggaggttttttttctatgctctcacagagcatcaggttcaggttagttatggattctttcaactgcccaaattcctcttttttttctgcccagtgaaatgcgggagtgtagccccatcccatcactttccacggtccaccacagagcagggctttgtgcaaggagggggatgttctagacctgcactgtctaatgtgggagccccaagccacatgtggctactgagtacttgaaatgtggctagcatgactaaaggactgaattttaaattaaattaaattctaattaattacaatctaaatagcttcatgtagccagatgctacacttctggacggcagagttctaggatctatgctagtcagagacaagaaacattcattcacagtctcacaagctatgaaatctatttgtatgaggccactacggccttggcaacaaactgggcaaggacagaggacagtataagaaaggacaattattggccaatcatacataggaagctatctagcaaaggcttaaatactagcaaatcaaatcaaacgcctggcacactaaatctataaatatctcttacaaatagtgatcaagaacgattgagcaagaatggttaatgttaggtttattaattattaatgtcaatgcatttgagaaaatcaaagaagaaatagaaggcaaggttctgaacctgatatttagtagtggtgttttataaacattgctttttttttttgagacggagtcttgcctgtcgcctaggctggagtgcagtggcacaatcttggcttactgcaagctccacctcctgggttcacgccattctcctgcctcagtctcccgagtagctgggactacaggtgcccgccaccacgcccggctaattttttgtatttttagtagagacggggtttcaccatgttagccaggatggtcttgatctcctgacctcgtgatccacccgccttggcctcccaaagtgttgggattacaggcgtgagccaccgcgcccagccaacattgcttttaaagttagaaacaagatgaagacggtgtggccaccatgagagtgtgccctgcacctccaactcaggaaatgcacctgaaccaagggccccacccactgcccttaggaatccctggcagccttaaggcccaagtcacaccaccacatgctgctcaccaacaatgactggggacagatcagttcctgggagacaatgtgacagactagttcctgggagacatcactcctctgacaaccacctttggcttcaggactccctgatagctttgctaaatcttcctgagtgcacacgtttccacccaaccttccctccagttctgcttcaccaaacacagcgatgtaggtcagtggggtctccatgccttcccgctcacccctcaatgcccctcatagggggctcccctagtaaaaatccttggatgtttttccatcttggtatctgcttctagcaggactttgatggagtttaggatgtgccttcccaaaatacagcaacttggcatactgaatattttaagctgaaggaatttgagaaatggcatgggcaggcaggattttctgaccttcccctgtagtaggtataagaccctcctgtgagaggtactccccctatacaggaaggaaaggcatatccttatttccaaagatgaacgcttgccaagagggatctgaacacacaggcccgctgttccgccattttattacacttggctcatactctcatacttcttttgtcttatcattatttctccatgactaatcaaaatttttttctctctctatatataaacatatatatataatatatgtgtgtgtgtgtgtgtgtgagagagagagagagagagaaagacagagagacagagagagacagagaaagaaagagagagggaaagagaggagctgtatcatgggtatttttgttgatgtctgaattagaaacaagcatgcacactatcaacattgtttgggaaagttgtagccggtgcagtaagacacataacaatagggttgtctagggcaataaaaagaggcaaacgattatgtacatagtgtaggaaaaaatggtgttgcggctcagaatgtcaccccgaaatacggaactttgaaggtgtctctctgacttttccctgcctttctgtgtgagagctagtcataaaggaattctttgaccttcctttcctgaaagtaggcagtgagacctccaccccatgtgacaggtgtcctgtcctattaccaggaggaaagaaatgctacacagaggggccaagaagaatctgaatgaacaggccttgctaagttctccccagcttattaccattagaccacaggatttttgtccaatcatacttgtacatgactgtccatccttcatcaaacctaagcatacatatatacagatagtcaggtgcagtgacatgcacctgtaatcccaggtacttgggaggctgaggcaggaggactgcttgagcccaggaattcaaggccggtctgggcaatacagtaagatcccagtctctaaaaaaaattttaaattaagaactacagttctccctgggtctttgagtcttcatttctgaaggttcctgtatcacgcaaaactttgatacatttgttatggtgtcctcttgttaatctgcctttttaaaataggggtatcagcaaagacccttgagatgggtgaggaaaagctatgattttttctcctctacagtggaaagcaatggatcctctgtaatgtacccttctgggttatcagatttgagtcctgttcattatctttgagctattttttaactttataagttgtaggtaactgatagacatataaattctgtctggtctggtaatgattttctcctaacttctacctgtggaaaattttgtctccatctgaaattcatctcaacatcccttcatgtcatataaatatgtgctgtcttaactcttctttaacatctgcctggtacttcatattatatgagtaaaataaattctttaatacatgttcatttctatatctgtataaagtcacaattctacttttctgaaaattatcttttaacaattggaagctaaaaaggataaaataggaaacagttaatataattaataggagtatttctgctgatgtgactgcacaagagtgcccagtatttccagcaagaactgagctgtaaatgtataatggcagaagtaatgtagatgtatgaaataaactattcactcacttttttctgtcatctagggatgacaataaatgtgaaaacagtattaagaattaaaaaattaatgtaatggagtaaaattaataaatggaaagatgtaaatggatgaggagagcaaatattgaaaagatataaatattgttatagttaggacattttaaataatgtctaattatgactttaatctagaagaaataacaaaaacaaaactaagagaagactattgaagagatactaatgtgaaattaattcaaactggctgggcgtggtggctcatgcctgtaatccagcactttgggaggctgaggcggctggatcacctgagatcagtttgagaccagtctggccaacatggtgaaaccctgtctctactaaatatacaaaaaagaaaaaattagccatgcatggtggtgcatgcctgtaatcccagttactcgagaggctgagacaggagaatcacttgaactcgggaggcagaggttgcagtgagccaagatccggccactgcattccggtctgggcgagacagtgagaccctgtctcaaagaaaaaaaaaaattcaaacttaaagttactggaaattgaaattattctgagccttgagagaaatgtggctatgtggcctgagtcatgtaatatgcagctgcaacttctacttctctgatttaaatcaactttcttccttattcttgtactatagaaaattaggaagacctaatggcaccggatataggaccccttcagatcactacctcttctcagggagtaacaaagtaatctttcttggaatatagcattctataaccaaccaaatcactgtaatgaatgcactggttttgtatggaaaactctgcaatcctgctaaaatttctctgtctctgcctacataagtgaaaccttaacttcactgctttggaacgctgaccccgttcatctggagttagtgtttcctgggtggctatactcaagctttgtgcgcaaataaactctatatttaatcatgtgttctgatctcactatttaacattaacactaatattaccatatgtttacataaaacaatattatgttgacctgagaacagaaatcaatccgtgaaaacacatagagcaagctctcccaagagctcgtagaattattgaaggatctgattttcattatccacagagcctgaccataggtagcttaggcaaaaagaggaactttctgggagaggattccattgtagcttacctaactgaagaaagctgtctaacaaagtcaaggtcttggcagcaggagaccctgtctaccctctgttccctacccttagagctatgccataaacccagcagcaaaaaaccctccaggatggttccctggctctgtcttctcttgccaaatgtcaaatggctatgagagaggtagatttgtaagatgcaccacctaggaaagaaaaaaaactcctgccaataaaactgatacctatgaaggtaagacccatactgatttttctgagatttcaatctctgacacatccgtaatgaacaatgagtgggactccttggttggtgaatgaatagtgctaaaaggtggagtacagtgttacagtgagaagataattttttggccaataaacatataaaaatgcattcactattactaatcagggagacacaaatcaaaaatacaatgagctattacttcatatccattaggatggctaccatcaaaaaaacaaaatagaaacaaatgtgttggtgaagacacggcgacattgcaacccttgtacgatgctgggaatgcaaaatggtcgaactgctgggaaaacagtatggtggttccccaaaaaactaaaattagatccagccatttcaattctaggaatatacccaaaaagactaaaagcaaggccttgaagatatatttgtacacccatgttcacagcagcattattcataacagccaaaaggtggaagcaacacaaatgtccatcagcagatgaatggataaacaaaacatgatatataaatacaatgggatattaatcagccttaaaaaggaggaaaattctgacacacgctacaacacatacggaccttgagaacattaggctgagtgaaataagccagtcacaaaggacaaatactgtatgaccccacttgtatttccagattgaagattattttaaaatgaagacattttaagatacagcagatgcagaaagaagccatttcagagcttcccttatctggctacaggcagagccttctaagaatgaagttgtcataaatcctctctttaggagagcttcactcccagacagggccacttgcaatgggatgagaaactgtataagcaaacattatcaccaagtgtcataccttccatttattctcctaaaagaccatttatctttcccatggaaaccctttctcccttcaccctttcccctataaagttggtgtataaatccctatctctagttcttcagggagcttctcatttaaatgctgccccacacacatgtaaagaaatcttgtcttttctcctgttaatctgtccattgtttggttacctttttccccctgttaatctgttaatttgctcatttgcagctcccacacactactggacctgagatggcagaggaaaagctttccctcccagcacagttataaaagatatctacaatagtcaaattcataaagacagtaagaatggaggtttccaggagcttgggtgggggagaaatgacacaagacagggaccccctcttaggagcctggaagctcccaaacataaaaaaatttaaaactcttgagttcctccaagggaaattctagatatctagctagtcctaaaaaataaataagtaacttggggctgggtatggtggctcatgcctgtaatcctagcactttgggaggctgaggcaggcagatcacttgaggccaggagttcaagaccagcctggccaacatggtgaaatcccgtctctactaagtggttcatgcctgtagtcccagctactcgggaggctgaggcgtgataatctctggaacccaggaggtggaggttgcagtgaaccaagattgcaccactgctctccagcctgggtgacagagcaaaactccctctcaaaaaacaaatacataaaaataaataaataacttgataaaaaggtatcatgttttgcagggtcttattttaaaaaaaagataatagtagcctaaaataattgccaaggaaattagatctaaagatgttcaattttcctataaaaactaaaaataacatcttaacatatatctctgagttgtctttcagaagcctggaccctcaccaaatgcaactgttggctcatggacctttgataagagagttgaggactgaactttgaccaccattctttgttctaaatttcttcctgagggggccgggtgtagtggctcacagctgtaatcccagcactttgggaagccgaggtgggtggaccatctgaggtcaggagtttgagaccagcctgggaaacacggcaaaaccccatctctataaagagtacaaaaattagccaggcctggtggcatgtgtctgtagctccagctacttgggaggctgaggtgtgaggatcacttgagcctgggaggtgaaggttgcagtgggccaagattgtaccactccattccagcctgggcaacagagtgagccaagattgtaccactccactccagagtgcaccattccacaccagagcctgggcaaaatcaataaataaacacatgttaaagatgttatttaactggttagtgaggaaactgagaaggtgttaaaatcagttctagggagaatccaaaataagatccagaatattgaaatgaatatgcaaatggaggtaaaattggcttccagtagggagagaagccaattgaataggacaaaatgtacatgtctagagacgagaattatgttgcagtgctatcaccagtcttctaaagtagctcaaaacaatgaaagacgagagacaacctggaagggttgtgatccacttcagtggaaaactatcctatccacctaggataggatagaatccatcattcagccagcttattcatcccaagtcatactagattcaagtttgagttctacgagacagactaaaatttacagggctatttcattaccaaattcgaaaacataaattgaaaatgatgtctctaaaaattaaactactgaccaatctcacttacgaatatcaatgcaatggtaccgttaagacagttaattgggaagtcatgaggctaagatgtctccagcaccttgagtttctacctaagccaaccaaaacccaattcaatgtaaaaagtaaaatgaaatttaagcttaaccaatcagaaactgccaactaacctctaactagggacttcccactttaaccaatcaaatatgttttctttgtcttgtttctgtgaatactttatcaaatttcctctgttgccccctttcctacccacccacagtggagcactgaactacttgtggtctggtgctgcctgattcatgaatcaatgaatgctcaaataaagtcattcaaattttattgtgcctaaatttatcttttaacagcatccagcagcacatgaaaataataatggagtatgagtaaatgagaaatattagtaatgcaaagagagtccaatatgagcaaatcaagtcaccatatgtaataaaatttaccaagttaataggacaaaagagggaaaaaagaaacaccttggccgggcgcggtggctcacgcctgtaatcccagcactttgggaggccgagacgggcggatcacgaggtcaggagatcgagaccatcctggctaaaacggtgaaaccccgtctctactaaaaatagtaaaaaattagccgggcgtggtggcgggcacctgtagtcccagctactcgggaggctgaggcaggagaatggcgtgaacccgggaggcggagcttgcagtgagccgagatcgtgccactgcactctagcctgggcgacggagcaagactccgtctcaaaaaaaaaaaaaaaaaaaaaaaagagattgaatgtgtggcgaggcccttcagggcccaggcgtggagccctgtactgggtattcataaaccatttctgcaggctagcctacgttggccctgaaaggcccaggaagctgggagagccagggagagacatgatggagttgtggcagggtgagatgtgccccttcctcctcctaggactggacgcagagaatttgtataaagctctttactaaccggagtcttaattaaaggaaagaattaaggaaagccctaaaggatctatgggagtgggtatctccaccgtggccttggtctcagccattcctcttttttatttttttgggacagggtcttactctgttgctcaggctggagtacagtggcacaatcttggctcactgcaacctctgcctcctgggttcaagcaattctcccacctcagcccccaagtagctgggattacaggcgcgagacaccatgcctggataatctttgtatttcttgtagagatggggtttcaccatgttccccaggttggcttcgaactcctgagctcaagccatccacccgcctcggcctcccagagtgctaggattacaggcgtgaatcactgcgcccagcctcagccattcctctgggggttttcttacagcttaggagttatatggcaacacaagctgcaatctaaagtcataggcttggtggctcatgcctgtaatcccagcactttgggaggctgaggcgggtggatcacctgaggtcaggagttagagactagcctggccaacaaggtgaaaccccgtctctacaaaaaatacaaaaattagtctggtgtggtggcgtgcacctgtaatcccagctactcgaggggctgaggcaggagaatctcttgaacctgggaagcagaggttgcagtgagctgagattgcaccactgcactccagcctgagcaacagagcaagactccctctctaaaaataaagccacacagatctgtgcttaaatcctggctatgtgtgattttggtaagttactcaagttctgtaaacctcctatttttacatctaaaatgcggaaagaaattatatttgttttagagttattgttgcaaaatatatacactacagagcacagagccttgtgcccagtaagtgctcagttgacacatgtgcttttaacattatgtgcattgatgcaaactcttttctactttgctttatctttgtcctagtggcatacggcaccctcttggcaaaccagctaggccaaaacagaaaagattcatcacagactgaaaactcttttattttaggagaggataaataagttggttcacattgtgttacaaagggcaaaataacattggaaggtagattgtcaccatagtttagggcctttaggttcacgaaaggatttccagggaagaggcatcaaaatgaaacaatggagctaaggaggaatgagccccgagaagagaggataaactttccaggcaaatggaatgtgtgagaaggccctgagatgagctggagcatggcaggcttggagaactgaagtcagccctgtttgaactgacttattaatgaaggaatggagagaagtctggatacagaggaaagcaggccagatcttctatggccttgtaagtcacgttaaggagctgtcattcaaattatccttcctgatcatgtagttgtaatgtatgcattagattaataaatatatcttaaaatatagacaacatggaattagcaaattatagctacttcacatggtaatgaggccagctttccatagaataccaggtaaagtgacatctcagttttatacatgatgtggcatgaagaaatgctctactttaagcggttggttgtggctttttcgggagcccccttagagaggatctcggaggtatctggataaaaatctggcttgtagctgttattgctaatttagcttcattcagcaacagttttgaggatgtatatcccacatgccgcactagagaaaaggagagggaatgggagatacaattttgcttcctgagagaacctttccgtcatcttacttcaggtattggcagcaacatctaaaccacggtgatttcacatggacaagacagaaacacagtggttatgagtgcggttttttcatggggtcaagctgcttgggcttgaaactttactcccaacgaagttatttgagtaagttacctaatttatttgacaccccccctttttttttttctgagacagagtttcgctcttattgcccaggctggagtgcaatggcacgatctcagctcaccacaacctccgcctcccgggttcaagcagtgctcccgcctcagcctcccaagtagctgacattacaggcacacaccaccacgcccagctaatttttgtatttttagtagagatggggtttcaccatgttggtcaggctggtctcgaactcctgacctcgtgatccgcctgcctcggcctcccaaagtgctaggattacaggcatgagccaccatgcctggcctatttgacccttaatttcctcatttataaaatgggaacaggagtctcttgatcatgaagtcgttaagaggagttagtaagatatttcacagctagccctaccctaatgcctggcacatagtaagatctcaatatatcctattcattatgattattagtattttgcatcttttaatctttcactttttttttttttgagacagagtctttgttgcccaggttggagtgcagtggtacaatcttggcttactgcaacattcacctcccaggttcaagtgattctcctgcctcagcctcctgagtagctgggattacaggcgtgcgccaccacacccggctaatttttatatttttagtagagttggggatttcaccatgttggccaggctagtctggaactcctgacctcaggtgatctgcccgccttggcctcccaaagtgctgggattacaggggtgagccaccacgcccagccaatctttcacatttttaaaagcctatgatcactagaattttacagctttgcttaagtgagtattataggatcagaaagctgtacttggtaaactttcctggcattaatttaaattctctaacttatttctttaaggtattcttttttaaagcttcttttaatggagacacaaaagtaggaaaaaaatattacagcggatcccatgtactcataattcagcttgaataattattctttgctgattcctttgtatccacacccacaccctccttcctccatatagctccatttgcaaatatttcagcagatggagtataaaatataccatcttatcatgtgtaaaaaaatttaatacttctggccgggcacggtggctcacgcctgtaatcccagcactttgggaggctgaggtgggtggatcacctgaggtcaggagttcaagaccagcctggccaacatggtgaaaccccgtctctactaaaaatacaaaaattagccgggcatggtggcatacccctgtaatcctagctactcgggaggctgaggcaggagaattgcttgagcccaggaggcagaggttgcagtgagccgagatcatgccactgcactccagcctggctgacagagcaagactctttctcaaaaaaaaaaaaaaaaattaatacttctgtaatatcattaaatatccatgctcaaactttgaatcatctcataaattgtctgtttagatcaggatcaaaacaaggaacacattgtgattggagttatctttacaatttttgaattgattttgtcattttaatatgtatagattcagtctttttttttttttttttttttttgagacagagtctcgctctgtcacccaggctggagtgcagtggcacaaactcggctcactgcaacctccgcctcctgggttcaagttattctcctgcttcagcctcctgagtagctgtgattacaggagtgtgccatcactcacacctggctaatttttgtatttttagtagagatggggtttcaccatgctggtcaggctggtctcgaacttctgacttcatgatctttctgcctcagtctcccaaagtgctggggttacaggtgtgagccgccgcacccggctagattcagtcctaacctggctgcagataccatctcttccccttcttctttattttcctttacacgacttgttaatacctgtcatatttgtgtgcctggtgtattgtctctctacctgcccatcataacaaaagcttcataacagctttataagaaaactgtggagggggcaaaaatcagaatgtgcttaatcaatgttctcttctaacataagtgatttttctcttggaactttttcttcttgagatagtgtgggagagaggtgttacatttatttttaatgatgattgttcttttctaagccgaagggatttattcaaagtgataggcatagcaagtcttatgatgagattttttttcaatgataccaatcaaaattctagcctccaaaatcaactctgacaggattagaaaaggaaaatggagacaaacatgtctgtggggtgaggggggctgtttggaactaggatgtgtggcatggaggttttggcttggagcaggaagtagactagtgtgaaagacacaatacattagacaattaaggagaagatattattcagcttattgcagtagagagagcaccccagatccaatggctaaagtgtctcagcacagtggttctaccttagacttttatagccaggggtaaacaagttgcagaaggtgttgttttgcaagtaggggacgtcttggttatctgaacgtcaaatgttttctctgtggtcagtttcagtgggatagactcttctaatctgctaatcaatcaaagaataggaggttggagcatctgggtctaaccttgtgagcaggctcaggcaaaagggactgtttggctttgccaaaggagtcatctttgactcatggaagttgtgagaaagtagatcatgagtcttatgtaagtcatatggggaagagtagttctttgaggtaaactctttccagaaacacaaggattttttgaggggggcagggagcggtctagaaaacaaaaggatgggggtacttcctagccatcactgtgtcctgagagcacagggctcaggtaaagttcaaccttgtcatgaggttgcctattggaggacagaataggtgggggggactgctagagtttcactgccttgggacaaaaagtgcccccagaactcagcgttctgaatcaggtgtattcaggtataaaacctgggatgcagtttaaggcctggcttgtggtgagctgagaaaaagtggagaatggtctcaagggagttgctttctcatccttttacctccaaagcacagaactgagcagttacagtctgatagtctcccccaagactgcttctcttaagaggcagaagttgaagactggtcctgagtatttagtagggtgggcaatgactgttttttctggtgccctccacccaagggttcatccactctgtatcccctcagccagttggagatgacagggtttggtatctggtctttatccatttctttgccgtatataagagcctgctgtagagggaaataagctcagccatttcaaatgcaaaagagcatacaggattaaacatgccaccagaagcaaatacgttagaaaagaggaacacagaacttaaaattagcctaaataagcatattaacaggggtaaagggtgctttaaactaaaatgagaaaataagagaattaagcagaaatatgcatacagaatagctgaatcaattaaaaaaaccactgctatggggaaaatggatagagcaaggaacaaatgagtgcatttgaagaagatgttgagtaaacaagctggaaacgagggtgacaaactgtcccagtctgcctgagactgcggggttttgaagacatgggactgtcagtgctaaaaccaggagagacccgggcaaaccaggacagctggtcacttttgaatagacataaagaatataaaagcaaaactaagagcaatggaggaaaagaagtgcaaacatccagataattgtgatcccagaaggacagggaaatgaaacagagaagaaatacttgaagaaatcatggagatacctttcgtagattaaaaagaaaaagcaaggcttctggtttctggtctgaaatataagaagcttggaagtcatcactccatcctaacaagtagtaagctgaacaaactgaaaaatcagttcttcttagatccgcaagagaagtgaggccacagggcaaactgtttccccccagattgaagatacagatgggcagatacagagaattacaatttaccagagcagaaacccatgagcaggaacctccacaggaatcagtgctgggtagagaaaactgaattgtaatcgatgaattactggaggctcagtgtagatatatctgagagataactccagggggacccagctattgggtgggcctcacttttctgagttttacttcctgaagctctaccagttctcacagtaaatatcagagagaactctcaggctttggtagagagaggaaaaatgattttgaaacattccagataattctgtttttttttcttttttttttgagacggcgtcttgctcggttgcccaggctggagtgcagtggcacgatctgggctcactacaagccccgcctcccgagttcacaccattctcctgcctcagcctcctgagcagctgggactacaggcgcccgccaccatgcctggctatttctctttttttttgtatttttagtagagacagggtttcaccatgttagccaggatggtctcgatctcctgacctcgtgatccgcctgccttggcctcccagagtgttgggattacaggcgtgagccaccgcgcccggccaattctgttctttttaaattattttattattattattattattttgtagagacagggttttgccatgtttcccaggctggtcttgaattcctgatctcaagcagtcctcctgcctcagcctcccagagtgttaggattacaggcatgagccattgcacctggccagttctgttcttttttttaattatttttattattttttaaaaattattattattatactttaagttttagggtacacgtgcaagagagactacagtaagtcctcagtgtcatcactaggttcttggaaactgcaactctaagcaaaatgacatacatatggccatgaataatgtccatttgttcaatgtcatttccttacaatggtgatgaggaaaaaaaagttggttttgcttaaagtcatagtcaatagtttccaagaacctattgatgttaagtgaggacttactgtatttaaccagaacctaacctgttagggttttatcagagcctaatgacctggaagaagagaaaacctcagctccagccagctgtagccatcctttcccacctaactggggagaagaactgggaagcacctgtgaagttcacagtccagaggcacaagctcactaaaagatcaagacctagtcatgaaaatactgactactttcctcccctcacaccttaccatattactaaaagcctatttattacagttctttttatcctatacgtcatgttgggctatcaagaaaaaattacaggctggatgcagtggttcacacctgtaaatcccagcacttgggaggctgaggcgggtggatcactgaggccaggggttcaagatcagcctggctaacatggcaaaacccgtctctactaaaaatacaaaaaattagccgggcatggtggcgcacgcctgtaatcccagctactcgggaggctgaggtaggagaatagcttgaactcaggaggcagaggttgcagtgaactgagattgtgccactgcattccagcctgggtaatacagtgagactgtgtctcaaaaaaaaccaaaccaaaacaaacaaaaccccccgaaatatataagaactcatacaactcaacagcaaaaacagaacaattaagaaatggataggcctggtgcagtggctcacgcctgtaatcccagcacattgggaggccaaggcaggtggatcacaaagtcaggagttcgagaccagcctgggccaacatggtgaaaccccgtccctactaaaaatacaaaaattagctgggcatggtggcgggtgcctgtagttccagctactcgggaggctgaggcaggagaattgcttgaacctgggaggcggaggttgtagtgagctgagatcgcaccgttgcactgcagcctgggcaacaagagcaaaactccatctcaaaaaaaaaaaaaaagtataaaggacctaaatagacatttttcaaaagaagatacgtaaatagtccacagatacatgaaaatatgctcaacatcattaatcatcagagaaatacaaattaaagccacagtgaaatgtcacctcatacctgttaggatggctattataaaaaagtcaaaagataacaagtgttggtgagaacatggagaaaagggaacccttgtacattattactgggaatataaattcatatagcttttatgaaaaaacagtatgaagattcctcaaaaaattaaaagtagaagtaccatatgatccagcaatcatatttttgggtacgtgtccacaggaataaaatcactgtcaagaagaggtatcttcactcccatgttcactgcagtgtaatttattgcagtattgtttacaatagccaagaaacggaaacaacctaagtgttcattgacagacgaatggataaagaacatgtggtatatatacacaatggaatattattcagccctaaagaagaggagaaaaatttggacccaaagagagagggatgacaagcatgtgacgatggaggcaaaggttggagttacattgccacaagccaaggaatgtctgcagagacccaaagggtgtaataggcaaggaaagatcctttgctagagatttcaaaggatgtatggttctttaacacctaatttcacatttctagcctctaggactctgagaacaaattttggttttaagccactcagttgggtacttctctatggcatcactaggacatgaatacactacccaaagtgacttacagattcaatgcaatccctatcaaaatccccatagtgtggctgggtgtggtggctcacgccgataatcccagtattttgggaggctgaggcaggcgatcaccttaggtcaggagtttgagaccagtctggctaacatggcaaaaccttgtctctaccaaaaatacaaaaattagctgggagtggtggtgcacacctgtaatcccagctacttgggaggctgaggcaggagaatcgcttgaacccgggagacagagactacagtgagccaagattgcgccatggcactccagcctgggcaacacagcgagacttcatcttaaaaaaaaaaaaatctctacggtgttaggcaaaagatggaaaaactcatcctaaaattgatatgtaatttcaagggatcctaaatggctgaaacaatcttgaaaaagaacaaaagttgggagaacccaatttcccaatttcaaaacttactgcagactgcgtgcagtggcccatgcctataatcccagcactttgggaagtcgaggtgggaggactgcttgaatccaggcatttgagacagcctatgtaataaaacgagaccgtctttaccaacctccccccaccaccaaaacaaaaaacaatcgggaggctgaggcaggaggatcacttgagctcaggaggaggaggctgcagtgagtcatagtcatgccactgcacgccagcctgggtgacagagcaagaccctgttcccccaaaattaaaaaacttactatgaagctgcagtaatcataaaagtgcagtactcgttaaggtagacacatagaccaatggaatagaatggagagcccagaaataaactctcgcatctatgatcatttgattttcaacaagggtgccaagcctattcaatgggggaaagaacagtcttgtcaacaaagaaactgttgggaaaacaggatatacacatataaaaaaatgaagttggactctttctactgtatacaaaaattaactaaaaatggattgaagacctaaatataaaggttaaaagtacaaaacttttagaagaaaacatagagacaaatcttcatgactttgaatttggcaatggttttttttttaactttttaattttattaaaaaaaaaaatagagaccatgtctcgctatgttacccaagctggtcttgaactcctgggatcaagcaatcctctggtgttggcctcccaacgtgctaggattacaggcatgaaccactgtgtctggtctggcaatgttttttttaaactgatactcaaggcactgcaacacaagaagagataaataagttgaatttcatcaaaatttaaaacttttatgcatcagcagacactatctagaatgtgaaaaggcaacccacagaatgggaaaatgtctgcaaatcataaacctgataagggcttaacatacagaatatataaagaattcctatgactcaacaacaaaaagagaaacacccaattataatatgggcaaaggatctgaatagacatttctccaaagaaaatatacaaatggtaaattaacacatgaaaagatgctcaacatcattagtcattaggaaaatgtcaattaaagccagggaagatagcaattcacacctaccagactatagtcaaaacaaaatggaaataagaggtattgatgaggatgtagagaaaggataacacttgtacattgctggtgggattgttaaatggtgcggaccctgtggtaaacagtttggtggtttctcaaaaggttaaacagaattaccatataacccagcaattctgctcctaggtatatgacaaagaatttgaaatagggactcaaacagatacttgtatgctgatgttcaccacagtacccaccagagccaaacggtagaaacaatccaagttcccatcaacagatgaatgaatgaacaaaatatggtacatacatacctagaaaggaatgaggttcggatacatctgcaacatggatgagtgttgaaaacattatgctaagtgaagtcagccacaaaaggccattgtattagtttcccagggctgccgtaaaaaagtaccactaagtggttggcttggaacgatacaaatgtattgtttcacagttttggtgtccagaagtctgagatgaaggtttcagcagggccaggcactctctgcaggcattaggaaagaaaggatctggtccaggtctctgtcctagctcctggtagctttagatgttccttgctttctacctgtgactttttcacagtcaaacatttccctctgtgagtgcatgtctctatgtccaaatttcccccagtcataatggactagggcctaccctaatgacctcatcttaattttttttttttttttttttgagatggagtcttgcactgtcacccgggctggagtgcagtggtgcgatcttggctcgctacaacctccgcctctcgggttcaagagagtctcctgcctcagcctcccaagtagctgggattacaggtgcccgccaccatgcccagcacccgccaccacgcccaagctaattttttgtatttttagtagagaccgggtttcaccatgttggccaggctggtctcaaactcctgaccttgtgatccacccacctcggcctcccaaagtgctgggattacaggcatgagccactgtgcctggctgacctcatcttaattttattacttctgtaaagtctctatttccagatgaggtcacatcctgaggtattggggattaggacttcattacatctgctttggagattttcaacccataacaaccatttactgagtgatttcccacatacaaaatatttagaataagcaaatttatagagacagaaagtagattagaggttattggaagtgggaaggtgggagaatgagaagttgttgcttatgggtacagagtgtctgtttagggtggtgaaaatgttttggcaattgataatggtgatggttgcagaacattttgaaaagtaacaacatgaaatggtacacttaaaatgatttaaatgactacttttgtttatatatatattttatcacaatgtaaaggtttattaatttccatagaagaacagagaaagttatcaaaaactaccatgcaggaagcaccaagccaagatagttttataggggaatgctactaaactttatcctgaacagggacatctcattctaaatgagatgtgtcggaggcatatctcacaatgtcagggaagggacaaggacacccacgttcatgtattctaattaataccatactggagagcctagtcagggtgctaaggaatgaaaattatattaaagacacaggattagaaatgaataaatacaattgctgttattgcagatgacacggaaaacacaaaagtatccataaattatttaagaattagaaggaagaatagcaatagaagttctcaaggagtgcaggatgggtgaggggcggcatgggaatgagacatgcatttagtatcagtaacgtatgcaacaaaaatattaaaacaattccacttaattagcctgtttccaccttaatcacctgtgttccatcccagttgcttcttctccaggtgacttcacatgaagggccaagggttccatgactctccatttgcagcatcaaaagttttggcccatctttcatcctccacttccctgattccttttttttttttttttttttttgagatggagtctcgctctgttgctcaggctggagtgcagtggcatgatgtctgctcattgcaagctccgcctcctgggttcacaccattctcctgcctcagcctcccgaatagctgggactacaggcgcccaccaccacgcctggctaatttttttgtatgtttttagtagagatggggtttcaccgtgttagccaggatggtgtcgatctcctgatctcgtgatccacctgcctcagcctcccaaagtgctgggattacaggggtgagccaccgcacccggccctattccttcttgctgtgcctctcatttctctgcctgagaggcctctccttatctctcttgatgtctggctgcttctcaaccctcacccatcagtcactggtaacgttcacagacaagcctttgttctctgaccctcactgctccccacgactcaagtagagtagcccccaacccacaaccccagtagccctccgtacgggtcttctgttgttctcacagcacttctctgaaatcagctttcttaatggtttgctgacttgtttagtgttctcaatcccttcggctggtcagagtccagaatgtaaaccaaaaaggaacagacgcagatcttaatcaatttagagggaaaaagaaacacaagtcatagtagaatctgtatcctgtgctttatccaaagagggttttgaggacttcaatatttaaaggggaaagggtaagttagaaaggaaggagaaaaggaagaagcaggagaaaaatcagagttgtggggtaggcaatgaggcaaatggtaacattcttgtgaccactcagtagggacaggctcagaggaagcaattatagatgagtctggatgagctcagtgaatctacagtttacatatgaaaagaaatgagtgggggaagtcaactatgcatgcctcttctgaatggtgaatctacattttacataagatgaagtcaatatgtgaagttgcagctacctctgtgaacacaaggaaggcagtttttgcacaactcggttcccaggtgtaactttacctttggcatagtgaatttggggtcctgatatatattttttcctttgacaagggatgcatttttgcattcctttgaatgcaaaaaattctccaccattgggacttgtagagactaagaattagtagtacttcttctgggcatggtggctcacacctgtaatcccagcactttaggaggggaaggctggccgatcacctgagttcgggagttcgagaccaacctggccaacatgaagaaagtccgtctctactaaaaaaaaaaaacacacacacacacacacacaaaattagccaggcatggtggtgcatgcctgtaatcccaagtactcagaaggctgcggcaggagaatcgcttgaacccgggaggtggaggttgcagtgagccgagatcatgccattgcactccagcctgggcaacaagagataaactcttgtctgaaaaaaaaaaaaatagtggtagttcaagtccatgctggagtcttgggatgcagatattttgatgaccgcaccatgacctggccactctcctcttagttctcctcactctgcacaggtgagggctgacctgccgtggggtgaggactccacagagaccctacccatgcagcagcaacacctgggatatgcccccaaactcctgatcttaggaataacaacttctcctcagggatcttagagattccctggctccaggtcaggcagtttggcctcctctgggctccagcctggggatgaggcttgttatcactatttagtacaggacagcagctttcaacaatggttgcattgtgttggaggcccacaaggaaataaaataaaaacctgggggcttcctctgactttttcaggctcatgaagaagaggccaatgaaatgtgaggagatgtggcctgtgggtttctggtgggtggtggcctgtgggtttctggtgggtggtggcctgtgggtttctggtggatggtggcctgtgggtttctggtgggcagtgttttgtgtttgaaggggctgttatctaaaggggctctttttaagttgggagtactaccaaaactcaataaatccaattaagaatgcttagaattattcattagacacatatttatatgcaacagaattctaaatatttttggggtgtgatactaggcattccatacattgtaaaggacagcgagtctagacgcatctacttggccctgattgagtttcagaagaaactgagaatgctgctggaatagctgagggaatcgtcacttacctgcttttttcccctatctttcaattccatgtagtgaccagggaacaattatgtagattgtctatcattaactgtgtcgattggctccttcctgtcatctctggcacaggaacagtgatcccctaacacaactttcctctttagttttcaggaactgagtctcttaacttgtgcctagatctagagccccatctcctcctgtttccagcagtccttgaactcagctgtttgaggagaattaagggtggccatgagggtacaatggagttaactcccacggagcgcttgtgcttggggaggatctggaccactgaagcctgaccacaagaagtgatatctgctacgatgtctttagggttaatgaaaatgagctataagggatgatggtggaatgttccaggcattgttaacagcatttgtcaataatatttttgaaaagaatatctggttgttgattctatttactaagagagcttgcattgggcctaagtgtggcagatctcagtggggacagggtcagaggaagccactctaggtgagtctgggtgacctaaaggaaggatgtgaatggatcattaagaggtcgcatatgcttgactgcagaggccatggtagtcactgaagtgtcctcctctggcatctgtgagctctgtaggtacagagtggagagtggattaaagggtaaactgaggcaacatctgagactgggagagtagttaggcatcaaagacaatatttcacggagagatgacaatatattttgttagatttgtgacagtggagaagaagggaagttagcaatctacaatccagaaggaaagagtaattggagagaattaaaaattaagtgtgtgccccgtggcaggaaaaggaaggcatctaagatgactcctacgtgtctggttggaagttactatatatataaatataaatatttatatatatagtaaagcagaaaccagtgaagtcatgtgatatttgtaatttgttttaatatcattcagtgagagattagcatgagaggtagaaggaatggttgaggctagtctatgcctgtggagagtttgttgaactagtctctatagtttatgtaacttcaaaaattacctgatacacacacatacacacacacacacactgtcacaggtggaattctgaaagttgccaaaatataagcttccaccctgacttccagttgaatcccatctccccccaacagacagagggggagctggtatggagaccatggaagggacagaaactcaggattcccatgacagagaagtgagtaaggctggaaccccaatcaaggggaggggctgtgagccagtcagaggccagaccaggaatgtgccttagggaagctggggagtgtgagttttatacaaacagcaatgaggagtcagtgcaggattctaatccacggggtgacctgcccaacatgaataaaaacatctctctggatgtttgggaagagagtacctggggaagaaggggattttgtgtgtaggttgttactggatgggcccatgagctgaggatttgggggatcattcacacagttaaagtaaatttggatatggagtatgatgaggaggtgatgatttctaaattttcctgttcaagttttctacatgtctacaaacacattaaaatgtctctcttagcttcataattaaccaaaacaaagaataagcaaatacaggttttttttaaaaaaggtttaaatgtaaacacattatatgacactaagtccaaattctgatataaaatatctggaacaactatttagaaaactacaaactttaaaaaataaacctcacttcataaaataaaaagtgtgtatacactattaactagtgtattaggcctaccaagaccatgactattagtaaatcacatctaagccctatcaaaactctaagagcattgtgtgctgttagaggtaaagcattgtgtgaaatgtttgctgagaattgccatcttttaagaaggccaccaaccttatctcctgggaattttccattcaatgccattccctgaacagcccctacacatgtttgaaaccatcaactgtaacagtgtctgtgatgctgaccagatggcacacgtgggtcattcaactttttccagaatatactctgggggtacaaacaccttaaaaagttacattcacagcagtttgtaccacatagaaaccaagactccttttgggagtgagaaactacaataataaagtacaacatatcaggatcacagaaggtaggattcggatgatggatgtgtgaacagagatgatggatggtgaactacagagacaggctgggctctcaggtctctgggccacggaaggagtgtgtcctgtaaccagcacaggacacagctcagtaagaaccatatactccaaggagctcggggcttggagctgggccctgtgctcactgatggggactcagcagctgtgtcctttctggcctggcagagtcccctgagcagggacctgtgtatggtctcagcaggtgcttcctcccagggccctcccaaggcgggaagtaaaccttcctcctcctcaggctgcagtgtgagctgagctccagctccagggctcagggaggggctgggcagtcccctgatggaaacacacttgcatgagcagcccctcctctgcagagggtggggaagaaaaggatgcctggggcagtccagccccacggtgtggtggggtcaggggctgtgtccaccatggacttgactcctcccctccttgtgatcctgtctcactgtacgtgtcgggacgggcctcaaagaccagcctacatcagaaactttgactgaggcccctgagaaatgttaccctgaactctgccttagtatctggatgtgtcttttcacctgatagagttataaagattttcccagttaaaaacaaaagcaaagctctgccagactcgtgttcgtggctccaaatctgcttcagccactgagcaggagctgagagggaagagagagagaagaacacaagatccatatggggaaggatttctatgagggtgtggcagtgagagcgggtggcaagttgccaaagaggcctaagccacagaagtgggtttcatgtgggactttcggaatgagcaggagggcgatgggtggagggtgagggtcagaagattctaatcagaggtgagaacccaaagatgagttattggtcattcaagtcaaacagtgaaattaccttggcctgtgcctccagtcagtggagcagggaaggggccaggatgtgcttcctgcaggtgttactggaaaggggtcctgattcagatcccaagagagggttcttggatctcatgcaagaaataatttgggaggagtctataaagtggaaacaagtttattaagacagtaaatgaataaaggaatggctactccatagacagggcagcaccaaacactgctggtcggctatttgtatagatagtccttgatcatatgctaaataaggagtggattatttattagcttttcaggaattctttttaaaaatatagaccacataaggtaacttgtggatgttgccatagcatttctaactgtgaggacaaccagaggtcactttcctcaccgtcttggtttcagtaggttttggccggcttctttagcgtatcctgtcttatcagcagggtctttatgacctgtatcttgtgatcccagtctggttgacttcctagctcatcctgtgactaagaatgcctaacctcctggaaatgcaggccagcatgcctaagcctcatttaatcaagcccctattcaacatggagtcactctggttctaacacctctgacttagggtggctgcagagctggaggtgcagattggggcagatcagcctcctgagaaaagcacacagagccactgcggggctgtgaggtgggagagatgaactcacattggcatttgatcagtgactctccagctgtaatgagaatagaatggagaggcctgggacaggaagacaggatgtggttgctcatgccatcctggtgggaagatctaggtgagttactgtggggtaaagaggagagagcagattccttgtcactttatgctgtagaatacattggacatggagagggcttggagcttgtgtgtgagaaaagcagatctatctcggctgactcccaacaaactggctgagaatttagatggaggattattattaaataaaagaggaagactgaaatgaatattgtcatcgtatttttttacccagggttgggataggtggaaatgtgtgtgtgtgtgtgtgtgtgtgtgtgtgtgtttaaatattcactaatttttcaattcaaaaatatttactgcgtgactactaagtaataatattatacaggttttagcgttaccatggagaatcaaattgtcaaggtcacaggcatctttttgttttgtgtggatcactgtgaaagatactatgctaaattttttctgaatcatgcagatgaaagcattaaacacatacacaaacatttacgtttgtgtgtgtgttgtgtgtgtgtgtgtgtgtatgtgtaatctatctcagcatacaatgccactgaaactacacttgcggattaggtcctcggaaaaataatcgtgttaacattcacgatgcaaatagaatggtacctgacacaaagtaagtgctataaaagaatacttgaggctgggcgcggtggcttatgcctgtaatcccagcactttgggaggccgaggccggtggatcacctgaggtcaggagtttgagaccagcttgggcaacacggtgaaaccccgtctctactaaaaatacaaaaattagtcaggtgtggtgatgggtgcctgtaatgccagctactcgggaggcttaggcaggagaatcgcttgaacctgggaggcggaggttcaacaagagcaaagcccattctcaaaaacaaaaaatttgaatggttaaatcacattggactgtgagtaaagggcttagacaaggtgtctcggaacttttgggtcatcttcttgatctttccataaaactctaacccttctattcttaacctcccccattcccaatttcaccctgatgtgcacatcctacctggtgcctagtcatcccggtggcccctctctgggctgtatctagggagagtggtgaccttggtcatcttcctcaggtccaagtatccataagagaagcagacttttctctctttcataatgatggtctcttcttgaataatttccctgtgcattttcattaagggtctcaccccatcaagggtgtgatgaggacagtgatgagggtcacggagcccggcctcccacggggggatgtggggtatgatgagagagagaagcaggtgccctcaggcccatatggaggctggggagggttgttaaccctcctgccctcctggccactgggtgcaggacatgttctctctgaggctcactcacctatggccccaaccacacaaaaatctaaatggggaagaagcagaggatgacttcatgctgaggaggcccatcttgcagcgagaaatgtgctgtggtgagcacctgcagcacaaagagcctggggtgggggtggaggtgcgtgagcgctgcctctgtgtggggatggtgtgcgcaaggcagtgctgaggaccttcaagccagtcaggaatgaacctgggctctgagacagtggagggaagtgtggcctgtccctgagggtctgtgggggtttcaactgggaaaccaggccctggacccctaccctgggccctctgctctgtgctttctggggcccagcagctgggacctcccaggagcagaagaggctcctctagccccaccccacactcaactttccccaagttcaggcccagggatagcagggggaggggtgtgatttgcatgaagggtgctctgtgccctcttaggaggagaggataagagagactctgtgcagttctgctcagctgtgggcttaggaagcagagcctggggcatctccaccatggcctggacccctctcctcctccagcttctcaccctctgctcaggtgactgcctgtggaatgccaaagtgattattggggacacatgggatgacttttctcttatattttaacattgtggggtgggtagtgaacccagactcacctctctgtgcctgcctcctctgttccagggtcctgggcacagtctgcgctgacccaggaagcctcggtgtcagggaccgtgggacagaaggtcaccctctcctgtactggaaacagcaacaacgttggaagttatgctgtgggctggtaccaacagatttctcacggtgctcccaaaactgtgatgtttggaaattctctgccctcagggatccctgaccgcttctctggctcaaagtctgggaccacagcctccctgactatctcgggcctctagcctgaggacgaggctgattattactgttcaacatgggactacagcctcagtgctcacacagtgctgcaggcacatggggaaccgagacaaaaacctgcccttggcctgtcccgaggctgatcactccatacttgcctatgacaaacaaagagggtgcctgtggctgatcgtacagtttaagcaagggaggaagtgagactcagccacaggcccctgcaaagggtcagcgggccttgttcccacattgtctctatttgaaaaagtgagataaatttcacttcgtataaaatgtacaattaaattgtcttattgtgtttacagaattatgcatctatcaccataatctaattttaaaacgttttcatcaccccacaaaaaaacccccacaattagcagccacccttcaccctttctccccagccactggtcattgctaaagactttctgtaaagaacatgcatttaaagacctaagaaactcagtgatgccaaacagctaggtttttcaaatgcccaagcatgtaataatagattactgaaaccaaagataaagacacaattatgaaagcagacagaaagctttataatatatacagaaaatcaacaattcaaacaatgagaggtattttatgagtatacattgaggccaaatggcagtgttatgttcttacaaagtcaaaagaaagaaagaaagaactgttgagtcataatgctatatccaggtaaagattttttttttttaaaaaaggtaaaaaataagactttgtcagatgaagaaaacctgaaagaattcatctaaaaaaaatcaaaacaaatcaactctaagagaaaattttcaggtggaagataaatgataatggaaacattgaacccaaagaatgcaggaagaataaccaataaatatagtagtaaaagaccaaatttttagctctacagttctggaaaatatgcatatcaaaagctaagttatagcatttttgatataatttctacttatgaaaaatattatatatacatatatacacatatatacatatatatacacacacacacacacacacacacacacacacacacacacacatatatatatatacatgaaacttcaaccaaaagaaggaactgtaaggggtctacatgactgggaaaatattaggcctattattaaatctaaatagatcatgaatagttacatgtacatgttgtaatctttacagcaaccaatgtaaaactgtgcagagataccaatataaaatcaatataaaaatcaaaagagcccactaaataatactcaaataatccagaagtagcagaaacagggtggagaggaacaaaagttataaagagaaaaaggaaacttacactaaaattgtaagcttaaatccaaccatgtgaataatttcattaaatgtaaatgaactaagcacatatattaaacacagagtttgtcacactgagaaaaataaaaaacaagagacaagcatgcgattctataataaactctaaatagaagtatatacacaaaagtaaaatgataacacaaataaacacctagttaaaatggcataaagcattacttcaatgttaattgcatcattctgattttctaaattgcatattgtgttgtaagatgccacttttgaggaaaactggttgaagtgtaactaaacctttattacatattttttcaccttaatgtgtatctataattatgtttacagaaaacattaaatgaaagtaaaaggatggaaaagttttatcatgtaatcctgaattaataacacaaacatatagtgtggatatttctttgcgtttcttttttgttgttgtcgttgttttttgaaaaagtctcattctgttgcccagactggagtgcagtggcacaatctcggttcactgcaacctctgcctcccagattcaagtgattctcctgcctcagcctcctgagtagccgggatacaggcgcccgccaccacacccagctaatttttgtatttttagtagagatggggttttgccatgtgggcgaggttggtctcgaacttctgacctcaggtgatgtgttcacctcggcctcccaaagagctggaattacaggcataagccacaacgcctggcctttttttgttttgttttgtttttgagacagtgtctcactctgttgcccaggctggagtgcagtggtgcaatcatggctcactgcagcctcaaactcccaggctcaagcaatcctcccacctcagcttcacaagtagctaagcctacgggcacgcaccaccatgcctggctaattttgcttattttttgtagagacaagatctcactatgttgcccaggctggtctgtaactactgggctcaactgatcctcctgctttggcctcccaaattgctggaattacaggcataagccaccacacctggcccagtatggataattcatgggtaaaaaatgtaatacttgaaaaacaaattagatgttttcttattatttccacatagcagagtactaactgtaggacattgggatgtacttttgaataagaaatgaaggtttaaaaaaagataaaataaaacaaaataagtgcctaaaactgactggtgaggggtttacccaatgcatgagcagtagaaagaatttaattttttgcatccaggatactaaaaagtggaaagatagatttcttttttttcctgttttacttcttttgggttgctctatttgatctaattaaaaagcctattactcctatgctatgctgatggaagagaagtcttctctaacttagtcccagtgagattgcctcctctgggccaacaatgctcatctagaacttggaatttcgataaatccattctgaggtgatgagcagcagcagcaccagaaaagttgatccaggccatctaggaccctccagggaagggctcaggcctgtcaaagaggcctgatagaaactggggcctgcagtcagtcagggacattgaagctctcctgacacggtcccaccagctgggaaaacactcggggtctccctcgggtttgatcagatggcaagttccccattccctgattggcccaaagctttgacctgttggacccggggcctatcaaaggccaggtgtcctctccccattggaaacctccctaggctcaactcttctcttctcattctcctgctggcctgggagcatccaggccaaggggtgaggtggggacagccctacattaagtttttatttcaaggtagaaaatctgtccccttgattgtttgggaaactataaaaagactagggcagctcagggtctaaaatacagcttcagggagtacagagttagagtgcagaaacttcaattccatttactctctagcaatttacctaatatcaaaacatacagttatgttatgtttacaaatatgcacgcacctctattaatatgtgttcataagtacatacacatgcaccattacgtttacacatacatgcatgtaacaccaactgatgtaaaaatcattgttttatgtactcagttttcctttgagtttaccctcttttctctactttttaaaatatttatttctaatttggggagctactaactgagattatttttcatctcactgaaaaacagttttagaatttcctgtagagcagttctgctggtggcaaattccatcgggttttgtctgaaaagtagccattttctcctattttttctgtttattatatagaaagataacttatataaagtaaaattcacaggtcttaattatacagtttgatggtttttacaaatgcagatgctcatgtagccaacagtccgatccattctcacaacatctccattactgcagaatggagacattctgttccagtcaatgtaaattatcccattacacctaccaaatagaacgtgtatgagagacacctttctcctgaggacttttgcaaagtggggtggatcatgtgtcccgctcccactgaaaagggctaaatggaaaactaaagtctgaaataaaataggaggctgccctgacgaggggtcccactttgcccttggacagagaacaggccgtggtcaaggccctggtccgggcagaagcctctgtcaggacccactggcatctggtcacagacacgatggacctgggcctaggcagaagggggtgctgttggtctgctgctgagggctctgtgggtttctcagctgggaaaccaaacacttgaacttggtctccacgcagggttcactggggccagcagctgggctctctctgcacccttggagagcctcaggccaggcccagcccaggtaacccctcccagaaatgtcaccccaccactgggactgacactcaggcacacggagtgatttggttgggcagaggaagaggagcacatttgcatgaagggcccctctctctcctctgggactacagggtgggtaagaaatacctgcaactgtcagcctcagcagagctctggggagtctgcaccatggcttggaccccactcctcttcctcaccctcctcctccactgcacaggtcaggatggccctcagcaccctgacctccagctcactgataccacctcccaaacttatgccaggaatgtccttccctcttttcttgactccagccggtaatgggtgtctgtgttttcagggtctctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactggcattcacacagtgacacaggcagatgaggaagtgggacagaaacctcagcctgctcagggtcttgttatatgacaagttttaaattttcaaatatgttttatatgtacacactccacttggaagcaccgtctggtttaaaatgtttctactctcaatttctcattcaagttttctgaagtctcaggaaaactaaaaacagaaacaaaaatatcatgatgactatgaaatattacctaattttccaaatatgctgaattcagtgcctgtggagctaaccattttctcttgacagaagaaaaatgagccttagaaattgtttccaaatcctgaaagagtcatcattccatgtactcaggacagatttagagagtgctgaccctgccctttgaaagatgttatttgcctcttagtgcccaaataaggaaggataattaggaatcagaagcctacctagggctcccctctctcctctcaaaattgcacttggtgtcatattgccctagaatttatgcctggtgctggcaaatatttttaaatttattttttaatcttttccttttctgcaatcaaatttcttgaggggctgagaagaagaaataggcccagagagaagcaaggcagtctgggtgcaggctctagacagcccagggagaagaaagagggagcagctccctgtgtcctggagggagccctgtccccattgggcttcctgctctgatgtcccctagtggaggctcctcagggagtccagcctcccagaactgccctataaacctcacagtgagctaagcaagtatatccaggaaggagggtctgtggagatgtgagactaaggtgtgttatggcctaaacactgcccatctccatccttcttggggatgacaaagtgaacagtggaggagacaggatacatgggtgcatctggacctcaagcagtaggctgttctgtggtctgtccctaaatcttgtgctggagaccccatacgagagccactccctgaccctgggctggagccctctaccccctgctcacaagaccagcagctgtttccttataggcccccagggagccacagaacagcatcaaccaagaccatcctcttcatgtgtcagcttttcagggagggatcgaagtcatggcccaggaaagggcttggacagcccaggggaggaggctggttggtatgaaggatgccctcctcaccctgagctgctggagggagtacaagggacttggagagcccaggctcagttgatgatcctcaggatgtagagctatgtatgggtctccactgtggtctctcccccgccttctccttcactgcacaggtggctagggctcagtgtcagggctggtgatcaaaagaccaaggtttatgcatgtgtctctgtccactgacccacctctcaccctgtgtctgtcttaatgtccagcgtcctgagcccagcctgtgctgacccagccacctgcagtgcatgcatctgtggggcaggtgggtaccagctcctgcactagaagcagcagcaatgttgggcacgggcatgtgctctggtacaaacatgcctccgagagacccagagctccacatatataaaagcagtcattgacccttaggggcataggcccaatgctgaggctccaggttggagaacatggcctctctgagcatctctggactccaggcagaggaaaaggctgatttttattctcagcttgggacacaagcaccaaggctcaggcagtacttcaggccagtggggaagtgggagaaaaagctgctgcccatccagcaatggagcttctctgtgcagcccccacttcttgggcaagtcagctgattaacgttgcttttcatttgtttagtaaaaatttagattttaaaactcactccagtgaacgcagtgtggagaatgtgtttctgtcctctcaattctaccctcacacccaacccttggcagtaacaaattgtcgtattgtctcatattaagagaaatccctcaataccaagatcaggctgtcctggaaaccaaatccataatgggtcaaaacaggaccagggtcattgtgtctgactcaggatagtcgactcccaaaggtctgtttatccacctcattcactgagaagctactatgcaccagcctcagatccagggattcaaggtacatgatgaacaagagaggaaggggccctgtcctcatggagctgacactgagtggtggaacagataaggcaatcaagtaaaaatgtcaatgcgacaatatgatgtcatcacacagtgaggagagctcagttgggggtagaggagccatcagaaggttgggcaaggaagacacaggatctgactcaagtttatgaagaaaagtccagatgcctcaaagaagatgaacaaggagacagcaagcatgaaggccacggggccagttggggtcattggagagaaaggtcaggtctagcctgtgtttgtaagaggagggactgaagcctgggtgaggagagagggctcaggaatagccttggaaagtggagggagtggatgcgaaacccctgctgagggggcctccatgagcaatgaggctgggggaggccctgagctaatcaccatgatggaaactcagacaacagcctcccagcctctttcaaagttgtcacaggacgcttttctctccaaatggcaaggggggaatcccactatgagttttatttgagatgtctcttctccatgtcctgtcctgtccctaggctaaattcccatgcgcaaacaagatactgctcagtctcaggtatcacattcacacacaaatgctccagaatgagggaatgcactctgaccaacccaccaggaatttttgcctttgagaatactagatcagatcactcacaccatctcccctgacaccatcatgttgaccagtgggttgtctgatcggtttggacagcagaatgcagatgcctgtagttgcagctggggtcagtcacatgctcatctcatggctgggagactttgggtccagacaacaggaaaaaaaggaggtttgcctacgtgatcccacaatgtgcatcactctgtcatccactcccatccttagttcatgttgggttttgtcctgtagatgctgggacctggacaggatcacaagccaggcgatttctggctcacaaagttacagctcaagctccctgatgttgctgacattcttcccacagaccaattttagacagacacactattgccatgcaggcactgacctgagatacaggtagtctcaggagagggaggaagcagatacacatccccatgatggcctccttgtcccagagtgggtaagaaaggcaaggaggccaggaagccacaggagtggccactgcccaccacctgtgcacctgtccctccctcaggtgagaagcagcctgagggtccagcacctgcaccttttcccagtgcccacacacttccaagtggggcctccttctgctcacctcccaaagctactgctttccgggacatctgtgtcattgctgagagtctacttttcatggggcccttgtcccagtggtctgggatcagtgtcagcctgtttaattcagcactgtctctgtcctttcaggacaccaatctagctattaaagctctaattgaattctcctttttttgccctgaaactttagactctccttctcagtgtctctctagaatattttgtctctatccaataagatcaagttatgtcttcaggcctacagccacttctttccccaaattctgcaccttcttttaagttcttattccctcttatggcttattttccactaactagctaatgatgccaaaacatttatctattttacctccttcaggaataaaaaagaaaagcatttatcaatagcccattgtcacaaagaaaggaacagaggagagatatcttctagaaaaatacaggtgaacaaggaaaaagttttaattcctcataggaactactccatgatccaagaaaataaattccagagattcaagagttcactccttagaaacaacagtgtaaatacaaggtagtaaattttcttggttttctcaatgaataacctcaaaagggttagagtatgattataataaaaagattatacattactttcaaaaatgtaagatgaacatgtcaaaaattttaatcgactcatatttctgaaaagaccagtaaaatggtgaataattttaaagaacattttaaaacacacagagtttctattccacgagggcaggacctgtgaggataatttcctgtgttagagaaacactgtcctaaacaacaatagtagaactctctaagctctgaatttatcttctcctgtaagaaaaaatctacaaagtgacaggatccaatttatataaaatatctagcaaagattttggacattcccatctcacacctcctctccaggctctcctcaagtgaaatctactctccttctgcccgtgttctcacctttctgcacgcttccgcctgctgacacatggcttctcctgctttcctttccagtagccctaacagatcaggccctgccagtaagtaagctcctggcctgagggaaccacatcgcatgttactggatttctgaggcacttgccctgccagggtctctctttctgaatcacaatccctgtattcctgggaattctcttctcctggattctgttattcagctctgtgtttctccctccatatctactttgtgaatttctctacatcttcacctgaatcccaggaagcctaaggacatgctgatgcttcctcagttctcatgtcacaccctgttccctcctcctctatgatcccaccaggtcatcctgcatcagaaccctgagtgcggcagaggcttctctggcctccttacccccagtggcagaagggaggaagggaggtcccctgtggcctcccatccttgtgctcccattagggtcagcatgaagcaggaatgaggctgtctatatcatcatggcattcccaacactaaactctgtgcccaggagaaggtaggcactcaataactatttgacaattgaagaactgcctctcaccacactggccacattgtactggactcaggatggggctgaactggaagagtcagctgtgaacctgctcttgtctctgccctcagcctgagagctgaaggggaacctaacagggagagcacccatgggcagggaaggtacattagtagcctcatcctgtttgtgaggctctgctcagccttgggaatccctgtttattcaaggcagagaagaaggaaaacaattaaccaggcctggccaacaggcagcatctacaaggcgatgagttgagggccagatggtcagagttggttctggcatctctcaggcgcctctctccatgttgcccttttttgcgatccaggggtgaggtttcaccccactgagcccccacccatctagatgggctctgctgagagaaaaacccattttctagatgagcccactgaggctcaaggggcacatgtacttggtgatgcaccttcttcctttagagactggtcagcctagaacaccccctctcgagtggccttctggtccctcatctgcccagccccacccagatctccatgaacctgagctgtgtgagagaagagggaagagtaggaggaagggaggagtccaggccatggtgtggatgttgcaggaacccctgggtcttcaaactgaggctggacaccgcaatgttctttttatctccctcaaattttttggtaaaatgtcagtgcttgtctggtccattattcaaacctgattctttttaccaccatcataggcatacatttctgagtcttcatcccagagaacagctcctctctaaaggggaggtgtagggtggctgtgagttctgagtttgcccctggggaggaagcacctgctccaccatgtgcacaggcctgtaagcaagagtccaactttgttgaaataggaaccatttgagtttgcttcaggccttgctgacctcagaagtttcacattgtcccctggtgacctcttcacaatgatgttagtggtgatggaacaatgcaggacagaaggccttccttactttctttcaacaaaaaaatggtgtattatctagcctgacagtaccctagctggagacagtgaaaataatttacattttaaacaaataatgtttgttattttttcaatctcatgagtgtaagataaaagtaatcctatctcaataccaaaacaaacaaacacgaaaaaccagaatctgaggagactgaagtgtgttgattgagagacagtaagaataacttagtccagctcccctgcctggctgtgaaatccaatgatccagtgtcccactctacagacaaacctacaggtttttcacccaatgcagacagaagacatggtattgaattcatgagtccccgctgagagtcacaataggctggtgtggcacaatgcattatgggaggcacagaatgaagggacaacatgtattcagtggattctgctctcttatcagactgagtcactgcacagactgctcacagggtttctccactgcattctgcctcacataaataaacaccaagagccataggatattagtcaattatattttctccttcagtgtcatacttgagatctctatcatatttgaaattggactcagagagcttcaattattttgttgcaatatatattatctttacaaaaattacctagactactgtgtttctgaaaaataaatcttacaatttattttacttccatgatggtattaaacttgaatggttagcatatcagccagtagtgtgtctggggctggacaacagagagtgtttggggtccattcctgaagggtgtgtgtgtgctcagagctggcatcatccacctattctgactcctgccctctgctaagtcctcacagctgtgaacttccaaacccctgggacaacacagctccactcctgctcattcccctgatccccaaaggcacagggccctgatcctgacccaaacacagagtgggatcaaaaagctgagaggttgtcacttgcataggtggatttttttcctcaaagagtataaagagagggagaaagattgggagaagctctgcggtagctgtaggcacagaaggcaggaatcaggccaatctccaccatggactggtcccctctcctcctcatactcctcactcactgtacaggtgactagacacaggcccaggggaggagccctgggaagcccaagggactctgctttctcatcttgtctctagaacagtatcaccacttctgtgtctcttccacttccagggtcctgggccaagtctgtgctgactcaacctccatcagtggcaggggccccaagatagagggtcactatctcctgcactggaagtgccaccagcactgggggtggttttcatgttaatgagtactagcagctcccaggaatggctccatagctcctcatttgtgaaaacagccattggccttcagggttctgtcctggttcacaggcttcgctgagcatttctgggctccagtctggggataaggctgactatttttctttatcttggcacacaagcattaatgctcacacagaactgtaggccaccggggaaggaagacaaagatatgctgtctttccagtgacagagtttccctgtgcagcccccaacccattcaccaaataagtgcttaactgtgattttttttggtggacaaaatgtggagtatgagaagcactgaagcaaacatggtctaaataatgtttcccagtcctctctcaattctacccccatatccaacccttggcaataataaattgtcatactgtcatatattgaaataaatatctatattagtccattctcacattgctataaagaactacctgagacagggtaatttatgaagaaaggctcacagtctttaattgactcacagttctgcaggctgtacaggaagcatgaattggaggcctcaggaaacttacaatcatggaggaaggacgaggggagcaagtacatcttgatatggcagagcaggagagagagagaaggggaaatactacgcacttttaaacaaccagaactcacaagaactcactcatgatagtgaatcttaagaacagcaagaaagaaatctgcccccacgatccaatcacctcctaccagcccctcctcagcatgagatttgggtggggacacagagccaagccatatcaattcctcaataccagggtcaggcttccctgggaaccaagtccatcatggatcaggacaggaccaggaacacagcacccactgtgtctgaccaaagagcctcaactgccagatgtctgtccatccacaccattcaattagcacctactatgtgccagccttaggtctaggggctcaaaaacagggtggacaagacaggaagtgtccctgtcctcatggaccagacaccatctggtggaagagatgagacaattgagtaataatatcaatacaataagatgtcatcacttagtgaggagaggagaggagagctcagtaatggtggtagaggagccatcagagggttggacaaggaagacagaggatctgagctaagtttgtgaagaaaagtccagatgcctcagacaagatggacaaggaggtgggaagcatgatggctgtgggtccaactagggtcactgggggagactgtttatacccagcatatgtttgtggggaggagggactgaagcctgggtgaggggagagggctcaaggctggccttaggacatggacaggatggtattgagtcacgctgcagaaggagccttcatgggcaagggggctgggggaggccctgagctcattattccaatggaaatatcaaactgcctgttagcctttgtcaaaggtatcaaagagactttttcattcaagatggcaagagaggaatctccctcttagacttctttgagatattctttcttcatgaccgtttcttgcccctggatgaatgctcacatgggagcaaattacctcctcagtcccaggatttcaatttgcacacaatccccccagaatgatcgagacctgccatccctgacccactgatcaggaattctggccttcaggacaacttgaccagatcagtcacaccatgtcccctgacaccatcgtggtgactggggtgaactgtcagactggtttgggtaatacatgtcctgtccctggagttgcagaacctgttcagaaagataatggtgtggatggagggaggctaattccagccacatcagaaagcaagaaagacatggagaccacccttgagctggcacagcatccttgggtctcacatgtgtctctagcgactggaaaaggaactcagatttaactaattctattttctcatctgtcactctccctttcactactgactcctgaagccccaacaaaagcagcactatgggattatggtcatggaatagaggccttgctgctgaacttttcttttttattctaaaaagtacaacacagataatgcatattaactaaaaattataaaaatgtatttaaatgatgtgacaatgaatgtataaggggttaataggagaaaataataaacaatgttaaaaaatacaaaataccaatacactataagagttatactatgtcatggattgtataaatcagtattgtaaagatggcagtgtcctaggattaatccatcaaattaatataagtgtaattaaaatttcagtaatattttaggaaactgcttaacttattttaaaactcaaattgaaaattgagataaaaattacctaagattatttaccaaaaatttgtaatggaagtgataccagatattgagttatttgaccaagcaatattagctaaaatcatgcatgattgagatcttgacatttacataattctcttaaaaattagagtagataggactgatgattttttatgtgaccttggaaatatggctaactctgttcataaaattaagtagagtacctaattcatacttttattaaaaaatccaaacagatttaaaatataatttagaaaagaaaaagtttaaaaactttagtttggaaaaatagaaatattatttttatttcatatgagaaagtacttcttaaataaacccaaaagtcaattcataaaagaaaatttgaagtatttggttgcaattatttgaagctttttttttcccaaagaggaccacagttggtaaaaagagagaaggatatgcaagagtggaaagacattggcaaggacaaagtattgctgtttgcatccagaagacaactttgaaatgagcgaagacagaaaaaaaggaaacccagtaaaaatgttcaaaggacacaaacaagccattcacgggtctcaaaatgagagcagataaatgtgacatcaaaatatgttaaattccaccagagacaaagagaagggaataagatcttcaagtagaaattgtggaatgagccaagcatgtctgtgcatggggagctttccaggccttgcaaaaagcaaagagagtaagaaaagagcaagaagggagtgagaagcccttttgtagagaaaccaagaaaagaaagtttagagtgttagagcctgggccagaaagataaaagagagagaagaggtagataatgtgggatttgagtgacctttgattcctgtgggcatacttctgagtaagacatgaagccactgagggtggaaagctgttaaatgatattgcaaatttaaataaaaaaaaaagatgccagtgaggatgtggggaatcccaaactctcactcacagcaggttgtaaaaacaaattcagctattttgagcaaagtccctcagcacgaagataccttaagagggtgagcatctgtcttgcaccaagtccactctgtacagagacacaaggaaatgtttatgagaaggtccttactaggggaaaagtataaaaaacaagctagttgtcaaacacaaggggaatttataacctgcagttagctgatggaatgctaactagttggaagtaataaaataaaagtattattatgagtttcaaaggcaataaatatataaataaaattaaaaagccaagagctaaagaaataaattattttaaaatatgaacatgcactataattttttttaagtttataccatgagctatttgaaagttagactggaagcacattatatacacttatgtaagagcctctgaaaaagatggaaacacatacgaaggttaaaagataatttaaaacaatagagagttatttcagtagctgaagatatgagtgccaataaaatgaatgcgattcaaccctgtgagcattgctttcataaaaaaattaaaacagaaaatgaatattaatagatgacttaagtgaaatcacaatgtatgtggtgatacagctgaaagacaaacgttttgttagtaagaagggcatcgctaagcctgatgagtgctttgtttagaattcccagctaccctggattcctctccaacctcatgaacagcttcagaaaagaggatcaggacaaccgatgctcctctcattgaaatgcccggatgtggcagagaggcaggaaatattttgggtctgaggacagtgaggatcatcactgagatgatcctgcccaaatgaaaaccactcagggcctccaagggagttcagccatcagctcactggactaggtttgggatgcaacactgacctgccccgacccagagtcataatgagccaggccacctccacccactgggtcagctcatctcctctttatcttttctccttctgacctgtgagtacccagatcagggtggacaagtaagagacacatagcaaggtcttatgtgaatacagtgactctaccttacgacgtttttgggagatacaaaggtacttagaggagctcagtttccaaagcagtgctccaggaagctggaaatctgcactatgctctgggctcctctcctccatctccaccctcactattcaggtgagaaagaaccttatgtcgggggatccacacccagctctgctccataccccctcactctctggctcactgggttgtaaacctgctctcatggccctctctgtccccctgcagtgtctgtggcccaggcagggcagactcagcagctctctgtatccaagggcttgggatagacaaccacactcacctgcactggggacagcaacaatgttggcaaagatggagctgtctggccgcagcagcaccagggccatgcccccaaacacctgatcaacaggaaaaacagccaactctcagggatctcagagagattccctggctcccggttaggaacatggcatctctgaccatctctggcctccagaccaaggacaagcctgcctattactgctcagcctgggacagcagcctcagtgctcacacagcgcctcaggggaagtgagacgaaaactcaggagctcccctagcttcactcggtatgcgggggcgtcatagagcactgtttaaactaaaccaaaaatgacaagggctggtttccacgtgacaaagtgtgtgctattcaaaactattaaaaataatatcataagttaaaataactaaatctgcagtattaatgaatatttataggaaacattgttgtgaatatatttgtggctagatacttacatgaacatacacatgcattaatcagtagtaaaaatgaatgcaagggtaaactaaggaaatatttattttcccagattttccttctcttttatttggagatgctggactaaatgctcagaggttccggtggtctgcctttgagtgtgtgttcagcagggtcacctcaagcttatcccaccttcttatgacctgggcccatgcctgtcctctcattagaatcccctttccctctgtcacagagctctctttattccttctacagacccagacttgttcctcacacttagttgaggcttcctgggccccacgtccctgtttgcccccaacacccacacaagacaatgatcccatgtgtgtgctcttgttgtgccctttccttatcctctgacatacctcaggcagtatctggaaagaacaaatgaagtgggagcgttagcttgtagttgaaaatgatttttgatattttggggaaaatatctggtttaaagatagttttccatcgagataaaaatgcatgtgtgacagcaccacatttctaatggcggaccaaagccccccacatctttgccccccacatggctccagggacattgacttgttaatatacaacccaggagagagcactgtgtcctatgcaactgcaatgcagaggcaggtttctgcccgctcctccaatgaagtgagtagcaaccccaaccccatcttcacccatcatttagatgacccccatacaaccacaacatagaaacacattgatcaaagggcctttttctctttgcagagacccctatttgtttatttggcatgtgagattttagacttttaccaacaattaaaatatactttattagaaaagttacacttcttaagaaactctgattcttactgtgaagttaatacctaatgcatcctataagcatagtaagtggaaaattgttctgtaaggagaagattaatcaatgaaataaaatacaagtatttgagagcaatctaataggtaaaagattagaggacataattgtgaatgccaggtgcaatataaaggaaatgtgggccgggcatggtggctcaaccctgtaatcccagcactttgggaggccgaggtgggcggatcacctgaggtcaggagctcgacaccagcctggccaacatggagaaaccccatctctactaaatatacaaaaattagccaggtgtggtggtgcatgcttgtagtcccagctactcaggaggctaagggaggagaatcacttgaacccaggaggcggaggttgcagtgagccaagatcacactattgcactttggcctgggtgacagagtgaggctcagcctaaaataaaataaaataaaataaaacaaaggaaatgtgaatacctagagttgattaaattgtggcccctcaccttcaacactcgaaaagctcagagtgggtagaaaagcttgttgagttatcttctgatgtcattgacaagataaatcagggacaatagaaggaatatgtggaaagaggtgccagaggctagaggggaaagtgtgaagtagccagcagagaggagcctgctggctgactacttgtgttagtagtagcaggtggtgttgacgccatctcccaggggaaaaccctgggaaacaggaaagctaaaagcaggctcaccatcctcatccctaacagaaccactgaagtgagcacaccagagtgtggggttccctcccggctcttcagatgacattgttatttggcaccaagctgatgttagtatgttctttataaatatatattgcacaaagaattgcataaaaccttcaataatttaatgaggactttctcacttaaaaaggtttttatgtctcttctgtggcccccataggtagccggggatccctcactgcatttcagtctgacaactcatcacatggacagagtccaccgtgtgtgactgtgtgtctgtgataataggtggcaaagcttcactgtcatagccgcacctgcttcattgcctggtgcttgcctttctgaaataggaaaataaactcttaccaatgtgtcataattaggttctatttaaaatctcctaccaaagttaagagcagcctgcacaactggtccacaaaatgagaaacctccaatttatttggactcttttctctaccctacccagtgatccaactggtcaccagccatgtggattctctctccaaaacgcttttaaattcaactctcctgtttactttccattctcatgtcttatgtcaaatattcatgtcacttacctagttctgatcagttctctggctccatggacagctcccccaactctgccttcctgaccatctctgggctgcggattggagatgaggctgacttctcctgtcagtctcatgatgaaagctacaatctcacagtgctgcaggcccattgggcagtgacaggaaaactccccagagcaccctcaccctgagtctgccatcagcctctccccaccagcatgggttgctttttcctgtcccctgtttgaatgtttgaattcaaattttctgtttatgtgtctctctattttctttccaaaatacacaactttttctttcttgtcttcatggatggtttttctggtccctgtgaaattactttatgaagaatatttagtttaaaacatagtttctgaacattgtcattttaacattgtgcactgggtcattcattgtgtgaggggggctgttctgttcatggttggacatttataagattattgggactcacacatcagatgcctatagcaccctaattcccaaattctaacaaacaagcaaaaaatgtagacattgcaaaatatcctagggagacagcactgcagaatcacccttgtctgagaaccactggattaaaaggacatggtttcacgtattgggcagccttttgtgttgaaccctccttatcccattccactgaatataaggctacatgcattatatctcgatggttccaaatttcctcttaaacaaatgtgtgggatacaactccaaaggttatgttgacagatgaataatcctctgaacaccattagttcagaaaacctgctacccaatgtacagcatctcttgctgaccagagtgtggagtgaaacatttgaccaaactgtgtgcataattgctaattcaaatttttaggtaaaacacctaaaacataacacattcttctctacttatcctcttaggggttgcttttcaagcatggtgtacaaaattatgacaaggcctcgtatgtgtggagtttacattttagaatgggtagacgacagtagacaagagcagcctcagaactgagcagtcagtgaagtcctttttttagccctagcgctggatgcaaattttaccagctgccatttgtgtttttgggcttgctccacccagtacagtccccatgaactgcatgttgatatgtatatttcaaagttaattaattaaaactaaataaactttaaaaaatattcctcagccacaccagcttcatttcacctgcctcctggactcatgctctccatccatggctctcatgctggagagttcagacacagggcatctccaccatggcataaagttctactgcagagcacagtctgtgacaatctatttaacacttccttaggccagtttcttcattacctgtaatggggatatagtaacactcaagttctcttcacagtctggaacactattctctgtgggagtattacctcggccccttcttcctacagaacggaggagtgataatgtaactagtattggccaataagatgaacagaaatgagaggtgtaatttctgagcagtagatgtaagattagcctgtgctttgtcaagttctatcatctctgacgtaacacccacagtgttctcacagaattctctcaaccatcctgcatcctgggatgaaggtgaagtgaactgaagccccaagcatttcaatcagagatgggaatggtggaggagtgagaaatatacattcgttgtgagtcaccaagatttctgtcaatttctcactgcatccaagcctagccagtactgagtgctatggaaattataagtgaatgtggggagccacaatgacaaaattaacatctatctataaatatatataatatatattaattacattatatcatatactaatattaatatataataaatatataatatataacacttacatattatataagtatataatatataacacttacatattatataagtatataatatacaataattaatctatattacatataatatattaatataaatatatatacataatttgatttgatgcaatactgtgaacatttagtagactacggagattgcatgatgtttcattttattcactggcaaatatttaattaagctgtcaccataataaacattaaaacacacagaattgacaaaataattctcctgagctgtggatatacaagttagacaactgattagaagcataggttcactcctgtgccatttgtggaatttttacaacttatttactttaagtgatgattttaagcataattggtttttgttcttgctttttatttattcaagcagaagaaagacacaagaatgataacccacatacatacagagtagtagaatggcaagagctaattattctcaaacacaaattcttaaagataaatgtaaaatatttgaattaaacattttgctatccaaaaaaaggtatgccgtttttttcctgagtactccagggcaggaaagtatattcatcaatccccctggtgtccgctttcttaacacattgttcatattggtatatatttttttcttattacttaacttactcatcctatatattgtgtttcctaaatatatttcaaattcattctcagccttgtgatttccctcgccctcattatgtcccatgtcctgctggggctcccccataccacccctctcctcatctgtaatgccccctcccagttcctgccctcctgggaactgctgtgctcttttctgccctgagccttgttacctccttcttgtactacctatttgtctcagtgagctcctcttccattcttcaaaggctccagagccctagagaagagcatcatctcaaaaaatttcccaagaagctgcaagtaatgagagtgtctaagaccactctttctgctttatggcaattttatatttaacgtggtattgagtcttgctgaattttcagtctgaagtcataatgtgctcaaatatacaaattccagagacacagagcagaatggtggctgccaggagctgaggggaggaggaaatggggagttgctggtcaacaggtgtaaagttttagttatgcaagaatatgttataaagatgtgctgtgcaacacttatctaaatattaattattaatcaaacaaaaaattcaaaattattaacacacatttccccctgggtttactggacagatgattttatatttgtctctgctaagtagactaaggtgtaaggatttggcacgaaagttgtaaaccacaaacccagccaaaaacaaaatattctttatacagtttttcaataaataaaattaatttaatattgctagtttaataaaatagctgtgtcttctaagttatagataaattttgcatatttttcactttaaggatcttacttaggtaaacaactgcatataccaactactaatattactaagaaaaaatgatttagagaaataaaaataattttcttgtgtctcagttttcacatataatctaaataaatttttaagtaactaaattagatgaatataaatgaagtaaacacttctatctaaactttttgtataatttaaaatcttaaaaaataaattaaataataggtactcttaaaaaagtgtaggtcatttaaaattaaaaatatatattttggatatagttataaaaatattaaaatagttctcatgtataaaagatgaatttatgagagacaattcaaagtttcttacatcctaggttttgagtaaaaattattgttaaaataattaaaaattctaattaatatataattcaatatataaaataagacaaaaataaaaatactaaatatatgtttttaagttaaaaaagcaaagtcataaaatatatgctttattaaaataattttgccaagttaagatgttatataatggttacttataaagcaatataaaataaattagagagatataaaatattataaatatagatatctttttgtaaaaaacattagaacataattttatattgaacaatcttatataatttttgtcctaaaataagatgatttactattttaagaagacaaatcaaaatgtcccaacaagtcttagtctatgtaaattataataaaatacatttgggaattatgtcccaacatatcttactctatgtaaattatagtaaaatacatttgggaattatttaataaaattaagtataattaacaggactataattttaaaaattatgtcttcctaaatattaaactttaatattgaaaatacacaaatacaaaactgaatattttgattttctatgtccaaacacagttttcttaatattaatttactctaaataaaagatttaaacattgatttttaattttaacatctatttctctttaaaacttctcaaaattacacttcaaaagttcaaattttgttaatattttcacacataatttacagacttttattgtcatacctttcaaaaaaatgtaatttttttacttcactgggacaataactcttttctttaacctttttttaaattattatactttaagttttagggtacatgtgcacaacgtgcaggtttgttacataggtatacatgtgctatgttggtttgctgcacccatcaattcctcatttatattaggtatttctcctaatgctatctctcccccagccccccacccccaaacaagccctggtgtgtgatgttccctgccctgtgtccatgtgttctccttgttcaactcccacttatgagtgagaacatgcggtgtttggttttctgtccttgtgacagtttgcttagaatgatggcttccagcttcatccatgtcactacaaaggacatgaactcatccttttttatggctgcatagtattccatggtgcatatatgccacattttcttaatccagtctatcagtgatggacatttgggttggttccaagtctttgctattgtgaatagtgccataataaacacacatgtgcatgtgtctttatagtagcatgattcataatcctttgggtacatacccagtaatgggatggctgagtcaaatggtatttctagttctagatccttgaggaatcaccacactgtcttccacaatggttgaactagtttacagtcccaccaacagtgtaaaagcgttcctatttctccacatcctctccagcatctgttgtttcctaactttttaatgatcaacattctaactggtgtgaaatggtatctcattgtggttttgatttgtatttatctgatgaccagtgatgatgagcattttttcatgtctgttggctgcataaatgtcttattttgagaagtgtttgttcatatcttttacccacttttcaatggggttgtttgctttttcttgtaaatttgtttaagttctttgtagattctggatattagccctttgtcaggtgggtagattgcaaagattttctcccattctgtaggttgcctgttcactctgataatagcttcttttgctgtgcagaagctctttagtttaattagatcccacttgtcaattttggcttttgttgccattgcttttggtattttagtcatgaagtctttgcccatgccaatgtcctgaatggtattgcctaggttttcttctagggttttttatggtgttaggtctttttttttttttttttctttgagacagagtctcgctctgtagcccaggctggagtacagtggtgtgatctcggctcactgcaagctccgcctcccgggttcctgcattctcttgcctcagcctcccaagtagctgggactacaggcacctgccactgcgcctggctaatttttttttgtattttttaatagagacgtggtttcaccgtgttacccaggatggtctcgatctcctgaccttgtgatctgcccgcctcggcctcccaaagtgctgggattacaggcgtgagccaccgtgcccggccatggtgttaggtcttcattcaagtctttaatccatcttgagttaatttttgtatactgtgtaaggaagacatccagtttcagctttctacatatggctagccagttttcccagcaccatttattaaagggggaatcctttcctcattgctttttttagtcaggtttgtcaaaaatcagatgattgtagatgcgtggtgttatttctgaggcctctgttctgttccattcgtctatatatatgttttggtaccagtaccatgctgttttggttactgtagacttgtagtatagtttgaagtcaggtagcatgatgcctccagctttgttctttttgcttaggattgtcttggctatgcaggctctttttaggttccatatgaactttaaagtagttttttccaattctgtgaagaaagtcagtggtagcttgatggggatagcattgaatctataaattaccttgggcagtatggccattttcatgatattggttattcttatctatgagcatggaatgttcttccatttgtttgtgtccccttttatttcatcgagcagtggtttgtagttctccttgaagaggtccttcacattccttgtaagttggattcctaggtattttattctctttgtattaattgtgagtgggagttcactcatgatttggctctctgttagtctactattggtgtataggaatgcttgtgatttttgcacattgattttgtatcctgtgaccttactgaagttgctaattagcttatggagattttgggctgagatgatggggttttccaaatatacaatcttgtcatctgcaaacggagacaatttgacttcgtcttttcccagttgaataccctttatttctttctcttgcctgattgctctagccagaacttccaacactgtgttgaataggagagggcatccttgtcttgtgctggttttcaaacagaatgcttccagtttttgcccattcagtatgatattggctgtgggtttgtcataaatagctcttattattttgagatatattccatcaatacctagtttattgagagtttttagcatgaagggctgttgaattttgtcgaaggccttttctgcatctattgaggtaatcatgtggtttttgtcgctggttctgtttatgtgatggattacatttattgatttgcatatgttgaaccagccttgcatcctagggatgaagctgacttgatcgtggtggataacctttttgatgtgctgttggatttggtttgccagtattttattgaggattttcgcatcaatgttcatcagggatattggcctaaaattctctttttttgttgtgtctctaccaggctttggtatcaagatgatgctagcctcctaaaatgagttagggaggattccctctttttctattgattgaaatagttttagaaggaatggtaccagctcctctttgtacctctggtagaattcggctgtgagtctgtctggtcctggactttttttggttggtaggctatcaattattgcctcaatttcagaacctgttattggtctattaagagattcagcctcttcctggtttagtcttgggagggtgtatgtgtccaggaatttatccatttcttctagattttctagttttcttgtgtagaggtgcttatagtattctgatggcagtttgtatttctgtgggatgggtggtgatatctcctttatcattttttgttgtgtctatttgattcttctctcttttcttctttattagtgttgctagcggtttatcaattttgttgatcttttcaaaaaaccagctcctggattcattgattttttgaagggttttttgtgtctctatctccttcagttctgctctgatcttagttatgtcttgccttctactagcttttgaatgtgtttgctcttgcttctctaattcttttaattgtgatgttagggtgtcgatttgagatctttcctgctttctcttgttggcatttagtgctataaatttccctctacacactgctttaaacgtgtcccagagattctagtacgttgtgtctttgttctcattggtttcaaataacgtctttatttctgccttcatttcgttatgtacccagtagtcattcaggagcaggtttttcagtttccatgtagttgagtggttttgagtgagtttcttaatcctgagttctagtttgattgcactgtggtccgagagacagttttttgtgatttcttttcttttacatttgctgaggagtgttttactaccaattatgtggtcaattttagaataagtgcgatgtggtgctgagaagaatgcatattctgttgatttggggtgtagagttctgtaggtgtctattaggtctgcatggtccagagctgagctcaagtcctggatatccttgttaaccttctgtctcattgatctgtctaatattgacagtaggatgttaaagccttccattattattgtgtgggagtctaagtctctttgtaggtctctaaggacttgctttatgaatctgggtgctcctgtattgggtgcatatatatttaggatagttagctcttcttgttgaattgatccctttactattatgtagtggctttctttgtctcttttgatctttgttggtttaaagtctgttttatcaaagactaggattgcaacccctgctttttttttgctttccatttgcttggtagatcttcctccatccctttattttgagcctatgtgtgtctttgcacatgagatgggtctcctggatacagcacactgatgggtctgactctttatccaatttgccagtctgtgtcttttaattggggcatttggcccatttacatttaaggttaatattgttgggtttgaatttcatcctgtcattatgatgttagctggttattttgcccgttaatgatgcagtttcttcatagcttcaatggtctttaccatttggcatgtttttgcagtggctggaacctgttgttcctttccatgtttagtacttccttcaggagctcttgtaaggcaggcctagtggtaacaaaatctctcagcatttgcttgcctgtaaaatattttatttctccttcacttattaagcttagtttggctggatatgagattctggtttgaaaattcttttctttaagaatattgaatattggcccccactctcttctggcttgtatggtttctgctgagagatccactgttagtctgatgggcttccatttgtaggtaacctgacctttctctctgggtgcttttaacattttttccttgatttcaaccttggtgaatctgacaattatgtgtcttgggattgctcttcttggggagtatctttgtggtgctctctgtatttcctgaatatgaatgttggcctgccttgctaggttgagtaagttctcctggataatatcctgaagagggttttttttttttgtttttttttttttggttttttttgagacagagtctcccactgtcacccaggttggagtgcagtggtgcgatcttggctcactgcaaactctgcctcctgggttcccaccattctcctgcctcagcctcccgagtagctgggactacaggcacccaccaccattcccggctaatttttcatattttttggtaaagacagggtttcatcatgttagccaggagggtcttgatctcctgacctcatggtctgcccacctcggccttccaaagatctgggattaggaggcatgagccaccgcacctggccctgaagagtgttttctaacttggttccattctccccgtcactctctggtacaacaatcaaacatatatttggtcttttcccgtagtcccatattttttggaggctttgttcatttcttttcactcttttttctctaatcttgtcttctttgtttatttcattaatttgatcttcaatcactgatatcgtttcttccacttgattgaatcggctattgaagcttgtgcatgcgtcacgaagttctcatgccatggttttcagctccatcaggtcatttaaggtcttctctacactgtttgttctagttagccattcgtctaacctttttcaaggtttttagcttccttgcgatgggttagaacatgctcctttagctcagagaagttcgttattaccgaccttctgaagcctacttctgtcaactcgtcaaactcattctctgtccagttttgttcccttgctggcgaggagctgtggtcctttggaggagaagaggcactctgttttttggaattttcagcttgtctgctctggtttctccccatctttatggttttatctacctttggtctttgatgttggtgacctacagatggggttttggtgtagatgtcctttctgttgatgttgatgccattcctttccgtttgttagttttccttctaacagtcagacccctcggctgcaggtctgttggagtttgctggaggtccactccagaccctgattgcctgggtatcaccagcataggctgcagatcagtaaatattgctacctgatacttcctctggaagcttcgtcccagaggggcaccgcctgtttgagacgtctgtcggcccctactgggaggtgtttcccagtcaggttacatgggtgtcagagacccgcttgaggaggcagtctgtccattctcagagctcgaacaccatgttgagagaaccactgctctcttcagagctgtcagacagggacgtttaagtctgcagaagctgtctgctgccttttgttctactatgccctcccccagaggtggaatctacagaggcagtaggccttgctgagctgtggtgggctctgcccagttcatgcttccctgcctctttgtttacactgtgagctactcaagcctcagcaatggcaggtgcccctccccccatcaagctgcagtgtcacaggttgatctcagactgctgcactagtagtgagcaaggctctgtgggcctgggacctgctgagccaggcaacgggagggtatctcctggtctgctggttgctaagactgtgggaaaagcgcagtatttggtcaggagtgtaccatttctcccagtacagtctgtcaggcttcccttggctaggaaaggggaatcccccgaccccttgtgcttcccgggtgaggtgacaccccaccatgcttcagctctttgggttgcacccactgtccaactagtcccaatgagatgaaccaggtacctcagttggaaatgcagaaatcacctgtcttctgcgtcgatctcactgggagctgcagaccagagctgttcctgtttggccatcttggaagagaccttccctgtgtattccgagccttctgcattctgccatcactgcagcctcctcatgttggatggacctgatatttttgcttttctagtaattcagaaatcctcagtggaaaggctgtttattaatatgagttatctccagacagggcaaaggtgtggtctatggatgctgtggattagcaatgaccaggctctcaggtgactccactcatgtgattttcacagaaagactgctgtctggccagtgagcagcacagggcactgtgagtcacactcagtgtctgcacagtgaaaacccaaaacttgccacccccccaaactccccagggctgggtagatggagtctgcactcactgacacagatttagcagctagatatggtcccagcacccccaccttcttccaagtcctgcgtgccagacaccccgacaacagctcccagatactgataaatccatggggagagttgggggtaggcagtgggagcaacacacttgcatccataacccctcctttgtgaggccactgaaggggataagagaggcctggagaagccactccagttctggacctcaggagggctgtgtccactgtgacctgggcacctattctcctgtgatattctatcatttctcaggtagggacaggtctcacgtcctggggaagccccctagcctgagttcttgccctgtgtttcactctcaccctttgtcctgattcctcacccacgatcatctttgcttgcaggttccctctctcagcctttgcttattcagctgccctccctctctgcacatctgagaaatgctataagacttccctgtaccccaagtagtggctgcattgttggaggctgtcacatattcttgtaccagcagaagtcacggagccttccccagtatctcctgagatactactcagactcaagtaagcaccaggactctggggtccccagtcacttctgtgaatccaaagatccctcgggcaatgtgcagggattctgcacatttctgagcagcctgagatcaagtccgactattactattttacatatcacagcaacagtggcactttcactgtgctccagacttacggggaagtgagattagaacctcccctgcattctctctgccttgtgcaggcaacaatacactgtctgggaccgagtgtggctcatcagtagcagctttgttgtttgtatttttcattcttcagtacagggtgggacctttctactggcctccattaatagtgagagtcaaacaagacagtctgtgggtgactccaaagtctaactcagggtttccttatgttagttagcttggactactcttggctcctccccagagatctcaacttctctggaattctccaggtgccacaagcactgatttcagtcttggccttgcacctcccctgagcagcttctgactctcctctcattacatctccatttatggcctgtcacccactcaatgtgttaaaaggtaaagcattttgcaaagtacttatcctgaactttagccccaaatccacccagcttccctagcccaggccagctctgcttcttatgaggctgatgagaggtacaagggctgcgacccttgctgagtccattcctgaaaatgcccccaataaagcctgattagcgccaatgccacaggacattgttctgtttcctttgcaggtggtgcccagtgaggaaagttcttcctcctgaatatgaatattttggagcatgaaacagctgagctgatctggggaggggaggcaaccccttgtgatggtggtcagattgcttggttgggattgtcacagaccatgtgataatgggattatattgcatatcacagatgcgctggaccctcaagtgtgctggggaactctggttaaagaatagaagtgatccctttgttcatattcactatgctggatgcccttttgagatccctgcaggacgctaaccctctgactgcggcagccttgccctttgatctgaagcttttatcatacattgtcctgctcaggggatttgggtggggcgttactcctatatatcatcacaagaaagggattctctggagactaaatgcaaactggaatatcccctggaggctgtccccctgattgggaaatatgaagagactaggggtgctcagtgtttaaaataaaacttcagagagtagagtctgagtgtaaacccttcaattccatttaatctctacaaatgtatataatgtcaaaacatagttatgtcatatatttacacatgtgcacacaaatctattaatacatgttcataagttcacatatatgctttatgttatacatatatgcatttatacatcaactgatgttattataatcatagttttacagactcaattttcctttgggtttttccacatttccccactttctttaacacttatttcttgaaaattttggtggctgcttactgagattttactaaaaaagagcttcagaatttcatttagagtagatcttgtggcaaattctattttttttgtctgaaaaaatggtattttttctcttttttatttttaaaacttatcttgaagcataatatgtaaagtgaaatttgcagatcttaattgtaaatttcagtgtgctttttatgaacacatatactcatgtgccccatgcgtactcacaacatttccattactgcagaattaaaacattttgttctagtcaatgaaattattccattacagaatagatatgtgtaccacatagaatgtgtacctgagacacacttcccctggggactccttataaagtgcggtgaattgtgtgtcttttttcccattgaggaggccaatgtggaaaactaaagactgagatgatgtagaaaactgccctgagagggaacctcactctgccctgaggtagggagccagcactggtcaaggccccggtggaggatggcacctctgttgggtccacctggcctctggtcacaggcacgatggacctgggcctgggcagcagggggcgctgtggggctggcacttagagtctgtggggctcttagctgggaaatgatacctggccctggcctctgcctagggctcactggggccagcagctgggtcctctctgggccctttgggagcctcagtccaggtacatcccaggcctactcttcccagaaatgacccagccactgggactgcacacgggcccagggaggggcacgcttgggcaggggaagaggagcacatttgcatgaaaggcccatctctctcctctaaggctagagggtgaacacgagagacctgccgcgtggcttcctctgcagagatccggggagtctgcaccatggccttgaccccactcctcctcctcattgtcctccttcactgcacagtccaggacggcacaaagcatcctgatcccccagctcactgacaccacctcccaactcatgccagaactgtccttccctgttctgctttattcagtgtataatggctgtctgtgttttcgggatccctctggcagcccgtgccgactcagtcgacctctgcatctgcctccctgggagccctggccaagctcgcccacactcagcagtcagcatagcagctatgccattgaatgctttcggcagcagccagggaaggcccatcagtacctgatggagcttaagagtgatggaagccacaccaagggggctgggattcccagtcactagttctcagtctccaggactggagctgaccactatagtgtcatttctacaatcccgtctgaggatggagctgactatatctgtggtacagattgtagcattggtgtgccgtttgggtaaagcacagataaatggggaaatgaggcaaaaactgtttttctactctgctaccaaggttgaaaaatggctctcagaaccagtgtctgctgacctgcatactcaaatatgttatgtgtgtgtgtgtgtgtgaatgcgtgtgtgtgtgtactttaattttacgagtagagagccagatattttctgattcctgcttccagttcccttggaaacagctttttaggccaggccttctagggagtgcactctgatctgtaactattgtgcaaatattacaacagagcctgtctcctcctgctggtctggtgtattgtggctatataggggggtgcaaagaaattctccttttcatattcagacactgggactcagctgcatacctcagtcctgtcttattgagatcatttaaatgatcaatcttagaagaaaacttctgacttaaataaattttagaagtctatcaacatgctagaaagcatattccagataaataaaaatagaataaagatttatagagattgagatgaaaagctttaaaccctttgggggtttctgaaggtattctcaggtgttcagtgcctgggatttgggagtaagggataaggaggagaacttatttccaacacactgaagatgacaacagataagcagaaagttaccaaagaaggaggaatagaaatagccatgaatatcatcctggtaaccctgatctggaatgaaggatttcatttatttacttatttatgtatttattttcaaaataagtacatctcatggagtccttggcaaaagctgaaggaagtattgcttcaggaaatatctgtccagtaattaggaaactactaatgtgattgagcagagacttcattaacttcacatgcaaagaatacagacttgcagaaccctcctggaaaaccatgaaacaatacatcatcaacaataacaactatagcaaaaacagcaacaacatcaaccaaaacgctttacaaaaaagttctaatttccagaactgtcacattatattatttaaaatttccatttgtcaaagcaaaataatgaggtaggttcaagacacaggaacatattgccatatataacggaaaataacaaagaaaaaaacattaaaaaaacaaaaaaattaaaagttgacaaaaactattttcaaagaggcagaaacactggtcttattcgaccaatacttcaactccattatttctccatttgctcaaagaaattttaaaaatgtaaaaatgttcaaaaaagcatgaaaagaatgtatctccaaataaagaatattaataaaagatataaaagaaagagtcattgaaataaacatagattaattgatattatcctattacaggaatagaatgaaataagggtggaaaaatacgcaggacctaaagaccctcttgacaccatcaagtgtaccaatatacacataatgaaaggcccagaagggtaagagtgaggaaaagaaacagaataatgtaattgaaaaatggtaaccaaaactttcccaaatttgacaaaaagaaacatactcaatccctaaaaagttcaataaaccttaatcagcattaatcggaactcatagatataaaacttatggaaagcgtcatggtgggataaagcttactaagttctaaaaagtcaaatagacaaagacggttacaccaaaagtgtgtcaatttctgtttcctgccatgatgcaatagatggagttcttacaccataaacaacactttaagacataatcgagtgcatgtaatgactatttccagacagtgaatattggccaacagggataacttgattatgtaacctcagagaaaggaccctaacacgcaaatgagcactgcagtggacacggatttctttttcttcactttttttttttcgagttagggtcctgctctgtcgcccaggctggagtacagtgatgtgatctccgctcactgcaaactctgcctcccaggttcaagcaattctcctgactcagcctcccgaatagctgagattataggcactcaccaccatgcccagctaatttttttgtccttttagtagagagggggtttcgccatgttggtcaggctggtcttaaactcctgactgatctgcccacctcggcctcccaaagtgctgggattacaggtgtgagccactgcacccagccaacacagattttttttttttaattatactttaagttttagggtacatgtgcacaacgtgcaggtctattacatatgtatacatgtgccatgttggtgtgctgcacccattaactcgtcatttaagtatatcttttttttttttttttagacggagtctcgctctgttgcccaggctggagtgcactggctctatctcggctcactgcaagctccgcctcccgggttcacgtcattctcccgcctcagcctcccgagtagctgggactacaggagcccgccaccacacctggctgattttttgtatttttttagtagagacggggtttcactgtgttaaccaggatggtctcaatttcctgacctcgtgatccgcccgcctcggcctcccaaagtgctgggattacaggcgtgagccaccgcgcctggaccacagatttttttttggagacaatttttggcccagaaggaggtggtgaccaagataatcgtgagctttttacacagctcagaacacacagatgagaagtcagaaaaacatagatggctgagactttcagagcaagacactgaaaagcaggcagctacacagagcaaggtccctgcgctctgcatgaggcccctttggatttggttgggcaaaacatgacaccttgcagggggctctaatttaatgaataggccttcccctactgggaactaagattcatattttttctctctgtcctgttttttcaccactgtatctacaaaccctaggactcagcctagcgcaaagagccaattaataccatgtttgttgaacgaatatgtgaattcacctaaatagaattctcagtaagagaaaaagatctgaggaaaataaagtgatttttactgctttatgtgtattttgagtttgggttgtgaattgattcaaggggatatattaaattagaatgttgacctccgtgtttagagaacaagagaggaatatgaacttgagtgctggaaaggtgaccagcaggatggactgggtcccatgggtttgtgcagagaccatggaaaaggatgagcctccagttactaagtaattgaacaagatatattttaggtaaacacttattttataatcacctgttggaatgggtgataactgtagatgtgactgttattcattgactctctgaaaaaattatttattcaaggcaagaaagattggagaatagttttatcttgaaacacttttcataaacatgacatattcttgctaaagcagataccatattcatctccaagctggaagggttatctcatcttcccaaacatgcaccccttatagtatattttatctgcttttatggcatgtccactttcttggtcacagacattgtaagcctcagagtttaatttgtttctctactgtatacgtatggcacctccagttggtcactgaagctggagattgaaatcctctacatcccccagatctgtcctctggctctatggcgctgtcctgttccatcagacctacattgcccttccttgtgtgaaccctaacctaagtccaatctctactccatgaaagctgtctgtaacagaagcctggcacctctttctcctttttatgaaataaatatctatttctatagatagatctagatctagacattaatagctccaaatctgtagaggacaaagtgcctagttctcaggtgataaccaacccacatcttctgtcctggaatatccagccccagatatcaccccattttctcctccctgtctcgctaaatatatattcacccaccaagccactgggtttgtagtaatttgtcacaacaagaacagaaaaatatgtggaaaagaatggaagaggagtgttgctgttaaaaaaaatacttaaaatatggaaatagttttggaagcagacaagagatagagtttggcagaattttggaaagcatgttagaaaaatcctagattgctttgagcatggtgttaatgcagatatggttgctaaagacttggctgggatgggctcagtaggaagtcagaagcatggtagcgaaaaagctacattttctttcttttttttctttctttttttttttttgagacagggtcttgctgtgttgcccaggctgcattgcagtggtacaatcttggctcactgcagcctccacctcctgggttcaagcgatttttgtgcctcagcctcccaagtagctgggactacaggtgtgcgccaccatgcccggctaaggttcgtaattttagtagagatggggtttcaccatgttgtccaggctagtctccaactcctgacttcaaatgatctgcctgcctcagcctcccaaagtgctgggattacaggcatcagccactgtgcctggtctagttacatttttcttagcaaatacctaattatacatctacagactggaagtagaaatacagccagtaccagcactttgggagaccaaggagggcagatcataaggtcaggagatcgagaccatcctggccaacatggtgaaaacttgtctctaccaaaatacaaaaaaatttagccaggtgtggtggtgcatgcctgcagtccaagctactcaggaggctgaggcaggggaatcacttgaacctgggaggtggaggttgcagtaagcccagacagatcacaccactgccctccagcctggtgacagagtgagactccatctcaaaaaaaaaaaaaaaaaaaaaaagaaagaaagaaaagaagataaaagaaatacatccagtaaaggagctcctggtgcactgatgggagttcacagggaattaagagcgctcttttgacttttgtgggaaaaccggaggaaaggggatcattgttttttggtggaaaacaggttggctggattgtttcatgcaattgtatggaaagcagaacaggtgagcagcaaacttggatatttagctgagaatatttccaagcaaagtattaaaagtataacctcattcattcttgctgcttacagtaaaattttgtgataaaaaatgtgaagtaagggaggaagtcttaaatggaaagaaactagggcatgataattgaggagattactagcatatttcgccaattacttgctcattccctcttttctgggagaccctaaaagtaactcatcatttactgttttccatccgcttccttccttgtctagaatatgggcctggaccctccacaagatgcgtagagaagtcagaaggccttgtcctgtgcaagcattcaagcatccactcctcgcactaatatttctagacagcaaactggtgatccttgctcacctgaaacatacatacgggttggaggaagacagaacctaacacaccttacctgtgtgatgttcagggctggcctctaacttctgagagcttcatttcactccacttcctacaaggattgctcatgccctccttcacttgtggtgaagttcaaacaatacattagatttgacatctttgccaagagctgtagagtgcaaggtgctcacccagagctacatcttccagcagatgaggctcacagttaaatcactgctatggtgtccgtcaactcaggcactgttgtgccttttcacagagcatcgcctgttaactgcttcacccacccactgtgggagtccaggtaggaggacaatgcctccccactagctggctcctctctggttgtacctgtgggtcacacatgcaggtgacggtttgtactacctcctacctggctgtactccccaaagccagggctgacacccctcactgcacttccattccatcccatcagtcacaggaggcagctattggctcattaccctttgcaaggagttcaagggtagaagtggcccatttataagaatatttatatggactatcttgtatatcctgtgaatcatgatactgttaaatcaactctaatacatcatgtttatgtccactgaaatgatgatgataaaaggaaaagtgatatctggacacgcagactgaaaaagatcccaaagattctgcacacaaggcccctattctctggggacatgtgggaattcaatggtcttgctgacatatagagtttgcttcactctgtgtcaatctgaggcatttgtgacctcagagttgtgttttctaagaatttaccatgtgtggcagctggacttcaagttatacctaaatatctctgtctcctagcactcacatccctgtacatattgaaaagggatcactagtacaattgataggatattgagaaaatgactgatgccaggccataatacactttgagttttgcgttctgctctctcagatcacttgctttggggaaagccagttgccatttgtgaggacactcaagtagtcccacagggagtttcatgcagcaagaagctgaggcctcctgccaccagctttgtggctcagtgaaactgtaagttgattctattgccttggtaaagtcttctcatggctttagttccccccactgaaatcctattttcaacctcatgagcctatctgagccagagccaccttgctaaactgctcccaggtttctgacccacagaaactgtgggattgcacatctttgcagttgctaagttttgtagtatttgatgtgaagtaattgaaactggatgcatcgagagaggggaatggaggtggcagagtgggtggaattaggcctggaggtctgctttcagtgagatgtgatgggaccatggcagacacctccctgtttctgattccagtggattgcttactgggcctggcctttttcttatactccatgacttcattgttaataccctacaggaattctgtatgcgctatgtcttatccatcttccttgggtaaatatttaaatataaatgaatcaaaacacatgggccactttctaatcttgattgttcaaaactgaattcctcaaattgaggggtatgattttctttattgtccttggtgctcgtctgccagtgtctatcaatggtagaatcatgtaaacagtcccctcccctattttgtttcactctctgaggacgagagagaagtcttggccttcaacagaaaatggtcaaactagaaagagtaacacttttgagctcctcagtgaatgtggccttggaaaaccccttcacctgggcagcaaaggaagagggagaaagacagagcctgaactggtaggaagtcctacctcaaaaacatcagtcagtcctcacatggatggccagggcattaaggagaactaattaagttaatttcacattctccatgacaaatgctgttgtcatcagtagggacctctcctctctttttccatcctcctacctgttctcactgtccctgacttacccacagtgaactttatgttttcaccttttatatccctatgcctggtcctctgctggcctgtgctgatcttttcataaatatttttgaaatgagaagacgcattttcttaagtaccatgaaagtcgacatcacatccatctttcagggtcctgctcccagactcttctgacttatctgttcactgtgctgggttggcagggaaaagtcatctgcagcagaaaaagtgacaaaatggagatacatagtgtgtcttggccaaaaatcagccaacagatgagagagatctaggattgtgagaagttctgccgttccccagcacctcacactatttgatgtctcaatgtttgtacatatcactatattttctagaagatgcactacatctagaaatagtgtttgctttgtttgtccccaagcaggaccccactctccactcagagccagttcacagttgccttcttccctggcccctgtggaaggagctgctcaggtgtttgctcccagagccctccgcattttccccttactgcggcctcctcacaatgaacaattgtcatgtttttcatttctcctgttcctgttattctagaaatccctcaatcaaaaaggatggttatgaatataagttacctgagacagagcaggggtgtggtccatggatgctgtgacctgacagggacccagcactcaggccaactccactcacatgattctgactgaaagactgaagtgtgcagcagggggaaatctgggtctttccaagctctgaacagtggtgcccacatatctgttatccctgggcaatggagcctgcactcactgaggaagataccacagctgtgtcttctctgggctgggtagagtctcctactcacaggtctgtggaaggtgcaggagctgcttcctcacttactcctcccgtgggacaaacgctgagtctcacccaccaacccaccatatctaaagaatcatgctcagacttcagctcttcctagggtggaacaaagattaccaggaggatacacaaatttgtgtggacagatcctcccttttcaggccactggagaagataaaagaggcctgagttaagcagcttcctctgtggggccacaggaggcggtgtccaccatggcctggacccctctgctcctcatgttcctctctcattgctcaggtgagaactggttttaggtgtctagggttagctccttagcttgcgtcagcctctctggctcagatccccaagacatgtatctctagttcctgccccagcccccatgagtgtctgtgcttgcaggttccctctcccagcctgtgctgactcagatgacctcactctctgcatctccgggagcatgagccagacttacctgcaccctgagcagtggcttcagagttggtaactttgcaatatagtggtcagctgaagccaggcagccgtcccaggtgtctcctgagatactactcagactcaaatatcactcagcaccctggggttcccatccacttctctggatccaatgatacattagccaatgcagggattctgtacattcctgggctgaagcctgagggtgaggctattactgttgtacgtgtcacagcagctccaagtcagcactccagacccactgggaggttacaaaaacctcttctctgatctcctggcctggtgtagtcactcctgctggtggctctaataaagtctatctcactgggtgacttatattttagatcttcaaccagcacctgattctttttttcagacaagtagatctgaaaatgtgactttattttcttcaattccactttcatattgattcatgctcataccttctcatttctttctggttttcacaggcagaaatcccttgctcagagacaaaaattctctaaattgagactttggaggagaccaaaagagagtggttcgggccatgcccggctcagagtctaggagtgactcagagatgcttctggtcccagagcttcaatctaggcattggatacaataccagcattcacaatggaattgtattctctatattagcaacaaaccatcacagattttgaaataaaaagaatataatttataataacatcaatataaaatatttaagggtaaatattaaaaaatggaaagtcttaaactgaaaactataaaacgttgagagtcattacaaaaaaaccttaaaataactgatattccttgtttgtagttggaaaactcaatgtgattataatttttataatgacaattctttccaaagttatctaaggaatcattgtaaggtcttcagtaaaaataggtttgcagggaatgaggagataaaaaaatctcaacaaagaaatgaaaactgtaacagaaaacatcaatgaaacaacagacctgggataatccttctcagctgccatgggatctaactgtatttaagaaaggggtgagtaggaaggcggctgccaaatccaggaacacagatgtcattttgagtgaccaaggtgagccaagggaggacagctttagtcagaagagcatagaccaggagcagaactcacatatctgaagctgatgggcagagtgtgggtgcaataggcctggcattgggtgctgctgagctgaaattatgctgtcacctgaggtgcgcccctggggtgacatggttctggttgttcttcaccccagggaaggacactgtgacctgttatctgttggaggatgaggactcagaaagctctttataagagagggcaccagtgtgatatgagggtccctgattgtctttccaaaggttggaaattgaacccgcatctttcatttttgtgtagagaacccaagatccttttctacataatcaagggttatttccaatagctgccttggcctgtctcagaaagagtgtgggtttgtcttacagcaatggtgcccactatttatgggaacgtcttgtataccctgatctatgctttcaggtctttgacatctcaggtttttggcctacctaatactagccatacgtctgggtactgtgatctacctcctactacacatataaatgcccatctcagcctcatctctccttgggatataaatgtgtgcaagggatttgaagcagctctgccttctttttgggtcctaaggatcagggttatgggtgtctccatccttccctgggtcttctcctcctcactgtcctgaaacatgacccagacacaggctcctgaggctcctgcaggccttcttccctgcttttgccaactgcaggtggaccctgccctgtgctcacaggtctttgtatctctccctgctggtcaattgccctgcaggggcttttcttatttctccattatgagaattcctttgtttttggaggaaataatttttatctaatttttgatttacttatcataatcctagaatttgtataaaaactcctgtttttgcataatgaaacagttgctatctcatgccattttattcaaagtcatgtgcttctgttcacttactggttagaactattgtttaatcattgacaaatatttatcgaacacccactctgcgccatgttctcctatgtcaggtgctgggtatacattgatgaatgaaacagactctatccttatggaacttgtgtctagtgagcttagaagtaaattttgtgagtgctaggatggagagtcaagctaaggactcttagttctgccagcatttaacatgttgttcttatacattttaagaataaattactccagaagaatctttttgttttgttttgttttgttttgttttggtgaagagtatccacatagacacacatagcaaagaccttatagaatgcatcagagataaacaaaataaaatgtaatgtttcccagagctggatgtagtttctggtttgatttattttaatgacacacagaagaaatcactttataatgaagtaaaattccacactacagaaacagagtaaaaatactttcttgaaaaaaatgccaaacctacctttaatcccaaggaaagagaattgcttgaatagatctgttagtatgaaacacataatagacaacctgctgtgtaaaattacttggaagtcatattttagaaggttttaaacattcttaatatactctgtttttgatattacgtcttatatttttctctgtggtggaaatttatttctaagaaataagaaaggatattagaatggcaaaaaatatttgtataaatgtgttaacattttaatggtaactatatatgaataaaataaaaacattgttaaaaatttattggaatgaataataaaattatcaagtttataattaataaaatcaagtatatttcttcttatgcaatttaaaaatagtgcagaatgtttattattctggtatcactaaaaatgacaaacttcattcatatctatagaaaaataattataaaattcagcaagtaatacaggagataatttgaacaaatattgaaacattttcttacttaaagacactaggtaaaaatttcagcaatgagtagagaggttatcaaggcgcattttattattgatgattgatatatgttttttctctcgagaaagtgcacaggtgggtatcagcagaggagacagtataggctccccagatgtcaaagcagggatgcgccaatacccatcagtcatcatcataaaagacagactgtgccttcctgtgtcaggctctgtgccaggagctgtgtgccccacgttcccttccagggtcctgcctgaagtctgtgctcactcagccagccccatcatctggaagtaacagtcccctcctcctgcactggaataagcagaagatttgggtggacagtgtggcctggccccatcagctcccaggagaagctctctgtctctctctcatcctgcatgccagttaatgacgataaaacccacctaaccaacccatctacaacactcagcttcatccctatctctctctcacactccatcaagggacacagtcatcccatgggttttttcccctggcatctctcactttcttcctcttccagatccctgggatcagctatcaccccacccgacaccccttctcctgcttggctgccttcaggctctttgttgagcctgacaccaaaggatgtctttctaaagtgtcagtttcatctattctgcccccagttcacaacctgaaacaacctccgatagtgaatcaagccaagcccctcactctaaagcacagagacatgccatgaattcctaaggggatgacagaatacatcattgatgagaagattgaacaagtgaagtgtgagtggcaagtcaggtgaggacatttgaatccaatctggcatttaaaatgtctcttcatttccaaagtcctatctctccctagtaatgttgtttgactgctagtcccagagcaggaccccacatcccagtgacagccaagtcacagtcgcctccttccctggcccctgtggaaagagctgctcagggctttgctcccagagccctctgcattcccaacttcctgcagcctcctttcattggatgggggtgatagtttgcacatgcctttctagtaatccaagaaaaacttactgaaaaagtctgtttgttcatgtcagtaatcaggggcatgaccagggcatggcccataaatgcctctggactgatactcaccaggctcccaggccaacaccacatacatgatttccactgagagaatgcagtctggacagagagcagcagggtacactgtaggtctgcccagtgggcatccacagctgtgccaacccctcccaccccacaaattcctcagggctgggcagtggaccctgccctcactgagcctgactcagcagctctgtcctccctgggtgtggtcccagcacccacttcctcccaggtctggcctgccagactcccccctccaccagaccctaggacttgaataaatacatagggtaaggtagaggcaggcaatgtgggggacacatttgggtccataactcctcctctgtgaggtcagtggaggggataagaggcctgaggcagcccactatggctgtggacctcaggaggactgtgttgaccatggcctgggcccctctcctgctgtttctctctcaattctcaggtaggcacaggcctcccatgtccagggcatgtccctcaggcttcaccagtcccctctggctaaaatcttacagcaactttatgctggtaggtggcccaactcccatgtgcatctgtgtctgcaggttccctctcccagcctgtgctgactcagccgccctccctctctgcacctccggatcagccagactctcctgcaccctgagcagtggcttcagtgctgatttctgctggatatactggtaccagcataaaccagggagcctccccagtatctcctgagccactaccaaaattcacttcatgaccagggctccggggtccccaggcacttctctggattaatggaaggccggtccaataaagggctcttgctcatatctgatctccagtctgaggatgaggcttactattactgtatgatcgagcacagcagagcttctcatgctgacacacacaggtggggaagtgggacaaaatctcagcctgctcagagtcttgttctctgatgaaatttagatcttaaaataacttatatcacttgtgtgggatgagtgagatatcccgagctcacaggaactgtcgatgaaaagagtcgagctctgtaaaatattgaagacatttattccaagccaaatatcagtgaccaatggcccacaacgcagccctcaggagatcctgagaacatgtaccccaggtggtcaggctgcaacttggttttatacattttaaggagacatgagacatcaatcaacacatgcgagatgtacgttggttgagtccaggaaggcagcacaactcaaagtagtggggctccaaagatcgtctttttgataattggttaaaagagttaaattattgtctaaagacttagaaccaaaggaatgcctgggttaaattaaggcattgtagtgaccaaggttttgttgctcagaggaagcctccaggtagcaggctgcagagaaaatagattgtaaatctttcttatcagatgtaaaaagtctgttctctcagaaattccaaaaatgaggaggcatatctggctccccgttcccatgatgacctgaactctctttcagattaactttggaatgcccttggccaaaaggaggggtctgttcagatggatgggagtcttagaattttatttttggtttacaatcctgtaacacgtcctgtaatttgctgcccagaggtcattaatggcctggaagaaataatgtgccagctgcagtgttgtccacagaaagacttactcattctgctgccctgagtagtgatatcagaaagatccatctgccaacagtcagaatacccttccaggagggttgcacagtaccaggggtgctggaagacctgggatctgaggcaagcagggggcactgttggatggatcccaagatgacaggattaccaggccacacaaggattaaacaagagacagtaacagtccactggctcttacacacttggataagcagtgacctccctgaagaatgactttcctgcacctgggctgaaggacccacatgagcactgggttttggataaaatagagcaatttcatttatgaacatagatgtgaaaattcctcagcatattcacaagtagaacccatgctggacctctgacctctaggatttaggctgagaacaggacatttgtgaggtcggtggggaataagcatgaactttggagggacagcaggtatgaggggtgctgagccgtatgttagatgccccaatcagggaaagagcctcgaggcttccagtgcagcttccctgataccctgtgggagagaaagatagatactggatatgctgcaatagagctcactaatgctctagtaaagagcaggcagcttgcattagcacagtccttcaggagagaaaacgcagccccaggaaagctgtcagaggccaagatgactcattagtcacattgaattcataatgcatttatgatgaaatatatgataaatgtcttatccttttgttcttttttattttttattatcgtgggtacataataggtgtatatatttatggggttatgagatgttttgatacaggcatgcaatgtgaaataattatatcatgaagaatggggtatccatcctctcaagcatttatcatttgtgttacaaatgatccaattacactctttacataattcaaaaaagtacaattaaattattatgaccataggtatcctgttgtgctatgaaatagtaggtactattcattctttctaactactttttgtacccattaaccatccccacatcacctcctactccctgctaccttcccagcctctggtaaccattattctactttctatgtacatgagtttcaaatgttttgatttttagattccataaaaaagtgagaatatgtgatgtttgcctttctgggcctggcttattacacttaatataatgatctccagttccatccctgttgttgcaaatgacagactcttattctattttatggctgaatagtactccatcgtgtgtatttaccacattttttatgcattcatctgttgatggacacttagattgcttccaaatcttagctaaacagtgctgcagcaaacataggagtgcagctatttctctgatatactgattttctttattttggatatgtatccagcagtgaaattgctggatcatatggtagccctatttttaggttttttgaggaacctccaatcgttctccatagtggctgtactaaatccaagaacattcaaaatcatatttatatcagtgctaaaaagtgtgacttgacttcaaacaatagccagtagttggtaggaatacaagtataagtttgctaaaaatatgatttgtcatttatatgaatatttctgttcccagaacaatctcatgtagactggcttctggaatctctcctacctcctactgagctgactctcctggagcctggccgtaacggtgcagggctggaagctatatactacaagcacatgctgtatggcatccagcactaacctgggcagatgacggcgaaacaatgtgtgatatttccatttgatttattttccttctttctctatagaaagtgttattataaaactgttatgttgaaggaacacaaaatttgaaggaaaggaatcaaacataaatgttaaatgtttatgtgtgtttatactgttgatctatgatatctcttgtagttactgttcaacatttctattttatatgcttttgtaaaataaacaacatattttatacaaaaactctcatgtgtgctagttgaaagtaatgccacctaaatgcaataacagaatttgaggagactaaaatgtgttgatttgagagacagtaagagtaatttagaacaagtccccatctggctctgaaatctaatcctttgctggtatccctacacctgaaaacctgcaggctttgcacctctgcagacagatgacattgggttaaattcatgggtctccactgagggtcacaataggctggtgtggcacagtgcattctgggagatacagaactgagggacagtaggctgggcgcggtggctcacacctgtaatcccagcactttggcaggccgaggcgggcagaacacgaggtcaggagatcgagaccatcctggctaacacggtgagaccctgtctctactaaaaatacaaaaaattagcctgacgtggttggggggcacctgtagtcccagctacttgggaggctgaggcaggagaatagcatgaacctgggaggaagaggttgcagtgagccgagattgtgccactgcacttcagcctgggcgacagagcaagactctgtctcaaaaaaacaaaaacagacaaacaaacaaagaactgagggacagtatatccccagtggacaccgatccataatcagccccagtcactgcacagactgggtgtatggtgtcctcagtgcctgctgcttccgtgtaaatgaacagcaggagatcctagggtattagtgaattatatattcatttccaacgtcacactcaagatgaagtctctacagtatttgaaattgaacttggacagcttcaactatttttgtttcaaaaaatattatatatacaaaaataccctatttctgaaggtaattggagtttattttacttccacaataatactaaacataaatggttagcgtattataaagtggtgtgtctaggcatggacagcagaaggcacttggagcctgttcctgaggggtctgggggtgttcggagctgagaccagccacttcccctgtctggtgctctctgttcagggctcacagctgtgatctcctcacccctgaacggctcacagcactactcatacttatccctatggcgccctcaggcagaagagtctgatccagggctcagggtgggatcagaaaagttcccatttgcatgaggagatcctccctgcctcagagtataaagagagaaaaggagagagttgggaaaagctttacttcaactgtggggcaaaaaggcaggactcaggacaatctcaagaatggcctggtcccatttcctgctcaccccctttattcactgcacaggtgactggacatggggccacggaaggggccctggggagcccatggagagctgctttctcctcttatttatagacccagaatcaccatgtctgtgtctttcccactttcagggccttgggtcccatctgcgctgattcagtcaccctcagtccctggggctctgggccagagggtcaccatctcctgcactggaagcagctccactttggttattggtgtgatatacactggttccagcagctccaaggaatgacccccaaactcctcatctataaaaacaattggtgacacctgtgggtccctgacaattctctggcttcaagtctggcaactccattttcgtgaccatcactgtgctacagcctgaagatgaggctgattatcactgccaattctacaaaaacagcctgagtgctttcacagtgctccgggttgaagtaagtcagaccaaaacacacagtgtgcccagccatgaagctctcccatgcaccccctactctgcagctaagtcaatgtgttctctcacttgtttgtcctaaaactggggcctgagaacttcttcagggtaatttttctagggaatgtgtcctcaccctctcaatatctgccccaaattcactctttggcaacaataccatgtgctcttttctcagaggtagcagctggtactgaatgccagaggccagctgccctgtggtggagtacagatgggtgaatcagtcggctggggcttccacaacaacacaccacagactggagtcttcaccaacagatatgtattgtcttactgttctggagtctgaaaggaccagatgaaggtgccaccccgtttggttttctctttgccctctttcctttgcttccagatggctcttttctcactgtgtcctcacatggccacccccaggtctgcatgtggtttttgtacacatttcttatgaagtctttagtccttttggattagagactcattcctatgacttcattgaatcttaataatcttagtgtccagatctcccaatacagacaaattggtaacttagttataacataaaaaatcagggggccaggctcggtggctcacttctgttaatcccagcactttgggaggctgaggtgggtggatcacgaggtcaggagattgagaccatcctggctaacacggtgaaactccatctttactaaaaatacaaaaaattagctgagcatggtggtacatgcctgtagtcccagctactcaggaggctgaggcaggagaatcactggaaccaggaggtagaggctgcagtgagccaagatcacccactgcactccagcctgtgtgacagagcaagactccatctcaaaaaaaaaaaaaaaaattcggggtggatgcaatataatttgtaacaaaggatcaggggtccagggacccagagtccatctgtgtctgacccaggagaggtgatgctgcagaggccacctggtcactccattcctctgagctcctactatgtgcagattctggatgtgttcttggtgctcagggtacagcgtggataagacaggatggtccctgtcctccaggaactgatgctatttaggggaaaacagaacacatcagtaaatgtatcaataagaatatgacatgttttaggaaaatgaagagaggtgtgttttggtgaggtggggtgagcagacttagaggagttgatgacaaagatgcagcgactgattaaggttgtaaaattcacctgctgcaacataaagtgaactaagaggaagtgagggtccaggcagggccatatgaggctctggttttgacacaaacattaggctgtggagtcctggacatgggcggaacacgcaaacggtgaaaggtcatgtctgcatggttcagaagtgggaggtgctgaggaatggagtgtggggagacagggaccacagctgggatctcaggacctgtgaggggtataggtgagctgcagctaagtgagaaaacattaaggaccctgtgtagttgacacaagattattgacatcttaagtcttcaataaatacaatcagcgctgacaaatgtggccgtgcctcagaagagctagaaatgtttatgtctaggtaactctcatgttctgtagaacttcacttgtatttttttggttttaaaggattattataagagcagacgtttatgaatatactccattcttttatcctcaatattgcccatctcttaaaatcctttggctttacacacacctacaacaaactgatcttcaaaaattgataaaaataaacgatgtgtaaaggataccctattcaataaatgatgctgagaaaactggcctacaatgcagaaaagtaaaactggacccctacctcttaccatataaaaaattaattccagatgaatgaagacttaaatgtaagacctccaactattaaaatcttagaagaaaagttggaaaatactcttgtggacattggtgtgggcaaataatgtatgtctaatcatcaaaagaaattgcaacaaaaaacttgacaatcaggaccaaataaaactaaggagctcctgcatggcaaaagaaactctcatcagagtaaacagacagcctacgcaatgggaaaaatatttgcaaactatgcatctaacaaaggactaatatccagaatctataagaaagctaagtcaacaaaaaaatttaactccattaaaaagtggacaaaggacatggtcacttctcaaaagaagacaaaaaagcagccagcaaacatgaaaacatgcagaacttcacttatcagagaggtgcaaatcaaaaccacatgggatatcatctcataccagtgagaatgggtattattaaaaagtctaaaaataacagatgctggcaagaatacagaaaaaaaggaatgcttatacattgttggtggggatgtaaattagtacagcttctgtggaaagcagtttggagatttctcaaaaaaaaaaaaaaaaaaaaaaaactaccactggacccaggaatctaggtgtgtacacagaagaatataaataattctaccaaaaagatatctgaactcattcgtttgttgcagcagtattcacaatagcaataacatggaatcaactcaagtgctcattagtagtggatcgagtaaaaataaaatgtgtgatacgcattcaccatggaatactatgcagccattgtgaacaacaaaaccatgttctttgcaaaatatggatgtagctgaaagctactttgcttccagatggctctcttctcactgtgtcctcacgtggtcactctcaggtctgtgtgttgtttttgtacagattgcttatgaagtcattagtcctcttggattagagactcattcttatgacctcattgtatcttaattatcttagtgtccagatctcccaatacagataaattgttaattcagttataacgtgaaaattcagggtgaacacaatataatttgtaacaaaggatcagggatctctttggcttctcgatggatcacctgccaaggggcaagggtgtaatttttacaatgataggcgcatagctcttaacacaagacagaattaccctgttgaatgcttcattcaaatgatatgttagggaggaggccagttggatgataaagctttgggaatgaacatttaacagcacaggatctaaaatgcagaagaaaagaacctctgatgcaaactttctgagtggagataaactgtctgatatcctgcagattaataaaaccagaaacttcatctgccccctctaatagaaatctacacattaacacaatttcactatatgaagtttccagaagatgatgtggagcttgcaggtgagcttcattttacactttccgcctattcatttctgtgggaggacttactttccctctttcaattttctcatgtgctgttcatgtcacaccctctaattcaaggctccagcccacctttcctgccaacaccaacactctctgtagatgaaaacccaccagtcagcagcctccttggcctgagagaggtcatcttcctgggtttctaagactctggtcctgccgagattctccttcctcaatcctaatcccgtggtctctggcagccccttcacatggacctcatcgctcgtctctgtgttcctccagctatatccacgtcagaaactgctcttcatctgcactagaaataaagaattatcctctcaactcttaaatgtttgctctgattctctcctcttctttgagctcaggcacaccaccccctctcagattcctgagtgtggcagtgtcccctctccagtctccctaccacctccaatggtgaaggcgaagaaaggatgtccctgcatgtatcacatcctcatccttcccttcagggtcagctccctgggtagggaaaacactgttcccttgaggctcacatacccactgtcaaaaagcacccagcacatggtaggcactcaataaacctttaccaaatgcagacctgcctctcaccacactggacacattgtagtgagctcaggatggggctaaactgggagtattagctgtaaacttgctcctctctctgtccccagcctgagagctgagggggcacccacgagggagagcacctaggggcagggaggggtcacaggcagcctcatcctctgtgtgagacactgctcagactgggggatccctcttcattcagatgggaagaaaagggaaacaaaattcggtaggaacttctatgcatccacacagaggaggcaatgacaagaaaacacaggatgcaagcacagtggtaataatgtatttctacctaatattgaataaaactcaatattgcctgtattctgtaaacaataactatttacaaaactgactgtaaattatgattttaaaaaccacagcttatgaagaagagaaacctcaaacaatgacacccctgaattgcaaatctaagacatggcacacatttattttcagttccatatgtggcctggatttatttacaagacaatattatgatattatatgtcactattccattttagatggtgtatttaaaatctcacagtactgcaactacctagtaatctactcatcagtataaacatcaatgtgacaatcctgctatccttctctacccctgcataaccccagcaaaaattcattatgaattcacagaatgtaatatcagaactgttgtagccacatacacagtttgtttcattttatgttttgataaagtaatcttttttgtttaagcttattgttttttaaaaaatatattacatactagatgtcattacaaatcagagattaataatttctcttatgcttatactactcccacagcactcattactgaatgtaaaccatatttatattttctttctttttttttttttgagacagggactcactctatcacccaggctggagtgcagtcgcacaatctcggctcattgtaacctccacctcccaagtttaattgattctcctgcctcagcattctgagtagctggcattacaggcacccgccaccatgcccagctaatttttgtatttttagtagcgatggggtttcaccatgttggccaggctggtctcgaactcctgacctcaagtgatctgcctgcctcagcctcccaaagtgctgagattacaggcttgagccacctgcctggctccatatttatattttctaaacatcctacttggagtggctgatcctaccagctaccatgtttccacctcacctgggatcaaacactgacaattggtaattttatctcttgcagtcttcaaatattgagcaaatttgccatttttgctattcaataaaaatgctggaaagttatttgccatgccactgactctgttcagtgcttggaggacagactcctaggagtgagaagttgaccacagcatctgaatagctattaccccaagtctgtggaaattagagaacaaaattttaccagaaatgccccccagagcttctccccataacctcaccacccttagagaagagagctcctgttctcctcagcgctgcagggtccacagaggaggaagagctctggccagcagggaggagccacagaagaaaggacctggtgtctcccgtgaccagggtagtgagtcatgggaaccagtcactgctctggacttgacctgacctaagaggacttggtatagagtcaccacttcagtcctcaccaaggaacatccaaaaagccctggacagattcacccttaaggagaccagtaaagcatgaactgccctgagttaatgagaaggtcacaaaaagggtctgtctggcctggtgctgagcctgggggcagtgatcagagcagggggaatgcacagctggctctggggacatctggtcatcatgtcacaggagagtgtgtctggatgtggacacctggggacatgaagggctcattaccaagtgatctaggggagatcagagctgcgatcagctaactgcctgcatggtgccctctgctcagtgatcacagtggtgagctcctgatgccccggaacacacagtttcacccttgcctgtatccctgatatccacgagaggggcctgacccaaggccagcgtgtcatcagaaggctggggggctctaatttgcatggatggaccctcattctcagagaatgaagaggggaagggagagatttggggaagctctgtctcagctgtgggcacagaaggaaggcaggactcaggacaatctccagcatggtctggtttcctctcctcctcactctccttgcacactgcacaggtgactagatataaggccatggctaaagccctaggaagcccatgggccctgctttctccttttgtctctcaacccagaatcaccatgactgtttctctcccacttccaggatcctgggctcagtctgtgctgactcagccaccctcagtgtcttgggccacaaggcagaggctcactgtctcctgcactggaagcagctccaacactgggactggctataacgtaaactgttggcagtagctcccaagaactgaccccaaactcctcaggcatggtgataagaattgggcctcctgggtatctgaccaattctctggttccaagtctggcagcttggcctccctgggcaccactgggctctgggctgaggacaagactgattatcactgccagtcccgtgacatctgctgagtgcttgtacagtgctccaggcttgcaggggagtgagacaagaacccccttcctcctttcccaggagggtgagtgcccagcagctactgcacaggcctggcctgtggcttctgcagttgctgtttccccagtgggcctgggagcatccagggccccacctgggagtagatgcttctcctcccctccgtcctcagagtcacccacagcagtccctttctaggaaaagggcctccagaaaacagaatgtcctgtaccctgcaacttgggacacagggtctctgctctaaagtccaggggctggagtgacaaatccagcagtgaaatctcagatctacatctgatggggaacctgcatctccatcatccttttgctatttccaggagttttcaaagcagtgtcttcctctcactggtcctcagtgtgttttcctgttctttttgtttcagcctatttttttttttttttttgagatggagtctcgctctgtcgcccaggctggagcgcagtggcgcgatcttggctcactgcaaactccgcctcccgggttcacgccattctcctgcctcagcctcccgagtagctgggactacaggcgcccgccaccatgcccggctaattttttgtatttttagtagggatggggtttcaccattcacaggattgtctcgatctcctgaccttaagtgatccgcccacctcggcctcccaaagtgctgggattacaggcgtgagccaccatgccgggtctgtttcagcctattttttatgtgtctttttattgaggaataattaacaaaataaacccctgatatttaaagtgcccaattttgtgtgttttaagatatttatacacccttggataatcaccacaatgaatcagtgattccatcagaagaaatcggtgactggttctggcagaatccagggaaccctatctaatatctcgtgaacttctacttggactcaagtaagaaacagggctctgaggctcccagccacatcttgggatctaaagatgcgtcggcctgtgcaaggattttgcacgttgctgtgctgcagcctgagaatgggtctgtctcggggtctgcacaggggcagtggatttcacagtggctctgaggcttacacagggctccaggcccatgggaaagtgagacacaaatcttccctctgctctctaggcctggtgcagtgatcctggctggaggctctgataaatctagctcagaatgtaacttctgttgtgaacatctgattttccttggacaaatagttctgacaatatcttatttcagttcgactagtatatcgatccattgctcatacttctcattccattcttgctttcgcaatcggtggaccctgtcctgtgcccacagttctctgcatctctccctgctagtccagcctcctgcaaaggttcagctcccagaagagactcctacatccactgccctggaagaagcaacactatgagtagaatggcaagattttgtcacatcagcactggggataactcatcactactctgggcccattgaagcaatcacatactctctgaacctcagttttcatttttggcagcatgtaaccctacctcagcagctcttgctttcaacatggggatgagctgaagaagaggcttgtaaatgacaagtatcagtcactgttcaccgtgcaggggtgtctgtgtccttctgtgtcaggctttgtgccagcagggctgtgccccgcaaactcttccaaggtcctccatgcagtctgtgttccctcatctggccacattgtctggaagttaaggtcacctcctcatgcactggaacaagcagcagagtcgagtggacagcgtggcctggcaccgccagctcctacgggagccccagatggtaatgcctgctggtctccagcttgcagggttctgattttgggctcttgctctaggtctggccacttgggcttctgcaatactctgggatcctgtatgaggatgagggtgatgatcagtgttcaggatgtggaaagagccccaggttaacccaggacacctgtctcatggggacatgaggcacaagcctcccatctgatcccacagcctggcctatagactcactttaattttgtgtgactgtcacctgactcaggacattcctgcagtcattttttcctccaggactgatggaatgaggccattccctgggtctgtcgcctcatatgcagtcgacctatatactgggctttcaggataaaacattcccagcctgggcattgcaatacagacaggcaggtagctcagacagaaaatactcttgttgattccagatttctgggcacatggacttggtgtgtgtttgtgtccatgactaaggtcaggtttggggttgggagtgagagtggtcaccacatggtccaggaagaatgtgttgtcaaagataaaattcgtacaccttcctgcccttccctgtacctgaggcagcttcctgaagcctgcaggtttctgagattctccataaatggagaggaaacatcccatagaatggatgggttttttttgtcccagacaaaaagacaagacaggacgagggtacagatgtcagcaagggttaaacagcaagtatgcacttgatcatgccaaagaatactgaaatagctttgagggtaattcagtgtccttgagaattaaaaacaaattggagattgagggcttcaaacccccattaggtccttgtgcaaacagatgctgaattccaacccacattaagaaagaggctaaaaagatgagacaaaatctctgaaagacaggtggaggggatttctgcagtttcttggtgcttaagagacagggacctgccaggcactcacctgagaaatcctgcagggtcacagcacagggaagggaatgtgtcgggtacataagatgactttgatgttgaaaacaccacctctaccactgataatggttttcatcattcatacttaggtgcatgtacaacctctagcaaccataattaccacaaaggacaggcattgtgtaaacttttatgaggttctgtgttataaaataattacacaaaatgtataaataatgtgggcactaataaggtgaggttatatgttgcaatatctggggttcctattgaatttatagactgtaaaactaaataggtgctaatgtaaaatgatacagttagaaatacttgattcatgaaaaataaaaagtgagcgaaaagaaataaagcaaaaagcccaaataaaataaagagaaaggtaaactcacacacaatatcagcaattatattcaatgtaaatgtgttgatgaaccagataaaaataatttccttaaaataaagttacttgtgtgttatattttaaaggatgctaaaaatacactatgcaaacatttacctgcagaaagctcttgtggttatctcggtatcagaccagataatttcaatgaaaattatttacatcaggaaatgtgggacattttatgtatataaaatgaaatatttgacaagaacacataacaattataaaatacacatcagtccatgcatggtggctcacgcctgtaatcccagccctttgggaggccaaggtgggtggattgcttgagctcaggagttctagaccagcctgggcagcatggcaaaatttcatctctaaaaagtacagaaaaaaaaattagccaggcacggtggcatatgtgtctgtagtcccagatacttgggagcctgaggtaggaggatcccttgagcctgagaggtggaggttgcagtgagccaagatagcgccactgcactcctgccagggtgacagagtgagatcccatctcaaacaacaacaaacaaacaaacgaacaaaacaaaccaaaaaagcacacacaaataaacaaaccaaaaaacatgtccctaataatataatctatataaaatataaattagcaggactaaggaagagaaaagaatcaattcccaattatagttataaataatagcacacacttctattaactgagtgaatcagcagaaaaaaaattgcacataacaatatgtgaacaacctgaaaaaccaaattcacccactgacgccaggagcccaaacctgaggagtagttggctaatgaatatgtattactgaaacgattgaataagtgctagaagaaataaatgaggcattcattatttttacccgatttgatgcttctcctctctgtcctgtgagcagggggcactcccatgtctattcctagtcccattcttatcccctcgtctctctccccaagactgagctgcattctgcagggtggctcccgtccccctggagtaaatgactgacgtgaggagccctgccttccagtgctgctgttttcatcgtgctctggtttgaatgtctcccttccaaaaggatttatacttaattgccagtgtgatagtactaagaggtaggccttcaaaaggtgatatagtcttgaacacggagacctcacggttgggatcaggtctcttatataaaggctggaggtagcggtgtgctctgtctctcttcttgccatgtgaggacacagaaaaaaggcacttatcagatgacagtgccttgatcctgaacttcccagcctcaaaaactgtgagaaggccaggtgcggtggctcatgcctgtaatccaagcactttgggaggccaaagcaggtgaatcccttgagtccaggagttcgagaccagcctgagcaacatggtaaaaccccatttctataaaaaatacaaaaattagccagatgcagtgacaggcacttgtagtcctacctaatcaggaggctgaggtgggaggatcacctgagcctgggaggtcgaggctgcagtgagttgtgattgtgccactgtactccagcctggatgacagagcgggagactgtctcaaaaaattaaaaaataaataaataaaaaataaaacagtgggcgagataaagaaaatgtgttacttatataccacggaacactatgcagccataaaagaaagttatgttcttggcagcaacgtggatggagctggaggccattatcataagtgaactaagccccgaacagaaaaccaaatgctgcatgatctcacttataagtgggagctaaactatgaatatacccgaacatacggaaaggaacaacagacactgggaatgactaccagaccaaaaaaaaaaaaaaaaaaaaagaggatccaccctgtggatcctctgcccactgcctgggtcatgaggttgttgggaccccaagcctccgtgtcatgcaatcaacagatgtaactaacctgcatgtgtaccctttaaactagaatagtaagagtaaagagcattgaaagaaaaagtcaagatcagaagcgaagaaaataataaatgaaaaaacacaatctatagttatccaaacaatccatgactgtcacaaacacagaacaaggacccagtggacagaatgaggcagccaaatactcaacccaacatgatacatagggaacacatttttcaaaacaccaaaaagacacaatgggaaagggagagtctggttcaagaagtgattttgagaaaactgaatatgcacatgcaaaacactgaaataagacctttgcattgcacgatacacaaaatcaacacaaaataaattaaagacctaaactcaatcttgaaactgcaaaggtcttataagaaaacataggttgggtgtatattttaggaagcctgtatctatgcacacaggctgcaaaaggtgaaaaataatcataacactaaagggaaaattaggggaactacatgcacagacaatgcaatggcttggctatatatgtgtgtgtgtatgtgtgtgtgttttgtagggtggaggtttggatacaaaaattacagctaacatgcaaatataaacaaagacactagtgacactttagaacttctacagggggaaagaaacaatgaaataaacaaacaaacaaaatgcatcctaaagactaggagagaattatggaaagtcctacctctgaaagagattgttatctaacacctacaataaactcactctactaaatgaaaaacaacaaaaacaacaacaacaaatacccaagctaagaggatctgaatagacatgtgtgtaaagaagacaggaaattgactcacaggttaacagtttctcaatatcactaatcctcacaaaaaagtgaatcaaaaccatactcaggtaccatataattccagttaaaatgaatattgcaaaagataaaaataaaaattgttggaggtgatggctggtgtagaattgcaggaaggaaaactgttgtacgctctttgtgggaatgtaaattagtatacacactatgcaaaactgttggaggttccttaaaaaagtaaaaggtcaaagtacaaccaccactccaggttaacaatcccaccactgggtacacatttagaggaaacaaaatccctgcattgaagaggtatctgccttcccatgtgtcctgaagcactagtcacaatagtcaagatatggaatcaacctaactgtccatccacagatgaagagataaaggaactggatatatacatgatggaaagcatttcagccataacagtttgggaaatcattgatctgcagccatgtggagaaacctggaagacaattaggggaaatgaaatgagcctgttagagagagacccatactgcatgacattaggcaaatggaatccaaaaaacactgtcttctagaagcagaactttcaataggggttactagaagctggagagaggagggggcctgggcagggattggtaatgggtacagagtaacactcagaggagaggaatccattctgatgttctattccacagcagggtgaccagggtcaacaatgtctaggggaatttttcaaaaacagctggaaaggatggttctgaatgttctctccacagggaaataataagaagccagacaccatgatttgatcatgacactacgtatacatatatcaaaatgtcccttgcaccctctggttatatacatacactctatagtaatgaaactgccatcaaatgttggtagtattcattctaactggagtgacatagaatctgagtgtggttttcaatcatgttttggtgtgaatcggccatgttgataatcttatcttttacctgtgcatcaacctcatgtcttcaggtcctctgcccacttttacacatcaaattcaaaacaaattaacaataacatggcaaatataactaatcacacacacacagaaaatgaaaaccaccactcagattccatctcactctagatggaatggatactacaaaaaaaaagttgaaaaatattaaaagacaaaaaaacgatggtgtggatttccagagggggaacttgtctccgcagttcgtaggaacataaactagtacacacactaaagaaaccacttggaggtccctccaaaccttaaaaccacaactaccatttcatccagcaatctactactagtcgtatatacagagtacatgaaatcaagccatggaagagattatctgcgttcccaggtggaatccagcactatgcagaatggccaagatgagaaatcagccgacctgtccatctgcagatgaagggataaggaaactgtcccatgcgtagacactggaatactcttcagccagaaaaatacaatgaattcccatcacgggagccacacggttgcacctggaggacatgatggtaaatgaaatgagccaggcagagacagacaaactttgcatcctctcactcatgcagaagctgagaaactttatctcaaagacctagaaagcataatcatggttaccagaggttggggggaagaaggggaaggggcaaggattggaaaggggtagaaagttccacacagatgagaggaaggaaattctgtttttctattccacagcagggtgactagggttaatagcatcattacatcttcaaaacagcttgaaaggaggatactgaagcttctcgccacaaaagaataaacagtggtacgaaataacagaaaaaataaataccctgatttcgtcattccacaatgtatgcaaagaccaaaatgtcgcactctaccctctcattgcattcctttactattcagcaaatttgtttaaagaaatataaatacatgatgctagaattcacatgggaccatgaatcaccctgaatttcttccaaagcaatcctgagacattcagactacatcagatgcatctcacccaccgatttcaaatttcatggaaaaactgggtacctgcttccacacagagcagtggaacacaagagagggcccagaagtaaactcacacaccaaaaaccatctgatccttgacagaatccacaacaataagcaagggggaaaggatgccctattcaaacaatggtgctgggataagtggttagccatatgcggaagagtaacactgggccccgacctctaaccagacacaaaaagaaactccagatgaatgaaagatttaaatggaagacctcaaactattaaaatcctgcaagaaaacatacaaaatacctttctccacacaggttttggcaaagaatctatttggctatgtccccaaaggaaatgacaacaaaaatggacaagccatgcttaatactctaaagagccaccacacagcaaaataaattagcaacagagtaagagacagcatacagagtgggagaacatgttcccaaactgcatctgatcaaggtctaatatccagaatcttcaaggatcttatgccaatcattcaacaaaaaacaacaaaaaaatcccattagtgtatgggcaagggatgtgaacacacacttctcataggacaatgtgcaagtgaccaacaaagagggaaacatgctcaaactcactcatcaacagagaaatgccaatcaagagcaggtcgagataccatcccacaccactcagagcggcgatgactatgcagacaaagaaagaaagaaagatactggcgaggcagctgaggagaggaaaggctgatatggtcttggtgggggaagcaagctagtacagacactgtggaaagaagtttggagatttctcaaagaacttagaactaccatccaaccccacaatccctctcctgaagatctacccaaggaaaatatatccttctatccaaaagacacaggcacttgtatgctcacggccgtgttattcacaatggtaaagaaacggaatcaacctaggcatccatcaacagtggataagataaagaaaatatggtatgtatacaccacaaaacactacacagcccccaaaaatcacatttttggcagcaacatggatggagctgcaggtcattatcctaagtgaactcaaggccagaacagaaatccaaatgccacacattctcacttataagtgggaactaaactatgaatgcacctgaacgtaaagaagggaatgattacattaggaataactaccagaccaaaaagaaaatgcaaatgggagggagggggcgttgcgtcctgaagacccaccttgtgcgtcctctgctcactgcccgggtcatggagttgttgggagcccaagcctcagtattatgcaaccaacagatataattaacctgtgtgtgtactctttcatctataataaaagtagaaactattacacacacacacacacacacacacacacacacgaagaagcttaagagctacataaacaaaaaaataagtaaaatctatagttatccaaacaatccctcactggcaaacacacagaaacactaacctatggacaaaatgagaaagccaaaaatgcagcccaaaattacatatggtgaatgcatttttcaagagaacaccaaatatcacaacagtgaagagagaagtctgctaattgtctttgagtaaaatgaatttctacctgcaaaacactgaaatggatcctcatgttacataagacaaaaaaatcaatgcaaaatacagtaaagatctccacccaaaactgaaaacacagggtgttttcacaccctagaagaaaacacagggtgagcgtttacttcagtgaaactttaatctatgtacacagattgccaaaaggaaagaaaacaaaagggaaaagtaggaggaagaaacccacagacaatgcgatcttttttcctttttttttgtgacgggacaccaaagtcaccacatgcacatgcaaatagaaacacgcaggactatggaaagctttagagatgttccacaggaatgaaaccaatgaaccgaaagagaaggtgtcctacagatttggagacagatctgaaaaactgtatctctgaaagcggttgttatctaacatgtccaagaaactaacaccactgtgtttggaagcaacaacaacaacaaaaaagacaaaacaaaacaaaaacacaacaacacatatgctgaagcaaaactgggcaaaggcccttaatagacatttctgaaaagatgacatgaattgactaatgagtcaaaaagaagttgctcaactttatcatttctcccgcaaaggtaagtccaaaccacagattctctgggattctggagaatgtgaattctgactcagtaggtctggagtgagcctgagattctgcgtttctaaaaggttcatttccccacaaatccacattatgtgtattaatattaccaagtaaataagaaaggtcaaaaataaaatggcaagccattagtagataaccttagtcttcctcctcatcctcctcctccactgcatgggttaggatggtccccagcatcctgatcccccaggtcactgacatcagctcccaaactcatgccaggaatgtccttccctcttcttccttcaggccataatgggtatctatttttccagcatctttctcccaatctgtgctgatttagccaccctctgtatctgcctccctgggacaaagggtcaaactcaccagcactctgagcaagagctacagcagctgccacatagactatccccagcagagctcagtgatggacaccaggttcacaatgccagtgggcagtggtgctgtttactgcatccagtggggatggagtggttgtccaggcacagacagatggacaatcacacagcaggaacaaatgtacattctgaaatttaacaaagacagaataagggactcttggggaatagaggtctcaattgcagacatagtgagtgcctcaaaaattagagaactggggccatctctgtcatggcccggattcctctctccttcatcctcctcagtcatcaaagagattccattagggggcaatcaaaggatgctggggcctgctactagctcccaaaaaacaccacaagcatttcagcagggagaaaagaaaatgctcacaaggatggggttagatttagttataaaccagattgtgtggcaggagggaggacatatcccccatcctttggccactccaaaattgggagagctaatctggggaaaggcaccaacacctattcattagtgtctcggtcctgtgtgatcatgggtctgtgtgagttctcagcagctgcctctctcaaggtctccccacaggacagcagggtgaaacctggggcaggaagagaggggaagctgatttgcataaagaactttttttatcctattgggtctggggaggcatgaaaaggccctgaggaaaacaaaccccagctgggaagcctgagaacacttagccttcatgagtgtccccaccatggcctggatgatgcttctcctcggactccttgcttatggatcaggtcaggggaagggactctatccctgggggaccacagaaaacagggtccaggttactctcatcctcatgatcataactgtgtctctcctgttcgttttaggagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttccacagtgatttaaacctatgaggaagtgcaactaaaacctctttatatactgagaacagttcagcccttacagacaggagggaaagtgagagggtggaaatggtcaacacggtgagtgaggagtctcctcgccccagtctctgacgcaggggttcactgccaggtgcctcacccagtctctccccgggtgtgtccaccttcccagtgtggcttttccatggctgtgcttcgtctccactgagaataatgtggagggagaattatctacaaaatatataagctcacagtgagtcacagacaccccagtgctccaggaagacgcttcttattcaaagagaattaacaggcatatgctcactcattaatttgaccatggaggctgactgaatattttatttatcactgaagtgggagcattttcaaggggcttgttaaaaatgtaattctctaacctaaacctactaagtcagaaacttgtgttggtgacagatagcctgtatttaacaagctgtacatgagatttttattagcgttaatgtttgggaagaacctacttttattatcataaaattattcataaggatctccatttataatgatgtcaggttaatattccataatcctactctcctaaattcccattcaaagcccccaaatactcagaaacagattttaaatctcaagccatagcaaaaattataacttgatttatgcagacagagtagggaggaatttctaaaaccgtaagttcctaggtgccaggtgtgctgactcatgcttataatcacaatactttgggaggttgagacaagaggactgcttcaagccaggagattgagaccagtgtcttccacatagcgagagtctatcaccacgaaagaaaaaaaaaagatataagtcccttcaggaatttccaaaaacttgtttccttagggtatatttagtggtccatatgaacatctgttactgaaaaccatcccgtagaggactggcttccagaatcccttctccctcccactgagctcacctacctgtggctctggctctcagggtctttataggacacagggctcagcctcttatcaccgattgttccacaggatcatggttccactgagatcctctcagcatagatacgtacctgtcctgaacagtgtcttttaacataatgttggcaagatgggaaggactaaggggtgacggagccttggagccaccagaagatggcagtaacctcactgctgagctttgctaggccagactcaggctcccaccctcctcccttcctctgactctttcttctggccacccggggtccaggagctttttccactcaatctgggctcaggggtcacctcagagaacctctcaagacaaaggaggtgcttcaggggatctaacacaagtgagggcagattttaagactgtccatgcacagaaaatcctgtgaaaagaaacaaaccagccctacttgtgtctgcgcacctgagtccttaggactgttttctcctgatctcctggctgagtaaagattgcaaatgtgcggttcattatccagatccagagaaatccatgagagtttatgaagacaaagacgacaactaccctatctacttgtcacacaatgaagacactggccttagatctgtcagtgccctggaacattctggaagaagagggtgaaggttacttggcatacgttgggactcaaacatgaggatctcatgatgacccagagggataaaggtgggatcagttgtgagggtggaaaatgtggatttcttaaggccattttgttaatccttttctcattgcaaaggatttaaactgaaatgaacacgatttttctaataaatgcttatgaggctttccattaaatttaatcatatttcctgcctttatgaaaataaatatagaaataaaatatacttccataatgcattactgattgtgtatctttaaactagagggaaccattacttctaaagaaaaattactaggattgtttgcattttaatctgggatcctacatgatggctacagatacagctgttgttcaaggttttagcctggaatctctgccaattcaataacggaggcaataaaaatagacactagtattataaagacagaattcatttattttgaaagttttgaaagctatgaatatctaccaagaataaaataaattgtactgaaaatatattagaatgaattaaaaaatgccaaattcacaactaataaaatttattataaagttaaaaattcttatatttttctgtctcagtataaaaaataaacatttaatgtatctattagaaaataattagcaattttgtaaatgatatcaaagaaaatttgaacaaatggtgaaatattttcttatctgcggacaccaaattaaaaaaattcaggccaggtgcagtggctcacacctgtaatcccaactactttgggaggccaaggcaggaggatctcttgatccaaggagtttaagaccagcctgggcagggacgggtgcagtggctcatgcctgtaatcccagcattttgggaggctgagacggcagatcatgaggtcaagagatcaagaccatcctggccaacatggtgaaaccctgtctctactaaaaatacaaaaattagctgtacatggtgacgcatgcactcctgtagtcccagctacttgggaggctgaggcaggagaatcacttgaaccggggaggcggaggttgcagtgagccagatcgcaccactgcactccagcctggtgacagagcgagaccccatctcaaaaaaaaattagccaggcatggcttcatgtgcctatagtcctagctactagggaggctgaggtcggaggattgcttgagcctgggaggtcgaggctgctgtgaaccgagattgtgctactggactccagcctgggtgacaaagtgagaccctgtctcaaacaaacaaacaaacaaaaaaccaaaaaaaccccaaaataaaacaaaaattcaacagcatgtagattagtaatgttagtgctttatttttaaaaattattgttaacttatatgggttttcctctgagaaggtgcactggaaggtgtcagcagagcagatagcacaaactcctcagatttcagaagcaggggtttatggtaaatgaaaaatgccagtcacttgtcagcatgcacaggtggctatgcccgccctgtgtcaggctctgtgtcagtagtagggtgctccatgcgtccttttcagagtcctacatgccatctatgctcactcagccaggcctgtcacctggaagtaacaggcaactcctcctgcactggaattagcagcagagtcaggtgaataatgtggcctggccacaccacctctcagcaaatgtccccagtggtgatgcccgatagttcccaatcctccttaagtaattaattcacttcaattgaattaaaaaaatcaatcacttccctatgacacacaaggacattcactctctggctttaactatccttgcctgccttgttattatcattccatgtgcccaatactgtcaaaagatgtatttttgccataccctccacatgcatttcatatgtgtgatttttattttcaaattctatatctcttctaggaatatggtgtgttttatttgtcctgctgcaggactcccctctccactcagattaaattattaaattccagataaaaaattaacttggaatactgttgaatcaatagtagaagtaaccaaaataataaagatatttcaaaatgaagattgatttttaaaagtaaaaatgtcacatactccacctagaagataagagactgtactacaaattcattagaacatccccttcatgtcatgggccagtcatgtccctgaacttaacctctgtcttctcgggtgatgttacaggccaatgcagcatcagctgcccacactcctagtggtggaatctgggagcacaggcaggagtctgcgcctgtggccttggctgggtgaaagatgacatttccaagacttcttgcttggcagccatcctcacgtgcaggtggtctggcagcagcactgcaaaacccaggcaagggatgccccactgcaaggcccagtggtaactgtggtggccattggcattgggggcagatgcagccatgtgagttggtgggctgtggcagccaccctaatgatggtttccacccctcccagctggtggtggctaaaaccacccggtaggagtttcaaaagcagtggcaccattaagcggagctcctggaggaggactggaagcaactgcttgcattgaaggaatgtagctatagtggaattattgaaccacatcatatttgcaaagatgcagaatgtattacagattacgagatatggaagttgaggttaatctggtagagagcagtgaatatgaggaggaagctctctattgggcgggtgctatcatagctgcagaaggtgatggtgcaatgcttctgccagtgagtaaagtcttgtacaaacttaaaccagttacggggtaaaatctgatccaggactacctgagggtcacttatgttggcctgttcaatacacacatttctttccaggagccttaccaaaggtctatagtagtgagttcagtatggaggcagtaatcagatcatatctggaaggaactggcataaactccaatcctgtgggacatcatggacagcaactaaattcgaatcaacagagtagagcccttgacattggacaagttcgtggtgaaagatctgaggctttaggactccgacatttgtgaatgacagcactaaatgaagtctttactggtgaacgtctatccagaataccttatgcttgggctgtggcagtggataatttaagtagacccactctatttatttatttattttgagacggagtcttgctctgttgcccaggctggagtgcagtggcgtgatctaggttcactgcaagctccgcctcccaggttcacgccattctcctgcctcagcctcccaagtaggtgggactataggcacccatcaccacacctggctaattttttgtatttttagtagagacagggtttcaccgtgttagccaggatggtctcgatctcctgacctggtgatccatccgccttggtctcccaaagtgctgggattacaggtgtgagcctctgcgcctggctaagtagacccactctaaaagactggtttcttactgtgagatttcagttggtaatggtccatgggaaaaatggaagacttcagggctcaatttgtgaactggagcaagatcaaaggcaacagggttgcaagtcaggctgtggagcatgattaaaatattgcaaatgacaaggacgttggagtcttgcattcaactgtaaaatgacagaataacaaataaatataatgaatcattgttctagagtccaaaaagggccaaaagtaattttcagtattcaagaactaaaaagcaagcagttttctcgagcacccatgagcattgtttctcctgagagatttgtcctcgttttcattgctggaacacctgcatggttgtagatggaggaatgtcttttgatgttcctatttttatatcagacaagctttaaagcaacaacagttataaaagacaaagaaggaaattttataatgataaaaggatcggtccaacagaacaatatcacaatcctaaatatatatgcacctaatactggagctcccaaatttataaaacaattattactagacctaagaaatgggatagatggcaccacaataatagtaggggacttcaatactccatggacagcactagacaggacatcaaggcagaaagtcaataaagaaaaaattgactttaattatatcctagaacaaatagatttagcagatatttacctaacattctacccaacaacttcagaatataccatattttaatcagcacatagaacgttctccaagataaatcataagataggccacaaaacaagtctcaacaaatttaagaaaattgaaattatgtcaagtaccttttcagaccacaatggaataaaactggaaattaactccaaaaagaacccttaaaactatacaaatacatgaaaattaaataatctgctcctgaatgacctttgggttaacaatgaaatcaagaaggaaatttaaaaattgcttgaactgaacaataatagtgacacaacctattaaaacctctgagatacagcaaaactaagaggacagttcatagcattaaatagtctgaaacagcatgaacagacaatctaaggtgacacctcaaggaactcaagaaacaagaaccaaccaaactcaaacccagaagaaaagaaataacaaagatcagagcagaactaaataaaattgaaacaaaaaatacaaaagataaatgaaacaaaaactggttatttgaagagataaacaaaattgacagaccgttagtgagattaaccaagaaaaaaagggagacgatccaaataagctcaattagaaatgaaatgggaaatattacaaccaataccacagaaatatgaaagatattcaaggctactatgaacacccttatgcacacagactagaaaatctagaagagatggataaattcctggaaaataagttattatttgaaaaagacacttgtatggccgggcacggtggctcatgcctgtaatcccagcactttgggaggataagcgggcggatcatctgaggttaggagttcaagaccagcctggccaacatgttgaaactccatctctactaaaaatacaaaattagctggacatggtggtgcatgcctgtaatccccgctactctggaggctgaggcaggagaatcgcttgaacccaggaggtggaggttgcagtgagccaagattgcaccattgcactccagcctgggcaacaagagcgaaattctgtctcaaaaaaaaaaaaaaaaaaaaaaagaagaaaagaaaaagacacttgcacacatgtttatagcagtacaatttgcaattgcaaaaatatgcaaacagtataaatatacatcaaccaatgagtgaataaagaaaacgttatttttttatttttagacggaatttcgcttttgttgcccaggctggagtgcaatggtatgatctaggtttaccgcaacctctgcctcctgggttcaagtgattctcttgcctcagcctcccgagtagctgggattacaggcatgtaccaccacgtccagctaattttgtatttttagtagagacagggtttctccatgttggtcaggctggtctcgaactcctgacctcagatgatctgcctaccttggcctcccaaagtgctgggattatgggcatcagccactgcacccagccaaaaatgtgattttatatatatatatataatatacaccatgaaatactactcagacctaaaaaggaataaaataatggaatttgcagcaacctggatggagttggcctcgtttactactctgggtttctgtctgaggatgagggtgatgattgctgatcaggatgcggaaggaacccagtgctaacccacagcatctgccccacagggaaataaggcacaagtctcttgtttgatcccacgctatgacctctagacctactcttccctcttgtcaccaaaaccacaatcaggaaaaatttctgcaggcatttcaccatcctggaacaaggatctgagactcttcactgaatttgtgaccttctatccagccaatatttatactgagctattaagattaacatcttagcctggtcattgccacacaggcaggcaaggcagctcaggtggaaaatacttttggtcatcccatgtgtctgggcatatggccttgatgtgagtttatgttcatgctcaggacaagttatgggtcaggggactagtcagcttatgggccaggaaaaggtgctaaggtttgtggagtcaaagagggaattcacacatattaatgctccttgtttccacctaaggcagtttgtgaagtctgtgggttctgtgactgtccacaaatggagcaggaacattccttagaacggatgattgggaccccacaaaggaaaagacaagaggaagcacaggctacacaatgaaaatacacttggtcatgccaaaggctaggtcatgccaaaggctaatgaaagagctttgagtataattcagtgcctttggggttgagtggaaaatacaaaaaccatctttgccctgctctcacaccacaacaatcaacacgtttccatgaccaaatgtgtaggatttctccccaccccctagaaagcaagccattggttttgcagcggacaccacacaggtgccctctcattgaatgcaattctgacactatccacatggagacagggtcagatcttacagtttgagggctacttccccaagactgtgccccactacttacgccaatcccaagcctcagattgctttacctgtgcttctgtccaaatagctgtaagttgaagatttcacaacatctccttggcttctattaatttgctagaatggctcacagagctcagtagacacttacaggtttattaaaaaggatacaaccaagcatatagatgaagacatgcatagcacaaggtatgggaagtggtgcaccaccgtccagtaatcttcatgtgttcagccttccagaagttctcccagcctagctccatttgggttattttatggacgcttcctcaccgaggctttatggagtaaaccactgcccattggtgaataatcggcagcccctctcccctccacagaggttgggagatgaggctgaaagtcccatccctctaacactgccttggtctttcttgtgacctgcccccatcctgaagttacctagggactgtcagccaacagtcatctcattagcatacaaaaagactctggtgattttaagtattttaggagttgtataacaagaaatggggtcaaagaccaaaaccataatttataataacacagggatgaaaaagaaagtagaggttgatgatttcaagcccacactagtcctcattatgacagatgtggatttccaacccataagaggcaggaggctgaagagctgagacgaaacctgtgaaaagcagggacaggggacatttctcaatttcttgttactgaagtgatagagctccaccaggcctcacttggattgacaaactaaattaaaagatacactctttaaataaaaagcacttctgagcatacatccaaaagaatgaaaatcaggatattgcagaaatatttgcacatttttattcatgcagcattaatcacaatttcaaagacatggagacagcataaggtccactaatcattgaatgtttacagaaaatgtggtgtatagctgcaatggatgctgttcaaattcaagaagaattaggccgggcacggtggctcccgcctgtaatcccggcactttgggaggccaaggcgggcggatcacaaggtcaggagttcaagaccagcctgaccaatatggtgaaaccccgcccctactaaaaataccaaaattaactgggtgtggtggcagaagcctgtaattctagatactcaggaggctgaggcaggagaatctcttgaatccgggaggcagaggttgcagtgagctgagattgcgccactgcactccagcctgggtgacagagtgagactctgtctctcaaaaaaaaaagaataattaaattttgccatatgcagcaacagggaaaaccctggaggatattacactgagtgaaataagccaatcttagaaggggaaatgctgcacggcctcatttatatgaggtatctaatttttttttttcgagacagagttttgctcttgtcacccaggttggagtgcaatggcgcgatctcagctcattgcaacctccgcctcccgggttcaagcgattctcctgcctcagcctcctgagtagctggtattacaagtgcctgccaccacacctggctaatttttgtatttttagtagagacacagtttcaccatgttggccaagctggtctcgaactcctgacctcaggtgatccgcctgcctcgacctcccaaagtgctgggattacaggcatgagccaccacgtccggcctataggaggtgtctaatatactcaaccgagcagaaatggagtagaatgctggttgccaggggtagggagagaaggaaatggggagtcactgctcaagggctatgaagctttaggtttgcaaaatgaacaagttctagagatgtgctgtacaacactgtgcttacagctgacaacactgtattatgtacttaaaattttattcagagggtatatcacacattaaacgttcttattaacatgaaaaagggatagaaaataccatgaaaccacttacagaaagcaagtatggcaatcctctgtcctttgtcttgggagaaagttttggccaagagacaatttaggcaaaaaagagaatttactgaagaaaaacagagagcaaatagtttatttagagagacagtgtactctggaagataaggcagagcgggctgctgatagagaatgagccagcggcccgagaaatgtgcactgagtttttatgatattgcactttttcttggagttcccacctctgttttaagtctccacctttttttctttctctagtttttctgcttcagccttaagtccctgccttttccccacatagtttccagcccaggctgtgggaccctcccttaacacacacatgggcccagtgtttgataggaattctacctaatggctgcattgctcattactgccaccccaggaaggttgtatggtggtcaaatctatacttactgtacctgcatctctcttagaaatttctcctttgctctcacccctattatcagcatgcagctagctacattctgacaggttaacttcagagtgagtgaatactgggtgtcttaaggggctttgttctggcataggtatttaccctaatctctgttcgtatctagcatgtgtgctttgggtggtctctggggtgtgagattttccagaactcccttttctcaggggctgcccctcctgcttctgtctagctatctgcctactctaaagttagtattagtatgaaagcttttatgaaaaacatttttttccaagaaaagggaggcattttatactggtgaaataaggtgttcaatgacaacacataacaactgtaaattgtatgcacctaataaaatagctttaaagtatttgaagcaaaactgtctcttttagcagaattaaaaagagaaataatcaatccataatcatatacacagatattaatacaactctcttattaactgagtgaatgacatggagaaaaaagagtatacatacaaatacgtgaaaaccatgattaacaaaatcaatccagtgacaccaggaacccaagcctgaagggtagttgcttgagtatgcattcatggatgaacgcatccaatgaatcatcacaggaacaaacaattgaggccttcgtttatgtatttctaactgatgttaagtttttccttcctattctgtgagtagaggtggatccctgtggaaggagctgcccgggtctttgctccagaagctgtctgcattctcccctcactgtagcctcgtcacattaggccattgttatatttcccatatgtccttcttctagtaatccaggagccctcaatgaaaaggctgtttattaataccagtagctcaggacagagcaggggcatggctcatggatggtttggaccaggcccttagatgactgcactcacatgattcccactgagactgcagtctggccagtgagcagcaggggcactgtgggtctgtctcacggtctgcacagtggctattcatagctgtgccaacccctaaattccccagggctgggcagtggagcctgcactcactgaagccgactcagctgctgcatcttctctgggtgtggttccagcacccacttcctcccaggtcctgccagactctctcatccaccagtccccaggtcttgaataaatgcatagagtggggtgggggcaggcagtgggtgggacacatttgcatccataacccttcctctgtgaggccagtggaggggataagagaggcctagggcagccactccagctctggacctcgggagggctgtgtccaccatggccggggcccctgctcctccctgctgctcccctctcacttatcaggtagggacaggcctcagattcctgggaaagcctcccagtctgagttcttgccccgtgttccactctcacatttcatccctgcttactcacccatgagcatttgtgtttgcaggttccccccacctcggcctgttctgactcagccaccctccctctctgcatctctgggaaattctgaggctcacatttaccctgagctgtggcttcactgctggtggctagcacatatcctgctaccagtagcatctagggagtgctctctagtatctcctgagagatgatatatctccagtgggatagatatctcaagagtgggctcctgataaaaggataaagttcaaccctatttactcattttcacactcttctttgccctttttctctgagataatgcagcagaaagacccttgccagatttcagcatctgcttgtggacttctaaggtcacagaaatctcaaccaaataaacttttagtctcagtaagttacccaatatatggtattctattgtatcagaagaaaatggagaaaatggactaggacagcacgtgtagaacagtctgctaatctgactcaagtaagcaccatggctccagggtccccggtcacttttctaaatctaaagatgcctcagccaatgcagtaattctgcacatctctgggctgcagccagaggatgaggctactacatatctcagcagccatggcacttccacagtgctccagacccccagggaagtgagactaggacctcccctgtgttctctctgcctggtgcaatcaccactgtcctgcctgggaccaactctggctcagggattgattcctgttgttactttttcagccagtgtctaattttcctaggatatatagatgtaaaatgtgtttttttcttaaaatgttaatttgatatatttttcatatcttttccccttatgatgcctacagtggagtaggtcagttcttagagctaagtttccctccaggaagattacagaagaggaaggagatgaataacctacacgtgctgtcctagtccatttcccccattttcttctgatataatagaatatcatatgttgggtaacttactgagactaaaagtttatttggttgagatttccgtggccttagaagtccacaagcagatgctgaaatttggcaagggtctttctgctgcattatctcagggaaaaagggcaaagaagagtgtgaaaatgagtaaatagggttgaactttatccttttatcaggagcccactcttgagatatctatcccattgccaggataagggcactaatccattcatgatggtggaaccctcatgacctaatcacctcttaaaggtcctgcctccaattacttttaccatgataattaaattctaccatgagttttggaggggatattcaaaccatacacatgtcccaaactagggcctagacctgacttagagatgtgtgtggtctgagaacttctgatcagctggttggtccagcatgccccaaccccagctccactgaccagctccaggagtgagtgaggtcaccttcctcacaactgctcattccagcctgtctctgaactgttcactcctcttgaggttcagaggatgcaggtctttgtggttccagggatgttgggcaaacagtcttttccacagtggaatatgactgtgcttgtgacttcgcagtgtgcagaggacactcagcacctgcctctcccccccgactttgtcaggcccatgattatcaccctctccttcatcccaagttcatctgatacgcatgccaagatttcagtgaggctggggacacataaggatgatgatactaaaatgaacaagttccatttcataatagtggcagaagatcagagatctgtaggggagttgtgcccccactctgagtatttaggaagcaactctagggacatcttgctctgcttctcccttctctgcacaggtgaaagaaggagcctgtgcagacaatcgttcattagaagctcctgccttcttcctcttttccaccccctaggactggatggggcctttgtaatggcttcaaattatagtgagagtcaaacaagacaattggtcaatgactccaacatccctctcagggctgcctgacatgagacaggatggattgcatctgatacacccccacccttctttcttatcggtatattaggtttttcttattgatgtgaacacactctatattacacaaaataagttatatttatatttcaaacctgtgatggtgatttttaaattatagtaaaaatatacatataaaatttaccatcttaatcattttaggtgtacagatcataagtattaactatattcacattgctgtgcaacagatctgcagaaattatccatcttgcaaaactgtagctattgaataacagctccccattttcctgcctcttgtggtggttttaaatacaatgcaatacatactagctgaaaatggaaaaaagaagtatatgaaaatgttaaatgcatagcacaaaaaatgaataatagggtcactttggttataactttaaatgagaaaactcaaagtaaaacaacaatctatgatatatcatataaaatgcacaatttaaaatttttaaaatttaatattaacaaaaatatatgtaatacaccacataagtattcaataaaactgaatacaattatgtttaatttttttaaactgtgaaaaagatcctattaacttttgaatatttacgcaaggaaaccaagtacatctcttcttgaaaaagtttgattccaattttttttttctttttttttttttgagacagagtcttgctctatcacccaggctggagtacagtggcgtgatatcagctcactgcaagctccgcctcccgggttcacgccattctcctgcctcagcctcccgagtagctgggactataggcgcccgccactgtgcccagctaattttcttttgtatttttagtagagacggggtttcaccgtggtcttgatctcttgacctcgtgatctgcccgcctcggcctcccaaagtgccaggattacaggcgtgagccaccacgcccagccagtttgattccaattttaacagacaggtgtttttgacaaccagtttattttcttactgaaattttctttttctttttttaaaaaattttaaatctttaatttccgttttcacttattttcttcttgcttccaaaaggaaaggagtgcgtagctctgttgcctgtacatcgtccacagcccctggctcggggcagggtcccctaggccgcccgggggtccacatgcagcccctggggggccggcgcggggtgaggtccggccggttggggccgccgctaggcgcgctggctgggcagctcctgggagatgaagcgacgcaggcgctccaggtactggctgtagagctcgatgtcgttgtgtccggcgccctccacccacagcggctccaccgccttggggcagcgctcgtagagcgccagcccgtgtgagaagtcgatcacctcgtcctctatgccgtggatgatgagcacgggcgacgtgatcttggacaccttctcgatgttagggaaggcgtcgaagcagtaggtcttggtgtcggggaaggcgacgcgcatgcccgaggtgagcggcgagtgcagcaccaccgcggcacactcgtagcgcgaggccaggtccacggtgggcaccgtgccgatgctctgcccgtacaggatgatgctgtccgggctgatgccgtacctggcggcgccggagcagggtcagccgcggcctccgaggcgcgcgcacccttcccaccagcgggcgtccccgggcccagctccggatgcgaccctctagtctccccactcagccaagtcagtgggtcaggcccaggctccacaccagtcccgagggccacccccagcccccaacaccgcggcggtgggcgaggccagcggccccgccccgttccctggcgctgccgttcactggcgtttcctagcaaggatctgcagggatcccgcctacggagtgcccctggggcaggggtaggggaggccctggcgcctgttctcctcctggtcacccctaggtgcacactgggaactgtgtgccccccacatcctgaatgcttcaggcctccctgcccgggttagaaagccgttcctggtgcactggccaggacagcggacactcttccttcctgcagcccttgcccacccccttggccatgaggaattcaggcagctgtgtccccagatgtctccacccaattttggactctcggagtccccacgcccaatgagatgccagtgcaacccaggtcagcatcgaaggtggtggctgcggaggtggcaccccctcccaccagcaccttcccttgggagtggacaagtcctcggccacctcagcaccaccagctcccacccagggccacccccacccccaggtcattggtgtgcggcccttgacccagctgatccagcaccagttacaaggcctcctcgtacccagtcccaaccacgcgggacccacctgccaccctgcccatgccaggaccccacaactctcctcccacacgctccaggctctgatcccaggcagacaccctcttgcaaggcaggagcatgggcaggtgtgcgtcccctctgcctggcattcggactccaccagcagggctgtccccgtccctggcctggaatcccagcctcctggcagcactccacagctcgccactcacccatgccccaaaggatgctgcctggctggtacctgtggccccagctctgcctcggcctccctggcctgctccctggcagccatggtcagtagtgtgctgagccagcccagccctgtcacctgctacaggcaggagcccccagctgccacctggatgtccccactcaaatgaacgggacacatccccagtggaggccctgggcacgctctggcctccccctcacagctctgggcctaggttcctgcaggacaaagtggcagcaggacagatggccgagcagacgagctcagagctggccatggcgggtgtgactctgccagtggcccaggcagtagagacaggaggggccgaggaagtcgcatgaagtggtacttggtgtcagcgccccacactgctgggaggcccccagagccagggtggtgccaggggaccagctcccaggcccacagcagggaccgcctgcaatatcaccaaggcaacgaggaccccacctccccagggcctctgacttctcagagttgtgcctggtcccctgtgggagcaggtcagaccagtgggctgggcagggccaggatgagacagccccagtggatggcgagcaggaaaggccgccagaggcccacccgggtctcctcgtccaaagcagcactggcccgggcggtgctcaaacaccggtgaagggcccaggcaagcgcagggctggggacctggatgactaggagggctggatctggaatcgaggctggcccagacctcgggtgtgtgctgggggtctgcaccttaccctgcaggccctgccccaggatggccaagctccgcagccacagggcctcatgggccaggcctcgggacctggatgcagcagcctcgcctcacttggccccaagtgctgccttggcagatgggctcccagccacacgtgcacagacccccagaccaccacccactccctcccaccgggtggcatccacgcccctgtgacaagctcagccccttcccgtcctcaggccaggggttccagggagcctggctccacaggccagggtgtgggaggaccgcctggccacacctcagccatgtggaggtggcacctgcacacccaagctcgcctgtccggctctctggccctgtgcatccactgtggctcccctcctgcagggccgcccaacttcctcccagggaagcccgccccccggcccccggcttggtcccctcttgggtgtgcccaggctgagctgcccccagggtcgccctcacctggtgtgcagggcctgccaggcggcgtcgatgtcggcatagaggttcctctcggaaggcctgcccgcgctggcaccgtagccggagtagtcgtagaagatgttgcaatggaggcgggagcccaggccaatgtagaagctgctcatctggctcaggtccacggcgttgccgtgcgagaagaagaccgtgtacctggcaccaggcacgcagcgaacatacatgcaggagacgcggttgccgcgggcgctcttggtggggaagacctcgatggtgtccagctcgcgctggctgtactggaagtcggcgcgctccgtcaggtgcagcttccagcgcccaggtgcgcccgaggaggcccgcagggtccccgagggggcggccccggccccaccaggccccggctcaggctcaggcaccaggaaggcgagcttggcagcgatgcggccggggcagggcgggcagcaaaggcagcagagctcactcagcgacagcccattcatggcgggcgccgcccgggccgggcctccaccggggcccccgccaacaacgccgcctggcctggcccggcaggggaagcgtgggggtgctccgagtcgcgggcaggggggagagcgcccccccagctaccgccccagacggcagccccgttaggaggccagggcccagccccatcgcggtccaagccgagccccagggagcctcgcaaccacaggtctccatgtcgtgccctgggaagcccatcccggcccgcgcccccgggccccagggccgcgctccatggctcccggccgcccgcccgtgcatccgtcggtccctctgcgccccggcccggcctcctgcaccgccaccgccgcagctcccccacggacggaagtgagtttactgaaattttcaagccacagaaagaacaaaagaagtaatatccattatattgtccaaaacaatagtacctggaagatctggaggcaaaaatgaagcctgagaatagcaggacatagacatatttcataacatagactcacagcagaataatggttatgttggttcattagggaagaaaacactaaacagctcttgcagatacactcaatatacagtaagatagcttgtgattttaacgagttagcaaagcagaacaatgaggcaaaagcaaacagaaacactaaaagaaatccattccctagaatcatttttaaagactttgctagatttaccaaagaattcagtattgacttattctgtctccattttatttcataatggaacccgtctaattttatgctaaatgtatgctgtaaggacaccttgctactctgaaaaaataagggatcagtggataaaagaccatattttattaaaaaaagagtgtgttttgatgcatgattttgtgactctacatttttaagtaaggatgaagaacttggtgattaattaaatgattcctcagttgctcatcaatgccatcagatgccttgaatatactgtgaggacagcatctggaagaaatggaggagatctgagtaataattcagatggagccaatttccacaatcttattttcccattacctgcagctctgaatttaactaagtctctgtgttaacaacttgtattgtttatctgggtgaatgacctcagaagacaccaggcagctggatgcctgcacttctttcgtgctaatggttcatatagtctcctcacccccaacactttgatacttccttgaaactggattacatatgagatagaaacaaagaatgcaggtggcataatgactctcaggagtcactgaatctgtgttcatgatgcattactgtgccagctgcctccctcttcttgtgaaggcccttctttattccttgagatgtgctcatcatgaaatagctacaagcatatcatctgcttgccttgcccgttatagcaaccatgaaaataaatttgcagcatcatatatagcccaaatattctcgaaagatgatcctaatagctctaataacaaaataagttttctacagagtagctatatgtacatgctctcagcttatgtaaacttgtgtttttattgctcttaaagcaaaatttttcctaaaattgagaaaagaactaaagttctttgtcattatatgaagaaagatacagcatctaatattgtgaacttctctattttgagatgttttcagacatcaagactggataataggctgggcacggtggctcacgcctgtaatcccagcactttgggaggccgaggcaggcggatcacgacgtcaggagattgagaccatcctggttaacatggtgaaaccccgtctctactaaaaatacaaaaaaattagccgggtgtagtggtgggtgcctgtagtcccagctacttgggaggctgaggcaggagaatggcgtcaactcgggaggtggaggttgcagtgagccgagatcacgccactgctctccagcctgggcgacagagcaagactccgtctcaaaaaaaaaaaaaaagactggataataaaattatttaacaattcggaacataaatttagaattgaaaaaagctttatactatactatactatactatactatactatactatactatactactaacacattttgtttgagcatggttgccttataagtttttggtagttcaatgaaaataatggctacttgtgagaaaactgaaatagactaggacatagtagatagagatagaaagaacaggtaaattaactgtctatgccacatggcaaagaaagtttacagtacgtagtcattaaacgtacatgcttataaatatataaccaatgatgaataattttaaatgcaatttagcagaattcagaccgttttatattaaacatatatttctgaatgaaatataaaatctattgaatgagggagacactttatatgtgtaattaatctcataaatagagaagacttttacaatagtttgtacactttagctataaactgtaattcaagagattcagtaagagtagctttttgtaacttaaatattctatattttccctgcatacatttttgcctttgatcatgtattttatttagcctgctaagatggtagagaaggtacagacagtaagcttttcaacctgacacataaattcaggttatttgaaaatggaatggtaaagtgttactgaagaacttttactatggttcgcatttggtaatatttcctaattattctataaacaaaatccaaaaaaaccttgatttcataacataaacttctgaggtctaaattaatcaataaaataaatttgttttaattaattattagattaaattatttatttaaataattatttaaataattatttaaataattaaattaattattagattaaatactagctgaggctcattagaggtaaactagagaattatcatcccattaagataaattttgattcagggaagtaacatcttggaagtttactaaatttaaatttaggaggaatttactaaatcaagtaccaagattttatttctgcaccaaatggaagacatatgtaaaatttaaatacattccattacttaatttactctttactatcatgagaattagtatagacagcatattttacacagagcatacaaagccttatcttcattgaattacaagtaaaatatatgtatgtacatataattatatatgtaatttagatattaaatgacagaatttacttatttacctgtgtgtgatggaatttgattctagtaattattccaggtacagtaactggttgaaaatgggacatgaagtaaactgatatgcttacaagtaattacagcaagcgaattcattgtaatgtctccaagcaaagcaagactacccacatgagataagaaatgagaggctacttattttgaccaagttagctcggtgacttggggaccaaggactacatgcacatggatgcttcttttgtacccctacccctgccaaaaaatatgtttccatggcaatatttgggaacccattatttcccaattgatgcttttactttcatataagacaacagttgatactccaaaatcaacttacattttaattaaccaaatacaatgttcctaaagacaaagagaaacatttcataacaataagagttaagccaacagaaagatagggagtatgaaaaaacagagaaaatcaataaaccaaaattaaatgcttgaaaagacaacacaattggcaaatgtttatttaggctaagcaagaaaaaagcagaagagactcaagtttctaaaatcagcaataaaagagaatccatcactgctagtaatacaaaataaaaataaaagacaatgcaatgaaaatcttatgctaaaaaaattagatagcctagatagaatgaagtcctagaaagacacaaactaaaacagactaaaggactaaggagcaatagaaaatctaaatagacctacaaaaggtaaaaagattggattgtaattttaagaacttataataaaattcccatctcaggtagctatcactctgagaaattaatatcaattgttcaccaactcttgcagaaaataaaaggggagagaacacttcccaattcatcttataaagccaggattactctgacaccaaagctatatcacaaaacaatatataacagtatctttcttttttttttttttcagatggagtctcactctgtcgccaaagctggaatgcagtggcccaatctcggctcactgcaacctgtttcctgggttcaagtgattctcctgcctcagcctcccaagtagctgggattacaggtgtctgccaccacgtccggctaatttttgtatttttagtagagatggggtttcatgttggccagactggtcttgaactcctgacctcaggtgatctgccaatctctgccttccaaagtgcgatataagtgtcagccttatatcacggtgagccactgtgcctggcccattgtttaaataaaattaaaaatcttcaacaaaatactggacaaactgaatccagcaacatataaaatagattatacactatatgcagatgtgatttaccccagcaatgcaacattgatttaatatttgaaaatcaatgcatacaaaaatcgcattaatagaataaaacacaaaaatacatgagcatctcaacagaaagtatttgagaaaatattacacattttcatcataaaacactccagagttatggacaagaagataacttcctgaaactagtggtagttatctatgaaacccacagctatcattatacttaccaaggagagagtgaatgactaatcagaatgaccactcttgcaaattctccctttttcaccttcctgctctcatcaccctcttttgctcctccatcttcccaaaaacattttcccccatcttttcccaaagccttctcccctctcctgctgctcaccaccattttatccccctccacctaccccaaaacttttttctcacacccccaccatcttttcacaatgccttctctccactcctgcttaccaacctcttttccccactcctgcccctctcccatatgccactcttttttcaccctccatctaccccaaaactatttgtcttcccaaccctcctccccctcatgctcgccaccatcttttcctcctccatctacccaaaaacttttctccccactgtctttttgcaaatccttccctccctcccgcttgcccattttccccacctttaccaacctctctttactcctcccacttgccaccctcttttccccctccatctgcccaaaaactttttacccaccatcttttccccaccctgttttcacaaaaccttttctccctcctgctcagccccccgtttttccctctcctatttgccaacctcatttccccctccatctacccaaaaacgtttttttttcccaccgtctttttcctattgcctttttgcaatgccttctcctgcttgccatcctcttttcccgttggtactcaccaccctgttttcctcctccatcgaccccaaaactattttccccctcttaccactccggtcgcactgcagtcgccatctcggccaccacccacagtgaggcgagccgcggtgccgcaggctgcagcctccagcatttggcaggtgtcttccttccccttctcctctgcctttaagttgggcacagaagagctgtgtaggcaaacaggaaagaacccgggatggtctgactcccccacctcagcatactttatatgcggagttatgcaaatgagttctgggactacatgttctgattggatgagagaaaaacctctaggcatacttagattggactttgttatcatgttctgactggatgagagcaagtcttaaaacgaccaatcagaacatgataataaagtccaatcagagtaggcctagaggtttttctctcatccaatcagaacatgcagttcaggaattcatttgcataccctccctgtataaagcatgttgagtgggcagagtcagggtcttccgtatattctccccgcaccatccgtgctcggcttagtgcaggaagaggagaagaacgggaagacaaccgcggcacagcagcttacgtgctgatgttggctgtggtgatggagcctgctaccggagccacagtggcccacagcgggagcatggccagagtggtggaaagacagtggggcaggtatgctatcagagctgcgctgcccgcggtgagggcagattgggggcgctatctggggttgcattgcctaggtgggttctgtgcagtatcggggactacgttacttgcggaggtggaacaggggaagggggtggggtgggggggacactattgaggatgggattaggtgtgctatcgggggccgtgctgatcatcaaggcagcttaggtgtgctatcggggcaggggacacgctgctccgagttgggggatgttacaggggctacactgcctgtggctggcaggggttaggggcactatctggggctgcacagccggtagtgggtggcgtgttagggacgctataagctactgtgttgtctgtgccccagggagggttaggtgtggggttgggtgtgctatcggaggctacagtgctagcagacaggttaggggcactgttgggtgttgcaccgcttgtgccaaggggtatgtttggtgtgctatttggggctacaaggggcaggttgggagcactgtcgggtgctgcactgcccatggcaaggggtgggttgggtgcactatcaggggctacactgcccagggcggggcgggcggggggggcgtgctatcctgggcttcactgcccatggcggggggctggttggggacgctgtcataggttgcattggggtggtagggggcgggttcggtgtggtattgggggctgcattgccagcagtgtgggggggggggtggttgggggcactgtcaggagcttgcgctgtcaagctagtagcaggttaggtgtgctattgggggctgcactgcccgaggtaggggggcggattaggtgcgctattgggggctaaactgcccacagctggcggggtttgggggctctgttggggggttgcagtgtcagaggcgggttaggggcattatcagctgctgcactacccgtggcaggaatcaggttgggggcactatcgggtgctgcaatgcctgtggtggggacgggttgtgggcattatcgggtgctacactgctggcggtggagtggttgggggtgctatcggggtcacactgtcagcggcgggggacaggttaggggtgctatcggatgctacactgtggtggagggcagggggtggggtgttgagagcgctatttgaggactacattgctggcagcggggggcggattaggggcactctcagggctgcactgccggcagcaggcagcagaggtggcagtgacagcagtggtctccacggaaaggacagtccttccctccctggactccaggctttacaaagcgattttctcctgcttaagtacagaggacatacagtgtttccgcaggaatactgagcacggcagggccccccacatctgctgtggtttcctgggttacaccctctcgctctgtgttgtggatactgcctgggacccccaggcaccgagtaacgtgcaccacgtgggggacggtgctctctgggtggaggctcaggaatgagagcccgcacttgggtggggagagctggctgggtctgactttttgctgcttccgttcccctaggaccgcagctctggtgggcccagtggttcctgcggagtggggagccgggcactgtggtgtctccagtccccaccacaggctccgattcatggccagcttgggccgaaaggggagggtgggtgtcagtgccttcgctgaaactggcacctgccacccagtggccagcatgaccaaggtgaggctttaatgctaccactccctgcatctgttctaggtttttctggctttgcctgcccagcagtctgtgcccacctagaggagtaggaggggccaccatgccgcatgctggaggctggagcccgcagcctgcagatggcacagtactacagctcgccttgctgcggttggtggcagtgatggagactgcagctcgaccccagcgatggaggctggaggtaggagggtacctggtggtggccacgtggtaggagccttgtagggtggggctggtgcattgagagcaacagcagcagtggttgtattggcatgggcattagtggtggcagcagcagcaagtctgtgagccgggaagggggtagtaggagccctgcaaggcccagctggcctggggtgggtaagaagcagtgggtgctgcagcatgggcctcggtggcagcagtggaagtgcagccagggcaaggagtcctcccccacctttctgcagtctctggagggcgcccacctcctgctggctcctgagccaggcatgagtggcagcattgtctcattcttaacaaaatttagggaatgactatttgtgtatctttttgcttgttttttgttgtgttaatcttggacttttcgaatttcatgaatcagggagtggataaaaggtatcataataggccttctaactctatcacctgatttttttcctttcttccagtctgttttttcttatcaccatcatcttgttctttattttcttatgctgctgcctatatttctggtttctattcttgtttctctttctggtcctcctgctttttgttttctttatcccaagcaatggccttaacaaactgaaactgagttaaaagtaaactacttgctagtgtgttgtatttttaaaataattggtccattactgtgttttagagatgagaaagtagttgcataatgatttagttacttgaatagctttgctttcgtgatcctgttaatgcgttgtaagtagttatgcaaggaatgaaaaaatgaagcatcaaataaaatactgatagcaaacagtcatttcatctctctcccatatagtctggagataaatgcaagtcagggggttaataagttccaaaaatttatgagatcattaagtgaaccacattcccttcattttatttttctgccacagttttcaagagcgttgtcatttgcatgagcaaaccttgttcaccacatctttgcaacagggaagggaaggggaggatcatatgtacaatgttttaaggcaaaaaaactcacaaccaaaagcaaggctttattaactttcaccttcgagaagctgcagtgttgagccctgttttattcctagtattactgcctttgatacgaactcttaagtgatcactttagaagttaatgcattttattgactgctttcaagaaacagtctatattgtatcatgcatgtttttcaagcccgcagaattgtataaggcctatatatacatagggcctataattttgacactttttaatgatttataaggttacgatcatgtaaaatcctgttgacacgtgagaatatgcctaagtaccgctagatagcttattttgaagagatagttattttgaagagatagaaattggttgcagtttgttaggtgtatttgtcaatgcattgcctcaatgctttaaagcatatagaagtttgaatatgctttaatctcatgtagtcctttgtttatagggtgtttaatatttttaaagactaaagatgtcacagccccctttaaggttcagtaatattaagattggagatttatagggttagaatccaacaaattcagaggaaaattgttaaattatatagctgtagagcaggaaatgaaacccaggttctaagctctaaggggaccatgagctgccataccaagtgcatcagtgactgggcatagagttggcagaattacaggatggttaagagagtgagctgtagagcctcactctatgtgaacatgaattttatataagtatgtatgtatttatttattttgagatggagtctcactctgtcgcccaggctggagtgcagtggtgtgatcttggctcactgcaacctctgtctcccagattcaagcaattctcctacctcagcgtccccagtagctgggaatacaggtgcacaccaccatgtctggctaatttttgtgtttttagtagagttggggtttcaccatgttggccaggctgttctcgaattcctgacctcgtgatccacccacttcagcctcccaaagtgctgggattacaggcagccactatgcccggctgtgaacatgaatttttaaactgcatggtgctttgggtcccagcttctccatctgtacaatggggacagtactaaggttttctttttcttctcagttgactgaattatttccatagtctgtctgtcttgccactcttgttacccacacgaaaggacctaaggtaatttctgacagcctgggactccttgtgcaaaacagaaggtgccacagacctcattttaggagaaacctttgttttcctcttggaaccccaagaactgtaagcagacaggtccatctcaaaatccaaggctctgctctgttttgctttgctttacctgactttttttttgatttgggtgggcatcaaaaattagtaggggagagctaaagaaagttgtggatatgaacatgtatttatggtaaggtaagttatgaaggagagaaatcttaggatcttgtatggcaaattcttgcactaaagtagataatgactaattaggaaagcaggaaatataggacaagtcagaaagtcataagatgggagagaaaagcttacgcctggtagatcctctcctgtctagaagtgtcgtatgtgtgatgtttatatgaaggagctctaattaattggattaaaagataatgaaagctctaaaattgtcagaaaaatagaagctctaatgccttttatttcacgtgacttcagcaatctttgggaaatgagagttttaaaattattggtggtaaaaagtcttcaaaaagtagacatttggtctaaattaagtcagaggttaaattggctaagtgctttaatgtcataaactgcttctttgactttggaaaattgttcagtttacctaatttggaactgttagatttctaggtaaggcctggggagaggtggagttagccatgtctcctagctatgctggaagagttagactttatctgcagttctgtcatgtatcctggactctgcacctggtatgtaattgaaactgcttacattgaaaagaaaaattatgtgtttttggttttaaaaggggtgggaatatggttttttccaaaaagtgagttttggcaaatttagaaagtttaagaattatttttagttgtaggaaaataaagtttaagcaagttatagaaggtttatgaaaattaactttgtaaagaattgtgtgtgtgagcaagttgactaaagggacagtaatgttagatgtaataaatgcaggtacccttccactttatcttctgtttcttaggttataaatattcactacctacgtttctaaaaactctttcactataatattaacacataactccattctccttgtattgcctgctttttcatagtatcctgaaattgcattagtagatttagattcagaagatggtggggaagcatcttatgagtgttttaagtaaatttaaggcaaagggttttctgtacatgggtggttatcacagcatcacttgttgcagcaaaacactgggtaacaacaatgtttatcaatgagaaattgttcggataaatgatgatttgtgccttgcgaggctcaactattcaaaagcaccctcttttcctcacttgctttacctttggttctgggcctggagcctttcagaggttactcaggaaatggactcctgtttcctgtgactaatctggacagcggcttcctatttcattcttcagcatcttccaaaaatttctgaagataatttcttcctttgtgaccacccatactcttggtttactttgcagttaacaatttcatgccttcactagattatctgtgtgaaggtgtggggtgtatgtgttcatactctggagggagcagaggaaaatagccacagccaaaggagtaatcttgcactaaatactcattataagaatgttgatacgttcatagatggtaaatctgtcagtaatttttacttgtatgattcttggttaagactgcactcactggtgataagcgtgctgaagggatcataggtgctatacttatgtgtgggaattgcattcaaaccaccaatgcctgtctactcaagttttgttgccttttgattaaaaactcttgggaatgtttccctggcatgcaaatatgggaactgcagtttgattctaggtagaaactctttggtagttgaaatgccataataagagacacagctgtcaatgggcaacaattcactgttggtaaggaatttacagtgctacttgccatattcttctttatccagactttgtgccaagaaaatgaaattctttttaaaaatttttttctagagtaatcctacaatattgctgttatcaagcctgatgctgtaattagtagaaaatgtctagaaattaaaagaaaagtagtattttccaactatggttaaattaattgcaaaataacttcctcttaattgtcagattggagacaagcttattaagagtgaaataaaacataatgtgttgctggtgctaggtacctctaaagcctttgagcactttcttctttataaaggctcaatctactcatgtgtcctgtaaataatcctgctctaccagcatcctatgtaaattttaaaaattatagttcatatattagattgtaacaaatgttgttcttctttaattatatgcaatgcaatcttgttatagactcacattagcttgccttattccctgtatgtttgctgtaaaatgtatagtccttttcaatatatgatagcttaaagatggacttaatattttgttttagaaccaaaatcttttatcttatatacaggaaaattacattggaattcagagatcagcaaacatttcctgtaaaggatgaaatagtaactattttcaggtttgctcagcatgtggtctctgacaactaaactctgaagtcataccaaggcagcatcagtaatgtttaaatgagtgaatggcgctgtgttccaataaactttatttacagaaacaagtggtgggccacattttgactgcagggtatagtttgtggacccctgaacaatggctttttctgaaacaacacaattgaattgagatttgaaagaatgttgaggcagcattgtttgtctggggtaatacctgaggtttgtcatctcacaccagggaaatcagggatgtggacacacaagaagtgagttcaagagtggatgattaataggtgaaagaaagagaaaagagaacagctctctctcctgcagaaagagagaggggcacctgagtgggtcttccggttttgtggtgaaaagcacaaggttttataaaggagcttgaggaggtggtgtcttgatttacacagggctctagagactggttggaccaggtgtgaacgtttgcatagcacagggagaagctggccattgcaccctaatcttttattatgcagatgggttctttaccttaccaggaccatattgtctgttccttactgtacctgtggttgacagagaaaagggaagatggagccaccatgttgaacatgcctggcccacaggtagccttttcctattggcacagctgctggcattcctatgagagcttatcaatgtctgcagcccaattttacaagatgctctttgttagaaaataaatgatatgggttttttttttcattagtaggaaaactttacactaggacttccttactttcagtatctgcctaaataatttctttttaattcctacatcaatgttgcatgtgcaatagagaaggtgacatgtagggagctgtgtcagcaggggttgcatatttcttgatgagcatcccatgatgcattcttcttcacttgtggcaacattagcattaactaatctacagtaaagtagatgggtccacaggtcatgggacatacactagctctgccaattacatgttgatttaaataatatcattctctaaggacagctttttttcccccagatcctggtatgtatgtggagttggggagagacaccaaactgtaccccatttcctcatacattgcttatacttttagaagtgtttgaaagataatatcacatactagtagtttactgtttcttattcaagttagttttaatagtcgctagggtgaatgttttcaaaattgtatagatattcgggttgaggcaatactataaattatgagttcatctcagtttttttgtgctagcgtaatgacatttcggagacataatgcatatgtgcaaaatacttcacctctctggaaaacagtaaagggctacataataggacagacaaaaataaaggcttggcgtaatggctcacacctatgatcccagcactttgggaggacaaggcgggtggattgcttgagctcaacagttcaagaccagcatgggcaacatggcgaaacccatgtttacaaaaacgataaaaataagccgggcgtggtggcatgtgtttgcagtctgagatacttgggggactgaggcaggagaatcgcttgagcctgggaggtcaagggtatagtgagccgagatcgtgccactgcactccatccagcctggataacagagtgagaccctgtctcaaaataagtaaaaatttataaaacaaagaatgtttctaactgtaataaaggagaagtgatcaagcttaagtgtagcttagatttaatctttgatttccgggtactatattacttaaaaatatgatttggatatttagaagttgttcaaattagaaactcaggagtggggtcactggtcactaaggtgctgaatatttttaataccttagtggatatgtaatcaacaaagccaacggaaccaatagagcatttgctttcataagaatttaagtgttgctgggtactcttaaatcgagctcacattattggtgtcatttaatataattactgaatttctttgaacccagtttccactttttaaaaattatttagctcattaggctgaaaacttctctttgttacattttattacacttcagtgtaatatgtgtaagatgtacattgcttctctctagaaaggtgagacaagttgaagcagggttgggggtgggtgcttccagttcataggtaaataggagacaaacggttgcattcttttgagtttctgattatcctttcactgaatacacaatttacatgcaagatgccatagaggaatagtcacttatgcctgagtctggcttagtgaatctgcatttttacataaaaaactgggcagagaaagccaatcagatacacatttgtctcaggtgaggagagggatgactttgggttctgtcctttgtcccccacctgtaaagataatctatcaattgccaatttatattgccagggtcaaattcaacagaactgttttagtgtaaagatcttgaggcccacaagaaatttcctttctgacaaattatgagggaggtatatagctttcgaaatctttgtagttatttttttattttattatttgggttttttttttctttattgacaaataattgtatatactcacagggacatagtgatgtttcaatacagaaaagttatagtgagcagagcaggataatttcatatcctttgttaaaggaaaataaatctccgggacaccccactaagccaaataatagttatcttatttagaaataaaatgggaggcaggtttgtttgatggagttcctagctgaggtgggagaattgcttgaacctgggaggccgaggttgcagtgagccgagatcgcgccattgcactccagcctgggcaacaagagcgaaactctgtctcaaacaaacaaagactatagaaaagctatttgtgaaaatgctttttgatgtgctgttttatgtcacagaatgcaacctgtgttttgattcagcaagttcaaaacactctttttgtggaatctaagaattgattattttgatcctattgagctttcataagaaaatatgaatatccagttgtaaaaactagaaataagctataagctatctgtggaatgctttgtgaggtgctgttttatatcataaaattgaacttgtgttttgattgaacaagttgaaattactcattttgtagaatctaagaagtaacgttttggaacttcttgagcccttattaaaaaatagaaatattcagtcctaaaaactagaaacaagccatccgtgcaaatgcattgtgatgttctgttttgtatcataaagttgaacctgtgtgttgattaaacaggttctgaacacttttttttgtagaatttatgaagtggcatttctgagcctattgagcccttatacaaacatacagttttaaaagctagaaacaagctatctgtcaaaatgctttgggatgtgctattttatgtcacggaatgaaacctgtgttttaattcaataggttcaacacattcttttggtagaatctgagaagtgacattcccaaacctctgaggcctttaaaagaaaatacgaatattttcctctaaaaactagaaacaagcaatgcgtggaaacgctttctgatctgttagtgtcacagattggaaactttgttttgattgagcaagttcaacgcactctttgtaggatctaagtagtgacatttccaaacctattgagcccttataagaaaatatgaatatttagtcctaacatgctatctgtgaaaatgctttttttttttttttttggcacagagtcttgctgtgttgccaagctggagtgcagtggtgtgatctcggctcactgcaacttctgcctcctgggttcaagcaagtctcctacgttagcctccctagcagctgggactacaggcgtgcaccaccacgcccagctaatttttgtatttttagtagagatgtggtttcaccatgttggccaggatggtcttgatctgttgacctcgtgatccgcctgcctcagcctcccaaagtgctgggattacagacgtgagccaccatgcctgactgaaaatactttttgctatgctgtttcataacacagaattaaacctgtgtttttgtgagacaggttccaaacactctttttgtagaatctaaaaaagtgatgtatccaaaccttttgagccataataagaaaacatgaatatttagccctaactgctggaaacaagctatctgtcaacacactttgtgatgtgatgctttatatcacagaaatgaacttatgttttgatgaaacagattcaaaacactattgtagaatcttaagaagtgacatttctgagcctattgtgaccttataggaacatacaaacatccagtcctaaagtctacaaacaagctatcttggaaaacactttttgacgtgcagttttataacacagaattgaacctgcattttgataaaaacacgttcccaactctctttttgtagaatctaagaagtgacatttcgaatctattgagcatttacagtaacgtatgaatatcttgtaataaaaactagaaacaagctatctgtaaaaacactttgtgatgtgctattttatgtcacagaatggaacctgtgttttgtttcagcaagttctgaactctttgtagaatctaagaagtgacgtttttgaccttattgagcccttataagaaaatacaaatatccagctataaaaactagaaacaagctatcagcgaaaacactttttgctgtttcatatcacaaaattgaacctgtatactgattaaacagtttccaaacactttttttgtagactcttaagaagtgatgtttctaaggcagtgaggccttatgggaacatatacataatccagtcctaaaaactagaaacaagctatctgtgataaccatttgtgatatgctgttttatgtcagagaatggtacctgtgttttgattcaacaactgtgagacactctttttgtataatctaagaagtgatgtcaccaaacctattgagttttataaaaaatatgaataaccctaaaaacgagaaacaagctatctgtcgaaaatgctttgtgatgtatttttttatatcaaataatggaaccagagttttgatgaaacagcttccaaacactctttctgtagaatctaagaagtgacatttccaagtcaattgagttcttacaaaaaaaatgcaaaatccagtcccaaaaaactagaaacaagctacctgtaaaaatgctttgggacatgcagttttatgtcacagaacggttcctgtgttgattcaacaagttcaaaacactcttgatgtagaatctaagaagtgctgtttccaaacctattgaacttttattaaaaaagtaaaaatatccatccccaaaaactagaaacaagttatctctgaagatgctttgtgacgtgatgttttatgtcacaaaatggaaactacgttttgatttagcaagttctaaacactttttctagaatataaaaagtgacatttctgagcttattgagctcttagacgaacatacaagtatccactcctaaaaatgagaagaaaaacctatctctgaaaatgcaatgttatgtgctattttacatcacagaatgaattttcaaacactctttctgtagaatctaagaagtgaaatttccaaacctgttaagcccttataggaacatatggatattcagtcttaaaaactagaaacaagctatatgtgaaaatgcattgtgaagtgctgttttatgtcacagactggtccctgtgttttgattcaccaaagttgaaacactcttttggtagaatgtaagaagtgatgtttccaaacctattgagcttctataagaaaatatgaatatccagccctaaaaactagaaataagatatctgtgaaaacactttgtgatgtgctgttttatgtcacagaatggaacctgtgttttgagttgacaagttccaaacactctttttgtagaatctaacaaagtgacatttccaatcttactgagcccttataggaagatgtgaatatccagtcctaaaaatgagaaaaaaagctatgaaattgcattgtgacatgttgctttatgtcacaaaatggaatctttgtttttattcaacactttcaaaactttttgtagaatgtaagaagtgacattttcaaacctattgagcccttataagaaaatgcaaatatttagtcataaatattagaagctctctgtgaaaatgctttgtgatgtgctgttttatatcacagaattgaacctgcattttgatgaaacagcttccactcacttttttatacaatctaaaaggtgacatttcctagcctcttgagcccttattggagcatatggatatcctgtcttaagaactagaaacaagctagctgagaacatgctttatgacatgctgttttatgtaacagaatggaacctgtgtttttagtcaacaagttccagacactctttttgtagaatcttaggaagtgacattttctatttttattgagcccttataataaaatattaatatttagtcctaaatattaggaaaaaacctacctgtgaaaacgctttgtgatgtggtttcatatcacagaattgaacctgtgttttgacaaagcaactttcaaacactgtagaatctaagaagtgacattactgagcctattgagcttttataggaacatacaaatatccagttccaaaaactagaaacaagctcttggtgaaaacgctttgtgacatgctgttttatgtcataaaaatggaacctgccttttgatgaaacagcttccaaacaggtttttttttagaatctaatagttgacatttctggccctattgagcccttatagaaacatatgaatatccagttctaaaaactagaagcaagccatctgtgaaaatgctttgtgatgtgctgctttttgtcacggaataatacatatgttttgattcaacaagttcaagacactctgtagaatctaaaaagtgaagtttttgaacctattgagacttgattaaaaaatacgaatattcagccctaaaagctagaagcaagcaatctgtgaaaacactttgtggtatgctgttgtatgttatggaatggaacctgcattttgatgaaacagcttccaaaacacttttttgtagaatctaagaagtgacattttggagcctattgaacccttacaggaaaatacgaatatccaatcctaaaaactacaaacaagctatctggtaaaacgctttctgatatgctgttttatgtctcagaatggtactggggtttcaattcagcaagtttgaaactttctttttatggaatctaaaaagtgacatttgagaacctattgagccgttataaaaaattcaaatattagccataaaaattagaaacaagctagctgtgaaaacgctttgtggtgtgctgttttatgtcaaagaataatacctgtgttttgatttggcaagttcaaagcacttttttttctagaacctacgtagtgacatttacaaatctgttgatcttttataagaaaatatgaatatccagccacaaaaactaggaaaaatctgtgaaaatactttgttatttgcattttatgtcacagaatgaaacctgtgttttgatgaaacaacttccaaaccctctttttgtaaaatctaacagtgacacttatgagcctatggagcccttatagaagcactcaaatacccagttttaaaactggaaactgtctcaaaaacactttgtgaggtgcttttttatgtcacagaatgaaacgtgtgttttgagttgaacaacacacaagtttccaacactcttgaatctaagaagtgacattttcaaacttgagcccttatagaaacatacaaatatccagtcctaaaaacaagcaaaggctatctgtgaaaatgctttgtgatatgctgctttgtgtcatggaatggaatctgtgttttgattcaagtttgaaacactctgtagaatctaacaagtgatgttttgaacctattgagtcattataagaaaatgcaaatatttagccataaaaatgagaaacaagctttttgtgaaaatcctttgtgatgtgttttctatcacagaattgaacctttgttttgttgaaatagtttctaaacatacttattgcagaatctatgaagttatatttctgagcatttgagcccttataggtacacatgaatatcagattctaaaaactagaaaggagctatctttgaaaactatttgtgatgtgctgttttatgtcacaaaatgataaccatgttttgattcaaaaagtttgaaacactctgtagaatctaagaagtgacatttctgagcctattgagcccttagtaaaaaaacaaacaaaaaacgaatatccactcctaaaaaccagaaaaaagctatctggtaaaatgctttgtgttgtgctgtttcatgtgacagaatggtgcctgtgttttgattaaacaagtttgaaacactttttttttgtagaatataagtagtgatgttttagaatgaattgagcccttataagaaaatgcaaatatttaaccataaaaataagaaacaaacaacctgtgaaatcactttgtgatatcctttttttatgtcacagaatggtacctgtgttttgatttaacaaatttgaaacacactttttgtagaatctgagatgtgacatttacaaaccaatcttaagccagttagatactctgatgagccagctgtgtgtgtatgtgtgtatgtgtgtgtgatctttgattattaaaactgaaaaaataatcgtatattcatgactagtagacacagtgttttaaaactgattctgaaagatttgagggttaggcttgttttaaaaacaattgcataggtcctggaaacaccaagaattagtggcttctcattcctagtcacatgaaaaatattttactactcttgtgaatggccataaataatatgcagaattttttctgtgtcctaaccttttatataattggttctacagtgtacatcactgtgtgcaactttgttttgtgtgctcagacttacattttccagttttctccactttgatacaattggtctgtgtttcatacattttgtattttctatagcgttcctttatatgactctaccacattttattgagtctcctcatgctgacaggtaagtagatgaattaataaatgaatgaataaataaaaatgagagcaaatttcaaacaggtgattaatttagtgattgtaaccatggactcagcaggttagaaataaaaactgaaagatttagaatgcaagcaggcacatcataccttctaatagccattggaactatgacccacaaaccattagcctagaatgatgggacatatcttgtctctaaaaaaaggtcactgttcagttctcaaagaatggatataaaaatggcagataccattccacattattctacttcctttaacctctacgcataaaacttgagctgcagggaatgttacctcctgttcttaaaaagacttgtagttcagtgaggaactcactcctttcttcattcatgtgttcaaataatatagggaaatgaatggaaaagtgaagagaagttgaagactattatggggatagcacaggattagtcagcctcatggtattattgatctgccttattccacaaatatttaccaagcacctgctacatgcaatttgtatactaggtgctggggatacaggagataacaaagtccctgctgtcaatgaaaggggtcagtcctttgattcatctttagttaattttaagcacacaacaactatctcaaactttcttcacactttccaagctcccgatccttcatgcactcttggtagatgcctgaccttacctcttaccttactagaacctaagaccacctggtataaaatcccttaagcacactcagatttgcgtgattttacaatgatgtctgttcccaaagcatcctcacttctcttggagctgagggtgaagagctcctctttcttcccatccgtgatcttggaacatgtacgactacacttgtgacagtaaatgcttaatacaggcagaaggtttgttccttatttcctccctggggcctccctccagtgaatatctcttctagcattgtcagttgtatccaacagaaaagcagagatctctccattggtccaaaaacctaagatggactctcactgctaaacttctcaaatgaaaattcctccactttagtcctgattaccactcaaacactgttagactgggcaggtcactacccctgcctagttctgtttccccatctacataacagagaaataattgcgccttatctatcctacagaagtgtgaagaggtttgatgtgacagcagtgaaagcaatttaaaaagcacagagtgctatacataagaagacattttcataattattccgctctaacatgatatctgtattcatacgatctcaaagtacttacccaagcatggattctaactcttgtgtatgtaagcaaaggtgtaagtctgtcaccctccatgcaaatagaatctcccctcccttggcccctgcatctcaccatatacaggaattaactcaagatgaatcaaagttttaaatgcaagaccgcaaactatgaaaatcctttaagataacctaggccatacccttcttgacaaaggctttggcaaagcatgtgtatgtctaagtccctaaaagcaatagaaataaaaacaattattgacaagtgagacctaatacatgaaagagtggctgcacagtagaagatattaccaacagagtaaacagacagccttcacaatggaagcaaatgttcccaaactacatctgacaaaggtctaatatgtacgatctaccttaagtccttaaatcagatcaaaaagtccaattaatggttagagacatgaatacacactgctgaaaagatgtaacagccaccagtaaacatgaaaacatgctcaacctcgttaatagagaaatgcaaatcaaaagcacactggtcaaaatggtgattataacacagtccacaagaacagataccagcaggacagaggagggcactggggcaattgatcatgattcttatggatagtcatttagtgttattaatgaatttcataacaaaatgatcaccatacaaaaaatacaaaatgtgttttcttccctgagaaaggaaaataaaaacttggaatgccgattcactatgccaaaaggaaaagttaagctgaaagctgagtcatgcaagaaactgcctttctttttttttcctgagcagacagctactgataaatagttaaatttctccacaggtagctactctatgttcatctcatcttacttaaagtgctgatttactgagcaggagaaaaatatataactgactattcctttacctgtttgttttctcttgcaacatgtggattcagcaacgtgaccatactctccctcttttccccgcagcctgcttttctcttctaaacactgaaaccctaaaatatttttggagaaaggcacagacctctgtcgcccagccatgtctttaaccttggaagaagaaacttctaaattgataagagatctgtctcagacactttttcgtttacatcccgttatctcagaaagcaaaacaggctttgttccaacccaaagtaatttgtgaatattcaagcggtatcattctgatgtaaaatttacataaattcttgggtttaccaaaatgcaaatgggcaagcagatcactatttacagataatggcctaaaaaatggtaagagtaaatgctgtggagctaaatgtttctgagtctgccatttcctagttttgtagtttctctcgggcaagttacccaaagttgctgtatgttattatcttgacatttaaaatagaagtaataactttattataaataatagttaataccatagggtcattaggaaagtgtctggcatatatagtcacaacccagtgaatgccattattgtttttgctattatcagtataataattgatactaattttgatgctgaggtaaaataatatctggcagcttttaatttgctaatgttaaataactgaaaatagctttaaaaagtgaaaatatccaaatcaatgacaatatttgatttatataaaataagcttcattttttttagtttttttgctcctaattattacttcactcatcacactgatatctgagcactttttaaaacatatccacccttctcagttgtactacttattcccttttcttgtaatcccagccttcaaagatcctttctcatttttctaactcatttcacgactccctcaccttgacccccagttatatctctcttgaagtcaattccattgaattgactacttggcccaaacttcaccccaactcagtctctcttcaggaaggaaagtccccacacaaaaaggaatgtgtctttcaactcatgcgccctttttgaagaagctttccagacagcttccttacagtgatctccgttatccatcctttagatcgctgtggagtcctacaggggcgcaatgtggacagtcattcaaatgaagcacacctaagtgcttgcattttctaaaggcccattgattcatgtaactcccgtacttgcacagataagatgttcctgcctgaatgcagcagatggaaatgaaaattgtattctctgtcaaggctgattgtattacagcttaatgatttgcattttaaaacttggaagttctcataaatattaaagtgaaagaacaattggctacattattaggtaggttcggctgttcgtataacctggtgctaactatctaacctgcctgagtgagcctcagtcttcattactgcagcatttgtaagatatcaatgcctgcttgaactcatgtcttactaagattatggccaggattgagtaacatatggatataaaagcacttgacaaatcagagtatttcataaatgtaataataatatgctacatttataacatctatactcttttcctgtgtctatcttcatttaaaccttgcagtttctatcataatcaaagattttgtaatcaggttacaatgagtaggatttaacccataagcaattttcaaatttcctagatatgttttcagttttcacatttatgttggtgacaaaattctgttttcagttttggtgtttgcatcttctaaaacagtgtcttgggtacttgctctttgatgagacactgtgcagacataaagagtgtaagaaaacagaacagtttatctcagctttttgtggtctagataacctgcacactgctttcttggctcactgcaacctcctcttcctgggttcaagtgattctcctgccttggcctcccgagtagctgagactacaggcatgtgccaccacgcccagctaatttttgtatttttagtagagatggggtttcaccatgttggcccggatggtctcgatctcttgaccttgtgatccccctgccttggcctcccaaagtgctgggattacaggtgtgagccaccgtgcccggcctgcacactgctttttaataagctgatctgtcttcttgtttacataggctgtgctatagtcatttaaagttcaaaattactgctaaaaagtaattaatcctttactgaaatattcctgctatttcatgagctgtcttacaatttggaggaatctatttgtcactgatgtttaaaaaagaaagtcacagcagggaggctttagcttcattgaggaacattattataaaataaaatgatcgagggtaatttttttttgtccttgtggtactgtttctgcagatctacattaatctgagcatttaaagtaataataaatttgttatatcctctttattattcacttcaccatggtagcccctagtggtaaaaggagatgtaaattgctcagtgctcacattgcagggaattttttcctcagttgaataaaaaggagttaagcctctttggaaatgagggctatagcctgtcaataactacatatattcctgtttttaagaaatcagaattctggtgtccagtaaatgtagatgccagcattattaaaaagtgattgagcagagaaatgaattgaatttttgacccactctggcttccagctttcatgggagcctatacagggggatgatgaagagggatataagagaataaatgattgctctattaatctactttaattgatactaaaatctgacagcgaattacaagttccaggcagtaaggcttaccaattcattggtaatttcaaggttctactttgctttctttttgccttcagctccttgcaaaggacacctttttttttttttttttttttgagatggagtattgctcttgttgcccaaattggagtgtaatggcccttaacatccgcctcctgggttcaaatgattctcctgcctcagcctcctaagaagctgggattacaggcatacatcaccacgcctggctaattttgtatttttagtagagatggggtttctctatgttggtcaggctggtcttgaactcctgaccccaggtgatttgcctgcctcagcatcccccgcccaaagtgctgggattacaggtaggagccaccacacctggccaaggacagccttttatagttcagtttctcagtttatctttgactattcttaattaagcttgacctggttctccaccactgacgctattggagttgcaaagcattttgctgttataatgatagctcccttgatggctgttcattattaactggttttcaaaagtgctgcttttaactttcattttataaatatttaactcaatttttataaaatgtgcatagactatagaggttctgcttacctgtttaatacagtaaaaaaatcccttttgtaatcttatataatattaagaatgtgtccttaattcatgcttaacataaattcttacacaactagcagtatctcaaaaaataaatgatttaatagtttatgacccttatacatataattaattgtagtaaaatatcttagaaaatagaatgagtattttttataaagataaaaaatcctgatttttttttctggtcttaatataaaattaaatgtgttaaagggaacttataaattacatagtagttcattgctcaggaaaagaaatgacaaagtaattaagagtgtaaaattaaaaggattaatttttcttaaaggccgatgagttaacaacacgcatcaatctctcttccttctccaaacttcagacaaatgatggcaaagtaatttttaagaagtcaatttatagaggcaaaaaacctgaagtacagagagtaggaaagacagtaatagaattgagagcagttgacatccataacattcctattattacctccattttctggataagaatatggagaagaggaatcgttaagcaatttgctgattgtcacatattcagtaagtggcaaagttagtattgaaacccaagtagtcttgttttaaagtcatacactcaatcactgtgccataattcaataaattgtgaaggatgggaagcagatggagaagtgattgatgaagcaggactgagaaagtgctgcctatgtgcccacagtgtgaagaccctacaagacatcagaacatcatccagtgaagctgtgagcagctcaccacttggaaaaactgagtgttttggaaggcagggataaagtgcagttctgaaaagagaaaaatccatcaagttctaaacggtcgcgctctcttaccccacagtgggcaatggtctctccattcatcattttcttttccctgagtcccttgaatcttaaatatactattctgtgaattaaacatggtaaacattagactttgaccagcgctattatcagaagttcacatacctaatcaaaggacctgtaaccttcttcccctccttagtttctacaccaccagtagccaattatactatcccagctcccatcctaaaatccccttctaaaatagaaggcaaaagatcatcagtcatttgagcaaaatttcagcatgacagcatgagtagttgagacctatagtaacaactaaaatggactgggataaaacaaataatgtttggaatcaaagaacaggaaaaatacaaccgatattggagcaagaaaaaataaaaaagaatatgaaaaatagataagaaatagctattggaaaggtacaagaaatacaattttaaaaccagtggaacataagacaaaccacaaaatgagaaaattctattaataaaaggtcgggggtcggggaactgtattctttttttttttttttttttttttaagacagagtttcgttcttgttgcccaggctggagttgcaatggcgcaatctcggctcactgggcaacctccaccttctgggtttaagctattctcctgcctcagcctcccaaatagctgggattacaggcatgcgccaccacgcctggctaatttttgtatttttagtagagattgggtttcaccatgttgatcaggctggatggtcttgaacccctgacctcgggtgatcccaaagtgcagggattatgggtgtgagccaccgtgcccggccactgtatcttttaaaaatgtaattgtcatggaaggcaagaaaggtttaggaggctttccatattgaagaggactgaggagacatggcaactaattgcaatacatgattctagactgcatgcaatactggaggaaaatcatgctataaagaattgactcaattgataaaatcagaatactagcagtagattacatcaaagtatcgtatcaatgttacatttactgaatctgactaccatactatagttaagtaagagaatattcctatttttaggaaatacagaagtgtttagaggtaaagggtcatgatatatacaacttaacaaaagacttagacaaatatggggtatttaaataaaggagaatgacgtgcaatctgagaacaagaagtccaacagagaaaagcaaaaatagggagtcagcgagcaaccagtgagatgggagcagaaggatggaagggtggaggagtgacatctaaacatattaagaactcaaatatgttgattattttgtatatctgaagtttgaaattatcactgacaatcttctaaacttcaggaaaaatgaggatactgtgctacaaatgtaaacttaagaacaatatttacatagtcatcataatgtaattatgaaatactgatttcaccaaaaccaatttgatttaacacatcgagagaacagtgggaatagagtcctgtaattggtgcacctgtcctaattcctatgtaggtattataatagaaagttaataggtaatgtttaaaattgataaatcaagataacaatatcagcatgttaggttaaaaacaaggtaattaccaaaagcaccagataaaagagccaaacattgctttctctattgaacgggactacagcatagagaagtgttaagcaagctgccattattcttttgctcttattataagcctcttaatactatttgattactagctcatgagctcctatttataaaaataaaagcaaattttcgaagtcagaacaattcatgctgctacaaaatccctaaagtcatttcaacaatacagcacactgatgattatatagacatttttcttgtctgagttctttgtctagaaactttttaaaagaaacgtggtcctgtattacatgtagcatgctttggaagaaaaactatctccaatcaaaaagtttttaaaagagcccagatgttatcgtcctttgtatctctaaaagcaattgcttttataaaattaggatctactcttttttgaaatttgaatgctgaagttttgtgggtttcagcaaaagataggcataacatacatctctacattttattaaatatgatggtgcagatgttaaaaatatgtttgaaatgcagtaccttctgttcttgctttcaactcctaccctagagtaaatgaaatgctaatcacctcttgtgttagtgatagaatttgtgagtttccacagataaaatatgtttactgtaatttccaaatagttgatagccagtagcaatatcttgacttcagcaactggtatgtaagggtctatattaaagtgtttatattatgactagtataacagatggtattatttgttacagcaggtcataacactaaaaaataaaactattacacatctacaatttgatcacaaattttagtggcagtgatcacttattttatgaaagagaggcagtaattgccgaagtactgcctaaaaatgtaagacaattctcattacagggtaaggtaaaattattgacttattaaccagaaattcacatctatcccgctacaggaaaaaaagtgtacatttaatatctactacagtcagttgagttttcaaagtaatctgtcatctctaccatgaatatggggaacaggagaataactgctggatttttggcatttgacacctaatatatagaactttaaaggaggttatctattatataaataatctttgaagaagagcaatttatgtttttggacaaccaaaaaattacttgtttagcttcacaggaattttaaagcatgttttcacttattattaaacagtaacattgaatatactgctcttttatcagttctcatttttttcaacattcagtagatgactttaaagaactctcaccttcctggttttctttctaaactgagattatttcttctctcacttatgcacctattttctaatggccatgtctcaaaaaatttttattctagcgtcttttttccttttatcttggttttgctgtagtgctagatagatggttacttgtgagactttcaaatctatataccaggctccaacttctctccctctccctctctttttgagtaagggtttggctccatcacccaggctggaaggtcatggctgattgcagctttggactcctgggctcaagggatcctcccacctcagcttcctgattagctgggactccaggtgtacagcatcatgactagcaattccattgtttttagaaatggggtcttgctctgtcgaccaggctggtctagaactcccagcctcaagcaatcctcctgcctcagcctcctaacgtgctaagattacaggcgtgagccaccacacctggccaacttctaagtttcagtgctgtagttttaaattgtttctcatacttatctaatattttttcccaccatgtcaaacccttaaaaactcagtatggacaaaataaatattaacttttttgagattgataattgtatgatagtgcttattacctcaaaagaattactggggcagcagtataatccagtagatgggggaaatagtggatattaagaccgaaatgggatcataactttttagttgtatttgcccacattaattgttttaaagggggtaaaggcctggaatatgaaaacaggaggatataaaatatatggaggttgtgaaagatgactcagaacttgaaacaattgtttcactgcagtaaatacatgttgaatgcatagaacagagaaaaacagaagaaaagaagaaggaaaaacaaactccatgatttaaaatattgatgaatgtgacaataattgtatctttaaaataactgagaaatggtagaaataaaaattataagcttcaactgtatattacttattcttgacaaagatgatagttgcaagctgaagccaaaatttctaactaggactaatgcaaagatttcaagagaaactttaataaagaattattgatgcaagcgctttcagaaagcaaaggtagggactaaccattagctcttgtttagaaagataaaggtcacaaataaaatttgtgttttaatctatacattttcagcattatgtcatcataaatttgcatgttgtttattacaaatgggaaaaggtttcctgtaatatatcaagatgagttttaatagtttcaaggaccattgatttgtaaacttaagactattatagtgttgtggaaaattaaatataattggtgttttaggaaaagttgttcattgaagtttccattttatgtgccttaacagattaattttgcttattaattctgtgatatttaagcactgctgtaagcttcacagatttggcaatagccactatatacttaatgagtacaaactatggagtatttccatattaaggtagaagaaatatttaaaagcacttctacttgtgatgtcattgggggtgcaacacaatataaagtacgcacattgctggaggagaagcataaaataaagaactcacggggcagaaacttaagacacacctaaatcaaatctttgttttcagcattatctttcattactattctttgttacaaaaaaacattgctatctgtccttttctatatgttctctacattaaaacttattatttgtatacatactgttccctacatctgcagtgccattcccagctcacatatctgccctcttaaatttatatcaaattcaactcccttcaaaaagccttctcagttgctttaacccaagccagtagtctgtcttctagaaaacagttgatgccgatgcctccttttcctttagcaactgaaaataatattatagttatttaatgtgtgtgtgtgtgtgtgtgtgtgcataacatcatactatttagtagtatctatatctatcaagtatctgctacagtggatgatagatgacttaaagacagaaatatgttattcatatctacttctcacaggtctagtgctgttgcaggatattttttaaggaatcagagagactgatggggttcaggaggatatttattatttaggtgcaccagcccagtcggattaacatccaaaggactgagccctgaacaaagagttaagttaccttttaagcattttgtagggtgggaggagatctgtgcagggggaagcatgttagagaagtgagaaacaaagacagttattcaattaattgagaaatgcgttacatcatttcttacttttcaaggaaaaacatgttttgcgacttttgtttatgtgtctagtgactttgcagctgcccagctagggaatcagggtcttcacaatgcctgggaatggaggggagagaaagctcattagccacagaaaaataggccgttagttttttaaaggactctagctctttctctttctcagggggaattggattttcttacatacaactgaggttctgcttacacattctttaatttcttttaattcctgttccagtgcagtgcaatgttcatagtagatgcttaatattttttgaattattgtatctttagtcattgcgagccatcattttgagagtcagtctcattcttttagccctagattatttttattttcttgagatacgtgaataaagggcacaggaaaaaaacacagttgagagttttggataatagtaacctaattcacccagattttacttcatattggttggaactctaagttgggtgcaactaacatgagacttgttttgatttattgtaaacatattcttgaatgactaatgaacagtgcttcatgtgaacaaattttcaccttctgataatttccaatattacactttgaaaaacattcccattgtagtgctctagaaaatataatttcaattgttaaaattcaatattactgtaattgaggatattaaataacttgttgttacatgatgctagctgcagcttaaatttcagatcatgagtgttgttaatattatatagttggaattagttctgagatcaatgaatcaatgctgtcttactgttttgtctttaatttttataccacatttattttgtgagtggatttcataaaaggaagttgctttatgttgccaagctcattatcttgggtttttgtccagagctgaattccctttttcatcaaaggacagagagagcccattataaactattgagtaatgctgatttgatgggtaggccacttacctttaagtggaaaggaggccaggcgcggtggctcacgcctgtaatcccagcactttgggatgctgaggagggcggatcatgaggtcaggagatcgagaccagtctggccaacttggagaaaccctgtctctactaaaaatacaaaaattagccgggcgtggtggcgggtgcctgtagtcccagctactcgggaggccgaggcaggagaatggcgtgaacctgggaggcggagcttgcaatgagtcaagatcacaccgctgaactccagcctgggtgacagagcgagactccttctcaaaaaaaaattacacaaaaatgttagactaataaatattaataaacactaaaggaagaaatttagtggaacatttatcagaggcaacagaccaggaagttatagttaccctgtgaaaaggcatcatctaggattcatagaaaacatttgcaaattggcaacaaccaccaccacaacaaactaaaacaaatgaaagaaatagacatttatacagggaaaatataaatagataataagtgtaataaattttgtgactttccacttgaaaacaaagaaatggaaataaaacctatgtaaagaagtggtggagtgagccgagctggggtgggaggggtgggggcatcccaggcagagggaacagcagatgcaaaggtctggaggctggagcaggctgtgaggggtgagagcagcaagtacatgaagtctagaccacaaatcgatgcttcaccctcaaaaatagcctctcactggccaccactcaggcccagatacatgtgtaaggtgggcagccttcaggaaaagtgaccgcaaaagtgcaccacattgggaattctgaggtgtttgagaaagttatggatgaagggtgaggtagactctagtggggaatgtcctcttgccacttggacttctctgtctatttcatgggctattatcaacttctaaagagccagtggtttgggtgcacatttaggtgtaagtacctcttgcctcaagccttaactctctttccaatgagtcaagtgagctgttgtgtttaagtaacttctctttattgtgaaatctttcctatcactttaagaaccttcttcttcagacccaagtaatcccaaggcacctataatgtccctcctggagaagacaaaagggtgtcttctatttctgtgtggcccgatatttcagggcccctaaccaggttagttcaaggtgctcagcataaccatgaatctgctacccatgtttctcaggtgggtcataggccctggagggattgtggctgtggaccaagcagggggtgctgtgggctgttctgagaaggagggttttggagtgtccaagctgagaacatagaggccccagatgttgtatgagtaaattttcatctgacagaattatattttcctaactgaaaacatgaaacagagatgtaacaactgtgcctctttggctctgtctttgcatgctgtcatcagccactgaacaggagctgagagggaagacataaagaacagaaaacccatgagggggatggtccatgtgggtgtggaagtgagggtgagtggggatttggccaaagaggcctaatccacaggagtagagtctcatgtgtgactttcagaatgagcaggagtgagataggtggagggggagtgttggaacatctcatcagaggtgagaatccatagaaggagacactggtcattacagtcagtgagaaaagtgactttagcctgagcctaaggtcattggatcaaggaaggggccaggaggagctccttgaagggaagctgtgagcttgagaggcaggctgaggcagatcagtagaatgagcccccgagaagggctcacagagtcactgaaggactgtgaggtggcagggacaagctcacatggcctttggtcagtgagtctccagctgtaatgagaatgaaatggggaagatctgggacaggaagacaagctgggggcgctggtaccatcatggggagatgatggtgggtggctctaggttagttagagttggaatgaagagcagaaagcagcttcgtgatacctttatgtcataaaatacatttggcatggagaggacttggactttgtgcatgaaggatatggatgtttctaggctgactcccaaatgtttctaggctgactcccagaaactaggatgtttctaggctgttcctggctgagaatttggatggtaactatagtccaaagaaacaaagaacactgaaatcatatcttattttttttaactcacaaaatagaggcaggtagatatttatatgtgttttgttggctcaatgattttttttagtaataaacatatttacttagaaactactgggtgtctgtatgctctgggatttttttctcctgtcctgatgacatctctttcctttctctgggttcaggagttacttcccaggttgtggtgacacaggaacattcactttccacaactcctggaggggcagtcaccttcacctatggctccaaaattggggctgtcatcagagcatctcgacagctgggcccaacagaacatctggcaatgtccccagggcaatggtgggcacaagcagtcaggtcctgggacccctgcacaatcccctggttctcttcatgaagaaaaagccactctggttataatgaggactagaccaagaatgaggcccagtgttacatgctcggtgtggtgatctgaaatatcaccacagggacaaatacaaaaatacaagtgggaaactacactcaaacccttggatcaagcctcagtcctatgcttctgaagcaaatttcttgtttttggagtctggttttcaaccactgtagactcagatcatttattcttcaggcccccaatgggatcatcacaagcactttttctatcaatcatggcagtcacttgagatcaaaggtgaatttcttcttcctcaagttataagcaacactttggcatatttggtgaacttcaaagaaaatggctaagatagaggatgagagacataagaggcttcaggaatatttcagcagatgcaaagcagactacagggtaactcatttcccatatgatttgattgattgcaaaatgtgaaattaaatgcatacaaaggggaatgtgtgtcatttttcctcttaatgacaaagtaaaaaaaaagcaataaaacaaaaacaagcactatttcatgtgtcttgataaacttgtagaaagtcttataatatccacaatatctaggatacagtaaaataactttccatatgaagaaccagaagaacacaacttaaatgagaaaagacaattgatagacaccaatactgaaataatttaggtgctgatgttatgtaactgagattaattaaggagtaattatacaattccttcagtgagcaattttagacattattttttgaagttttaggttcaggggttcatgtgcaggtatgttacgtaggtaaacttgtgtcagaggggacattcttgaaacaagtggaaaagaagcaaatcccgaaaagaaaaataagtcatagaaacaaaccaaattaaaattagaaaacagaaaaatgcaataaattaaaaagaacagtctggagggactctggaacaggtaacagtgaaattaaagttcaggcattagaggaattatttaccgttaagtagggaagaaagtacaaacaatagccatctaagcccagcagagggagctgtggatcttctcagaggtgagcaaggccggaaatgaactcccggggctctcatttatggctcctgggtccatactcactggcccgaattggggtttagagcaggtgctttctcccaaagggcaaactcagagttcccagcagcccatcctccctgacagagcggctgctgcctggctgagcactcagaacttagggagccggtggttttggtagaggccccatgtttgcataatgtcctaaccaaacacacatctacccggggaggtgacgaggagttagaggaactgtcccagggtccagaagtagccgggggttctggggatccttggaaagtccacaccatagcttggatgtctatcctcccctctctccctcctcactgcccaggttcatgtagatttcaaagacaggactttggagggatctgtctgctgtgattcctcacacataacatgtatctgttttagtttcttggttcagttctcaggctgtggtgactcaggagccctcactgactgtgtcctaaagagagagacttattctcatgtgtggcttcagcaccacagcactgaattcagcagaagcctggtcaagtcctcaggacattgatgtgtaacacagataacaaacacccctggatgcccacttgattctctggctccctcctgggggaaagctgccctgacccctcaaggggcccagcctgaggatgaggctgagtatactgtgggctacaccacagtggtccttagcacagtgagagacccagatggggaagcaggacatgaacgagcttttggctgatccggggtacaaacatgaacgtaggatatcaggatcacgtggccagacacctgagctctcaaggacacctaaattttaactatccgtagagagaaaggtgggtggagaggtgtaaattgattcctgtatctgtttgaattttaaagtggaaaatatttgtgaatcatttgggagatgcagattcccaaaaagaagaatttatgtttatattccaaacagaacagtaatagtgagatcaactctaaagactaaggtcaaacacacttcatccagaaagatggatctcaaaagattttgttgttgttttgcctattaaaagctaagagaggaaattatattaataaagtttatttcatgttctatgttaatagtgtgtatttcatagctttttaagcattaaaaattataaaagtgttaagagggattctcttctctaatgttatataagaaagtatccacctaggaaaatattttgaaggtctaacccccagtacttctaaatgtgaccttatttttaaaatagtgttattgcttatgtaattcttaggatgaagccatcctagagcgaggtggcctcttgatccaatgtgcctggtgtccttataagatgatggtagtaaggagattggaagacacagagagaatgccgtgtgacgacgaaggcagagattgaatttacacagctgcaagataaggagcactaaagattgctggcaaaccaccagcagccagaaagagggaaggaaggatctcccctcaggtatatatggaaacattgccctttctatgaattttgggaggctagcctccagaactgtgagacaatacatttgtgttatcttaaccaaacttgtgtttaatacattctgacagcagttctaggaaaccaatacaccagacaataaattacacaatacttctgaaattgattgtacttctttcattttggcaaccagtttttccatgaatatgattatatctgtgctcatatttctaactttataaatatgcttgtaatttaaggttaagataagaaatccttgtgtcttaaaaatccctaaatatatgagaactgaataataatattaacattatgagatctaatggaaaattgtagcttttacataattccacttgttcactagtatcaagatgtgaaggtgggaagatcaccttgttattaacaaaacactcctggtcatctctgtggatttgagagtgcagggggagacacctacatattgtttgggaagtcacaaatgcagcatgcccagagcatcatgtacaacagtgtgagtttgctggacatgtgggcaggaagcagaacagactggggcatgaggaaccacctatcaccaaacccaccagcgccttcctccctggatcagcccagagctgctcagacttgaatgtgcacatggatcatgtgggatcctggataatgtggattctgatcagtgggtctggactgtggactgaaattctgcgtttctagaaggccccttcttccaaagatccacatacatgttttaatattaccatattcataagaatggtgggaaataagggaagccactttcagacagaaaccaaatagaaatttatctgagagggagctaaaggattatgatcaaagagaaatccccaattccaggcagggagctgatcacagagggcagatgggaagttgggagaggttctatttttttttttttaagaaatagaaatgaatgcaaacacaactcaaacctcctcttgatccaacatccctgctggctcctgcccaatttctgcactggcttcttctccagtcttttcccaagcatggaccctcctcaccctctctgcttccccatctcaaactcacaacttcccttctcagttctcctgtttctctccctttcattccacttccttcttctctgtgacctccttagacaatcaccaaaatatttctagaagaaaagccatgggtatttttcatcttttcttgaaagttgtcactcacattccctcttcgttcttcagcctctcttaccccttactacaaaagatgcctgaggccactgtttctcttttccatcccctcaaatagcttctccttccaacccgtttctctcctcagttactagagcattcagtgaagcactcagtcaggttaaaggatcctcccaaatgctcaccctgctctctatgtgtgatctcctgaagaatcaagtagggagagaaacatggcttcatgagtttgtggggaagtgggtgcatggctgaactgtccttgttctcagcaaatgtactttatttcatgcacagtttgtatatgagacaaccttctcctgcggactccttataaaatgggaagaattatgtgttgtgttttcacagaggaagcccaaatattccatgctcatgggtaggaagaatcaatatcatgaaaatggccatactgcccaaggtaatttatagattcaatgccatccccatcaagctaccaatgactttcttcacagaattggaaaaaactattttaaagttcatatggaaccaaaaaagagcccgcatcgccaagtcaatcctaagccaaaagaacaaagctggaggcatcacactacctgacttcaaactatactacaaggctacagtaaccaaaacagtatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctaagaagaaaacctaggcattaccattcaggacataggcatgggcaaggacttcacgtctaaaacaccaaaagcaatggcaacaaaagccaaaattgacaaatgggatctgattaaactaaagagcttctgcacagcaaaagaaactaccatcagagtgaacaggcaacctacaaaatgggagaaaattttcacaacctactcatctgacaaaggggctaatatccagaatctacaatgaactcaaacaaatttacaagaaaaaaacaaaaaaccccatcaaaaagtgggcgaaggacatgaacagacacttctcagaagaaggcatttatgcagccaaaaaacatacgaaaaaatgctcaccatcactggccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaaccattgtggaagtcagtgtggcgattcttcagggagctagaactagaaataccatttgacccagccattccattactgggtatatacccaaaggactataaatcatgctgctataaagacacatgcacacgtatgtttattgtggcactattcacaatagcaaagacttggaaccaacccaaatgtccaacaatgatagactggattaagaaaacgtggcacatatacaccatggaatactatgcagccataaaaaaggatgagttcatgtcctttgtagggacatggatgaaattggaaattatcattctcagtaaactattgcaagaacaaaaaaccaaacaccgcatattctcactcataggtgggaattgaacaatgagaaaacatggacacaggaaggggaacatcacactctggggactgttgtgtggtggggggaggggggagggatagcattgggagatatacctaatgctagatgatgagttagcgggtgcagcacactagcatggcacatgtatacatatgtaactaacctgcacattgtgcacatgtaccctaaaacttaaagtataataataattaaaaaaaaaaaaagagagttaaaggctgagatgaggtaggaggctgccctgaggaagggtctcatcctctggcatctggtcacagacacgatgggcctgggcctgggctgcagagagcacaatggggctgctggtgggggctctgtgcggctctcagctgggaaataaagtccatgaactttgttttgcctcacggctcactggggccagcagctgggtcctctctgggtgcttggggagcttcaggccaagctcagcccaggctgactcctcctagtagtgtcacccagccacagaggctgtacacaggcccagggagagttaggttaagcaggggaagaggagcacatttgcatgaagggcccctccctctcctttgaggctagagggtggataagagagacctgcagcgtggctgcctcagcagagctctggggagtctgcaccatggcctggaccccactcctcctcctcttccctctcctcctccactgcacaggtcaggaggaccctcagcatcctcatgccccagctcactgacaccatctcccaaactcataccagaaatgttgtttgctcttgtccttccttcaggccataatgagcgtctctgttttcagggtctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactcacacagtgatacaggcagatgaggaagtgggacaaaatcctcaacctgctgaggctattgttcagtgacaatttttaattttaaaacattttctgtatgtaaaaaatctatctggatgcatcctctgatttagaacaattttactcacaatttcccatttaatgtttcagaagtctcagaagaaattaaaacataaacaagaacataagcctcctgatgacactgagatgtctgcttatccttatgggctgataccaaagtctgtgaagctcaccttttctcttgaaagaaaaaaagaatgagccttcccttgagcaaatcttgctcagagcccaaacttcaagcccacaaatggacagtcccctgcagcatgggctcttgttcttcaaggggtcaatgaggagacctccctttcccaccccaggtgtctgtagtcagggctgcctgatgttccctgcatcctgggactaggcactcaggtgtgtaataccccagaggacaggcctgggagtaattccaaacacagagctggcctgattcactttcaggttcctttattttaagttaaaatgtcaggatagaaagaagttgggtatggggttattcatgaaactgaggccagaagatgtctttgtgggctgtgagagggtgacatggtggctccaccattgctaggggaatgttgagtgagctcctaagaagtttggggaaatcggtcttgtgagtgtggcttcccttcagctcattccactcagaaacatgaggacacccatgggtggatttttctgaactcacaaacactgacttgtgtcctcttttttcttatcccattggagatattcagtaatctactctgtgagatggggtctacaggagatcatggagaagaaactcttcaacctgtgcaagtgaaacttccttgtgtgaagctcttgatgtgtccagattccaaggtcaccttctcctgcacaggggtcagcagaaacattgaatattaccatggaaactggcccaatggctccagagaaatcctgaatttgtgactgagaactgcagtaatcaaccttcagggatctcagcctgattctcctttttcaacttgactttccttgactgtgcagcccgagggtcaggatgactatcactgtcagagctgaatacaacccgatgctgccatgagctcccattccatggggaagtgacataaacatctgtcctccatttcccccatcaaatccgtcactgccctgtccctgcctgtgaccgacacctgctcaggttgtggattctgctgtcacttgtgattccagcaagtctgatgcttttaacttggtgcatcattattagggaagccactccctctaaatcctcagaagatgcccccaaggagttcccggatcccaaggtgcaggatcaacctcccagtaaggaaggctctctgggccccatcactgttcatctgttctactttaatcctaagaaccttgagccttcattatttcccctttctgcttatttggctggaacgttgctggaatgcatctcagttctttggggactagagggataaaaagcacagcccatagaaagctttcacctggttaagtagcatttcctaagagccacgagggcatctgctcactgctcactgctcatccttgcatcataatgggttcctggaccctgggctctcctggctcattgagtttaccaatccctccacactccactcattgctagggctggctagagggaaggatagtaattgtccaatagggagatagttttaggggggattacagaaactactccccataatctttgttgataacatcttcatcttgatgtttgctccccaggatctgattgtgacagtggaagtctgacacttgaagaaatgtaggtttacccttctgaaaggcctggccctggcttggcctagggctggaaggaagaggtgctgagctttgggcaaccaaggcacagctgtcaaggggctgagctctctgcaatgtgggcctcctgcagagacatccctagggaggctgagacctgacgatgatgcagaaaagcaaattgaagtgagcaggggatggtctgtgggggaatcagatgacaggtggggggccagatgtgatacagatggtgcaacatgaagaaaagtgtcttttgtgattgttctgaggagaagggctcagtgctagagcagtgataatgaggcaggagctgggtcctgaagccacaggggaaccaggtcttgggtctttttctgagggtccctagggaagatcacatgacaaccaagtcccatgttatatgtccagtgctcggtatcccagatgctgtccctcccagagcctctgggtgtcctcgtcccactcttccctgtgatctgttttcagctccaggagcaggttcatactctgtgccaagagtggggcttgcatggctgagtggagaacagatttgcaagaagatcccaccttgcagtctggctctgtgtcctgggtgtgggtggtaactgaggagatgtaggcatttgggctccactagagaccacagggagcagagctcacaggggctccccacaacccgggctcctcccttcatcctcctcccattgccttcctcactggggttcgggccaggggagaacccagggctgcttcaagggccctgctctgcaaccatggtctttatccaagtcattgtctccaaactctgtaagggctttctctgaaactgtaggagcattttttttccatatgcccaaggcaggcttacagggtgctgaccccaccccttaaaagtgctaatagtctctcaatgctcaagacaggagggagaattaggaatcaggagcctacccagagcttccctctttcctcactttcaaaattgcactgtgtctagacatagaatttatgcctgggttgggaaatatttatttacttattaatgtattcattcattaatctcactttctgcaatctgtgtaagtgaggggcagaagggaagaggggcacagagggagaggttgaacccaagggcaggtcctggcagtctgggcacaggctctgatcagccagggggaaggaagagggagcagctcctggtgccctggagggaggggatgccctgtccctgctgggcctcccacttcgttgtacccagggaatgcttttcagagaggcagagctcttagcagagtcccgtaaaccatacagtgagttgggcaggtgagtccaggggtaggggctgtgtggagacctgagaccaggtgtggcctggcatggacactgcccagctccattcttttagggaggacaaagtggacagaggaagagacaggagacatgggtgtgtctgagctttgggcagcaggggatgctgtggcctagccctgagggctgtgctgtggatcccagctgggagccaccccctggtcctggcctggagccctctgtcccctgctcactgggactagcagctgtgtcctcacaggtccctgagtacccacagaatagccacacccaggtccacactctcccggggttagctttccaggcagaggtcaagagtcagaacccaaggtggggtttagacagcccaggagaggaggctggtttgcaagtccctcctaacccccttcgccctgaactgctggaaggataggagagacttgaagaatccaggcccacctgagggtcctcaggacacagctgtgtggcgggtccccaccatggcctgggctcgtggcctctttccttttctccttcactgctcagctggctggggccaggcgtcagggctgaggatgaagggaccaggattgctgtgtgtgtccctgtccactaacctgtgtctcttactctttgtctgtcatgatattcagggtcctgggcctgttctgtgctgactcagccaactgcagtgtccaggtctgtgggacagatgaccccagcacctgcactgggagcagcaccaatgatgggagtatgcacgtgttttggtaccagcagtctccaggctgtggtgcctcagaaaccctcctagtcaacaacaccctgcccagcaggagcgggccatgctctgattgcccatctggggtagtgtcagtggggctcagtgagcagctgagctttcaccccaatatcctcaaccaggcgagcatggcagggctagtttgagctggtttatcctcccatccacctatgcctgattttggcagggcccagtcaggaactgaatttcagcccccatccccagcaatgagttgaatgaaatggtacaaggcagagcacaccagccctcagtattccctccctgaacccagactctggtggttatgggggccagggaggaccagagctttgtctcccacctggcaatgagaatactggttggggatggaagtcagtgtcgttggcacacctgctgtccccctccctgccctggtgtcagtgagtcctctttttctcatgaaagtgtcagcagcactggagtactgagagccagcgttctgcctttgctttggcagtgggaagctgaacctacaaacctgtgtccttcaacaactcaacaagaagatcacctgataaaagggagattagtggtgcctagaggctcaaaatacagtatttaaggtgtctagcattcagttcatgaaatcattgtcacatcaagaattaggacattcagaacccaaatgaaagaagacagtgacacgcatggacactgaagcaaactcagatgctaaaatcatatgacggatttttaaagcaacaaccacaaaatcccttcaatgaataattaaaaacactcttgaaacaaatggaaaagaagaaaatctcagaaaagagaagttataaaatcaaaccaactggaaattaaagaacctaataaactagagcacatttaaaaagaaagttaaggcaggactcaagaactggttacatttgagattcagtcactgggtgaggtgttccacacgacataaaaatacagtaaaaataagtaggtaaacacatgaaaatcaatgattctggtttgacttgggaaacattaaagtggaaaatataaagaataaaatagcatttatttattgaaagaaagaactacctttagctttttatcgtttccccattaatactctcttgaagatgttcccaggggacactgtgagtcttctcagaggtgagaaaagcctgaaataaactcccacgaatctcatttaatgggtcctggggcccatgctcactggtctgagttagaggtgatagcaggtgcttcctctcaagtggtgaaattagacctcacagcagcccagcccccctgacagtagagctgctctctcagctgaaaacaacagaagcagatggtgttggtgatggttttggtaaagtgcttattaatgtgtgaaccaaatatatgcccttcatctagggagctgcataggagataaaagaaccatctcagggtccagcagcatcttagagctctgcagatttttggaaagtttacatcatgccctggatgcttctcctccacttccccatcctgttcagtctttgcccaggttcatggagatttcaaagaccagcccatggagagagccctctgttcttccccattcctgtcgtgtctgtttcggtttcagtatccagttcttagggtgtggtgactgaggagccctcactgactctttcctgaggagggacagtcactctcacctgtggctccagcaccagagtggtcaccaacaatttctatccacactggatgcaacagaagtctggccaactttttgagacattgatttatgatgcaagcaacaaacattcctgaatgaccacctgattctcagaccttcctgggagcaaagctgccctgagcctctgggggacccaatccataggctagactgagtactactcaagctacacgacagtgggggttactgcagtgaaagatccagatggggagccaagacgtaaccctgcctctgacagcctggggagaaaatgatcacgtgatatcaggatcacatgaccagaaacctgagctctcaaggcggtctaaatgttgcctatccttaaagaaaaaggtaaacagaagggtctacatcaatatttattcctgtttgtgtccaaaagttgaggaaatccatcaatgaggaggaactgttccagaaaagcggattcctaatattttgtaatccaaaaggaatagtattgcctacatcagatccaaggaataaatttaaatatatttttttgcaggaggaataatcttcaacgatgtactttgccagctaagaacgaaaggaagaaacgttctttggtatattaataacattttttattaggttgtaattaaggtgtattgcacaatttaaaacatattaaaatgattttttgtaagaaattcttttttctatatgttatgtgttgtattggactctaaagaatatatgttaaagccctacaccccagtattcaagcacataaaatcatttgaaaatcggatcattgaagatataatagttaagatgaggtcattctggagtagggaggtctctttatcagtgttcctgggtccttgtaggaagtcaaccatgagaagacagagaggcacagggagaaagtcatgttaatatggaggcatggagtgaagttactcagctacaatacaaggaacaccaaagattactagcaaagaggaagagctgccaggaagaatcccaggaaggttttctctacaggtgtcagagggaacatggccccgccctatggatttggatttctagcttccagaactgtgaaacaataaatgcctttcattttaaatcacatgtgtagggttatttttatggcagctcaaggaaattattacaccaaacagtcattgtaactatttctgagtttgcatgcattctctcatcttgtttctcagttttttcaacaaatgtgaccatgtctgtcttcgtatttcttccttgtataactggcattgaaggttgacgtaagttattctcgctgtcacaaaaattatataaacatgtaaataaggcttaattttattttgttcgtaggtacaaatgcaaaactaattccaattgttttgtaagaaatttttgtaaatatttttctcatgtaaattagaagggtctcttgagttactgaaacacttctggccatttctgtgatcttgtggtgtcaggatgagatggctaccatgttcaatgaaagcttcaaatacattattattttttctaggtttttaaaatttaatacagtctaattaaatagtaacagcagtaactaaatgcactgaaaaacagacaggtgcctgcctatatctggaataaaattacatcaaactagtctccatggtaaaaaaaaaaaaaaaaaaagacaactgctgatatccatggttagacaagtcaaggacaacttggaatttctaaagccatttttctaaaaatcaacagcaacagggacacaactacttcaaggggtaaaatatctatatctacattgttttttattaacgaagattgagttgcacctaaacagcatggcattcttatctttagccttaaaggaaaagtgaaagtattttccatttgcaccagtttgaaatatttctgaaataaggattacttcaaatgaattattacattacttatacacataagagggtctcacatatagtgaaaaggcaaacccaggattttaacgtcaaccttttaaagttgatttgattgcataaaatgagagagaaattctcacacgcataatctgtttaacaaaactcctcggtgaatcaggatgcaaaatataaaatgttctaagggagactctgatgagcaggcatataaaattgaagtgaaacccatgtcagcttcgttcctcccacttctttggtgcttctatgaggagctctttctctactgcaagagcctggacttttgacctaatggagaagaacctcaggaaggcaaggcattctgataaaatgccccttgagaccttttattttttaatttaaagggatcaactggtcttgttcagccttaggaaagaaagcatcactcagataaaagtatttggggaaactttaaatacctggctacctcttgatatatttaaattagattgacttcagctgttcttagaaagcattctgcatagttatccagagcagccactgaagttctggttctccttacatggctgcattcagaggtactccacatgaggcatgtttagaaaaagaaggacccttatacttgggagtttttgttcttccacgtaacctgttagtactgttggtaaaggcagtccccagatggcaccagtgcattttgtcaatggtgagtctagacagtgttgcaggggtgttgctgatgagtagaacagtgagcagataaaggtgagcagtgttgatctaaaggctttggggtccatctgcttatccttgcacacctgaacaaagtcatcagatgtgccacaccatcaaactgttgaagcttggacttgatacatgatagagttccatgccaattgcccatcttcatattcaacttgcagattagttggtccagctgatattttaacagatactgttagtagatcatctgaatgtgaactatctctaaccaagaaatttccttctggtgtctcttttaacttttctttggcttcattaacaatcatccttccccagtgccatcctgtttgagctcctacggggacttcaccagatgcaccacctccagggaaggttcctgtgctgaccctgctcctcactggctctgcatctattccctgccattcccagagggctggagacaccacagggtcatggaagtaaggtcactgaggcaaagacagatggccacccaaactgggtgagaaaggagctttcatttttcctggaagtcagtgggaacccccccaatcaaccctatgggtttctgaaatggtggaagatggggaaggaatgaaaagctgcctgtttttctcaacaggtccaggttgagggatgacaaagttccttgcagatgcatcacccacagatcaccagcaggaggatcctgaggctgcggtcagtgccctggcacaggacacatgggccatgtcccatgcagcaccggtggctccgagtgagagggcttatgctgcaggggaagccaaagattcctgagccacagcggtaagacatgagatgacttaaatatctgtccctcaagtatattattcttaatatttaatgcacaaaatagtgaaagaagagattagcttgcagtgcaaattgaacagattcagtatagcttgaggcatgagaaacaacagctctattaccatttaccaaaaatacaccctgaatggacagggggtgcccgtgagctggagatagggtgccccaattgaggaaatataaatactggttatcagttaaatttgaattcatgtaaacaaccatttaatagatttttatttttagtataattatgtcctatgcaaagttacttatctttaattctaatgtaactggatgtcttgcatcttgtgagataccattcccagcattcccagctgggctctgacatctgagtctatgctatttacctcaaaaacagagttcctgtaacaaagttatccccaagtaagtacttcggttagaaataaatatgtctgggctgggcacagtggctcatgcctgtaatcccagcactttggtaggccaaggcaggcagattacttgaggtcaggagttcaaaaccagcctggccaacatgatgaaaccctgtctctaccaaaaatacaaaaggtagccgggcgtgggggcacctctgcagtcccagctactggagaggctggggtgggagattcacttgaaccgggaggtggagcttgcagtgagccaagattgcaccactgcacttcagcctgggtgacagggcaagtctctgtctcaataaataaataaataaataaatacataaataatttataaataagtgtgtcatcccatccacctcaaggctgtaaaacctagcatgccttatccctcctcactttcttttttttttttttaattatactttaagttctagggtacatatgcacaacatgcaggtttgttacatatgtatacatgtgccatgttggtgtgctgcacccattaactcatcatttatattaggtgtatctcctaatgctatccctcccccctacccccatcccatgacaggccccagtgtgtgatgttccccttcctgtttccaagtgttctcattgttcaattcccacctatgagtgagaatatgcggtgtttggttttttgtccttgcgatagtttgctcagaatgatggtttccagcttcatccatgtccctgcaaaggacatgaactcatccttttttatggctgcatagtattccgtggtatatatgtgccacattttcttaatccagtctatcattgatggacatttgggttggttccaagtctttgctattgtgaatagtgccgcaataaacacaggtgtgcatgtgtctttatagcagcatgatttataatcctttgggtatatatccaataatgggatggctgggtcaaatggtatttctagttctagatccctgaggaatagccacattgtcttccacaatgcttgaactagtctacagtcccaccaacagtgtaaaactgttcccgtttctccacatcctctccagcacctgttgtttcctgactttttaatgattgccattctaactggtgtgagatggtatctcattgtggttttgatttgcatttctctgacagccagtgatgatgagcattttttcacgtgtctgttggctgcacaaatgtcttcttttgagaagtgtctgttcatatccttcacccactttttgatggggttgtttttttcttgtaaatttgtttgagttctttgtagcttctggatattagccctttgtcagatgagtagattgcaaaaattttctcccattctgtaagttaactgttgtacttagttgtactgggtttgatcgtagtttcttttgctgtgcagaagctctttagtttaattagatcccatttgtcaattttggcttttgttgccattgcttttggtgttttagacatgaagtccttgcccatacctatgtcctgaatggtattgcctaggttttcttctagagtttttatggttttaggtctaacatttaagtctttaatccatcttgaattgatttttgtataaggtgtaaggaagggatccagtttcagctttgtacatatggctagccagttttcccagcaccatttattaaatagggaatcctttccccatttcttgtttttgtcaggtttatcaaagatcagatggttgtagatgtgcggtggtatttctgagggctctgttctgttccattggtctatatctctgttttggtattagtactatgctgttttggttactgtagccttgtagtgtagtttgaagtcaggtagcatgatgcctccagctttgttcttttggcttaggattgtcttggcaatgcgggctcttttttggttccatctgaactttaaagtagttttttccaattctgtgaagaaagccattggtagcttgattgggatggcattgaatctataaattaccttggggagtatggccattttcacgatattggttcttcctatccatgagcatggaatgttcttccatttgtttgtgtcctcttttattttgttgagcagtggcttgtagttctccttgaagaggtccttcacatcccttgtaagttggattcctaggtattttattctctttgaagcaattgtgaatgggagttcactcatgatttggctctctgtttgtctgttattggtgtatgagaatgcttgtgatttttgcacattgattttgtatcctgagactttgctgaagttgcttatcaccttgagattttaggctgagaggatggggttttttattttattttattttattttattttattattattatactttaagttttagggtacatgtgcacaatgtgcaggttagttacatatgtatacatgtgacatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatattttactgagaatgatgatttccaatttcatccgtgtccctacaaaggacgtgaactcatcattttttatggctgcatagtattccatggtgtatatgtgccacgttttcttaatgcagtctatcattgttggacatttgggttggtttcaagtctttgatattgtgaatagtgccacaataaacataggtgtgcatgtgtctttatagaagcatgatttatagtcctttgggtatatacccagtaatgggatggctgggtcaaatggtatttctagttctagatccctgaggaatcaccacactgacttccacaatggttgaactagtttacagtcgagacgatggggttttctagatatacaatcatgtcatctgcaaagagggacaatttgacttcctcttttcctaattgaatactctttatttctttctcctgcctgattgccctggccagaacttcgaacactttgttgagtaggagtggtgagagagggcatccctgtcttgtgccagttttgaaagggaatgcttccagtttttgcccattcagtatgatattggctgtgggtttgtcataaatagctcttattattttgagatacatcccatcaatacctaatttattgagagtttttagcatgaagggctgttgaattttgtcaaaggccttttctgcgtctattgagataaccatgtggtttttgtttttagttctgtttatatgctggattatgtttattgatttgcgtatgttgaaccagtcttgcatcccagagatgaagcccacttgatcatggtggataagtttttgatgccctcctcactttcaaacagtacaacagttaacatttcctaaccattggagatattaaagcacagatcttttatatgagattagttaaaatttttatctttaatgcacaagagtttgggaacattaggaatttgtacatatgctaaattatatgtaaatgaaatgatacgatgtttggaatatgttttaaaattagttgagtgtgtggagtgaggggtaaagagggatgtaagatgaataagacaattttatgttgatgatgatttagttgggatgctgggtccaggacatgcaatgggcttttctccatagatgtctgcaacttcaaaaacatccacagtgacaaatgtgtaaaaaaaattctgtgaactcttctgtggtggtgtgtgtattgaggtggataagggaccccctattaagggcctgacttctccccctgaagcacggaaataaaggagaatcttgagtttcttcaagggaaatttcaggtacctcactgtccctgagaagaaaacctgactagcaaaaaggttaaaggagcttaaaacaaccaaggaagttagaggcatgggatgtctgggtccctatagaaactaaaaacaacaacttaacatatgcccctgagttgtttttcaaacactcagaccacctccaaaagtctcggctgtcagtaggcctcagataatgggaaactgaggactgaggtctgactgcccttctttgttctaagtctcttactgaggggccctgaggaaatcacgcccatgagccagagctaacatttctttctgttgaccccaattttttggacaaagctttacgaccttaaccagttgcaaatcaggaaatttctaaatctacttacctttgatctgaaagcccctgcttcaaaatactctactgttttaggccaaatcagtgtataacctctatatattgatttacagttttgactatgacttctgttttctgaagatttcccctgcttttaaacacctttgctttcaggccatcagggagtttgggtcttaagcatgagctgcccgattctccttgcttgatgcctgtgataaatgtctcattctcttgctgcaatcctgatgtcagtgcttagatttgtatacctggtcaatggattcaagtttggtccattaatagtgtgtcttgcttttaacagacactcagagttgccagatggtgtgcctccaccctgacctccagttgaagctcatctcctccccgcacacagaggaggacttggtgagaaggccacagaatggaaaggagctcagggtttcccaggaaagagaagtgagtgatactggaggccccagagcaagaggaagggctgtgaggtaggcaggggccataaagtgaagggcatgctggtggggctgcaaggtccagggtttatgtaaacagcaatgaagaaccacaaaaggagtttaagcccaggagtaagatgaacaggctgaatgagaaggatgtctccagctgcctcgaggagaaaggcctgagggcaccaggggatcctggtcatagattattcactaagagaacctgtgagtctagaagtttgaagactatttgcacagttaaagcagatttgcatctgggatacagtgaagaagtgataatttctgcattaatctgtccagtcattcaacgtttctgcagaaacattaaaaggtcacacttatctttcttagtaagccatgaaaaaaatgtaagtagggaaaattaggtttagaatataaacaaattgtattctatctaaaacaaaattctattgagaagtagatgaaacagataagcagaaaaataaaaaggtaggaagacaaaactcacttcataaaataagaaatgtgttacaccatgaactggtaaatgttatgcctacccaactattattttttcacaaataaaatctagtgagtatcaacatgctaaaatcatggtgtgacttaggaaatgttttctgggccaggtgcggtggctcacgcctgtaatcccagcactttgggaggctgagatgcgcggatcacgaggtcaggagatcgagaccatcctggctaacatgatgaaaccccgtctctactaaaaatacaaaaaaaaaaaaaaaaaaattagccaggcgtggtggcaggtgcctgtagtcccagctactcaggaggctgaggcaggagaatggcatgaacctgggaggcggagcttgcagtgagctgagatcgcaccattgcactctagcttgggcgactgagtgagactccgtctcaaaaaaaaaaaaaaaggaaatgttttctgaattgctggatgttaaatctatcactgaggtgattcctgaaacagtccccttctatgtcattgccttgaacaaccccttcatgccactcaagtcagcacaactgtttcagcatctgtggtggtgccatagtgacgtatgcaggtcacttagctttttctagaatgtactcttggggcactggcaccttaaaaggttataaaatttttaaacagttataaacgaacatatttgctcctctcatagatcaagactacttataggagtgagatactggctaggcatctagtagaccacgtcatcatcacaggatataggattcaggacacagatgtgtatacagaggaatagtgtcctggtgagctgcagagatcagctgggctctctggtctctgagccatggggaggtgagtgtcctgctatcagcaggctgcactgtgggacttgcctgtggtgtctgcacagctgctctttaagaaccattcattccaaggagcctaggtctaggggctgggccttgtgctcattgatggggactcggcagctgtcttctctggtctggcagagtctgctgaacagggacctgtgtatggtctcagcaggtgatatctcctagggcccttccaaggagggaaagcaaatcatcttcctcagtctgcagtgtgagctgggctccagccccagggctcaggaagggactgggcagtccctgcatagaaacacatttgcatgagcagcccctcctctgctgggggttgggaagaaaaggaggcctggggcagctcaggctcactgtggtggtcaggggctgtgtccaccatggccagaacttctctcctcctcctgatcctctttcactgctggcctgaacttctcttctccttatgctcctctctcactgcacaggtaaggacaggcctcggagatcaggactcagttttcagcctgcatcagtccctcaggctcaggaacccatgacaaatttcatcctcatcttaaccctgtctcttatttgtgtctgtgtttacaaattccctctcccagcttgtgctgactcagctgtgtcctcccccctacttcctgtatctctgggagcatcttccagactcacctgcaccctgagcagtggctgcagtgttgacatttatctcatatcccgctgtcagcaaaagccagtgagcccttcccagtatctcctgatctacctctcaaaagtcaagtaaaactagggctctggagtctccagctgcttctctaaatccaaagatgccttggccagtgcaggcaatttgctcatctctggggtccagccagaggacaagactatctgttctatctattactgtcagacctgggatattgatacttcagttacacaggcagatgagaaagtgagacgaaactcagcctactaagaatggaactatggctctttttccaattgtcaaataattttcacatacacaaactattttggaagtagctactgattcacaatggttctctcaatgtcccattcaatgtttctgagtcctcaggcaaactaacaacaaaacaatgataaaacatatgacaaaacatatgataacactgactctttccctgctgaaccacatgtaataaaaccagaggagctggtttaataaaacctgaggagctgacttttcttttaaaagaaaagatgacagtcttttggagtctttttcttggtcaaaatttcctagaccatcccagcaggtggacagtcccctacagaagacacgatcctgggaggaatcccaggtacagagctggcctgcttcacttgtgggtacctgccccttcaattgtgaaatcagggaggggagagtaagcatagggggtaggtgaggatcaggaaaggggcaaggccactacatttcattaaccacctttggactccagtgcaagatagaggctgatgatcccatcacacaggtgactacaacctccttgtcatcaacagctcctgcccatggggaagcgaaatgaaaatctatccccatccctctcttcttacatatccctgtcctgcccctgccggtgaccaacaccagctcaggttgaattttgttttgtcacttgtgctattaaagaaaataactccttctcttactggtctcctagttcagacagaatcagtttgtttccagaaatagaaaacgctgctcacacacatgagtgtaaagtaaggatgacaaaaagaaaaaatccaggctatgtggcccagagacccaggtgccctctgattggcctcatagatgtcccctcctcctggcccaggtttgcttgtcattccttaagctctggaaccttgaactacatgggttctgtcttcatagatacagaagaaaaccctccccaagaaggagatggttcccagaaccagcacatgctcacttttctctgtttaattccacacatctgacttatttttgcttccatgagcctttgttgaagatatctctgaatacctctcatttctgttaggtctacagcctatggacctatctccattatatttgtgcttatttttctaacctttatgactgattatcatttaagcttaatatgagatatgcatctatattaaagatatataaatatgtcatcaatggtcaatattattaaagttataagtagtaatgcaaaattgtagctattatatcatttcacttgttcactaacattaatatgtgaagtgagaagatcactttattaatcacgcactcctggtcatgtgtgcggatgagtaagctcaggggggatgctgccatggtccatgggaagcctcaagaacagcagacctggcacatcaggcacaacatgggacacagggagtgagccatgtcagcagaaagcagaatagactgaggcatcagaaacaacccattgccaaactctccactgccttcctgcatgggtcagaccagagctgctcaaacataacgtgcacacagatcatctgggctcctggaaaatgtggactcaggggtctaggatgaggactgagattctacacttctaaagatcccttctcctacaaatccacatatgtgtttctgtatcacaaaattagtaagaatgggggaaaataagaaggaaagccatttgtagacaggaagcaaagaaacatctttcgcggagagaactacagaattttcatgaagaaagacttccagttgaggcaggcagacaaccagagaggacagccgagaagactgaggaggctcctctttcttcacaaaacaaacaaatgaaagcaaaaagacaccaagcctcccccttacctgccctgccctctggctcctgtccaatctccccaccagcttctccttcagcctcttctaaattgtggaccctcctcaccttcccttcaggagatgccctgagtccactgcttctctttcccaaccccactagcaccttccgctacttcctgggtttctcctcagctaccagagaatgcagtgaaccatccaatccaaataaattatcctgttaaacattgaccagtaggtctcctttgtgcggatctgaggaatcaagcagggagaaagaacctgactttgtgagctgcctgagaaatgagttcatggctgaagtgtcccttttctcagctaacatgttttatttcatgcacagggtgtatacagagacaatcttcccctgaggactccataaaagatggggagaattgtgtgtccagttcccattgaggagacacacacagaaaactaaaggctgaggtgaggtaggaggctgccctgaggacgggccttgccctgcccttggtcagggagtgagcagtgttcaagaccctggtggggacaggaggctctgtcaggaccccggcatctggtcagagacacggtggacctggacttgagcagcaggggatgctgtggccctgctgctgagccctctgtggggctgtcagctgggaaaccagaaccctgtgtggtctgtgctcagagatcactgggccaagtagctggatcctctgtgggctcctggggagcctcaggccaggctggatcctctgtgggctcctggggagcctcaggccaggcccaagttaggcccacccctcccagaaatgacacagccattgccgctgcatacagccccagggaggggtacggttgggcagaagagagacaagtttgcatgaagggcccctctctctcttctgggactaccggatggataagagggacctgcatcatgtcagcctcagcagagctctggggtgtttgcaccatggcctggaccccactcttcctcctcctcaccctcctcctccaccactgcagaggtcaggatggcccttagcaccctgatcctgcagctcactcacactgcctcacaaactcataccaggaatgtccttccctcttatccttacttcaggccataatgggcgtctatgtcttcagggtccctctcccagcctgtgctgactcagtcacccactgcatctgcctccctgtgggagcctcggtcaagcttacctccactctgagcagcaaatacagcacctacattattgagtggcatcagcagtagccagggaaggtcccttggtacttgatgtatgttaccagtgatggaagccacaaaaatgggatccccagttacagttctcaggatccagctatggggctgatcggtaggtcaccatctccaacatccagtttgaggatgaagctgattgtatctgtggtgcagatcatagcattggtgtgacatatgggtaaggcaaagtgaccccagtgaatgaggaagcaggacaaaaactgttttctctgctccactatgaaggctgccacgtggccctgagaaacagtgcctgttttccttactactcaagaaagatagatagatagataggcagatagctagctagatagatagctagctagacagataggcagatagctagctagctagctagctagacagatagataggcagatagctagctagatgctagatagacagatacctagatagctagatagattttttgctttgggttccttaggaacaagtttgctaggccaagctcctaaggagtacacaagtctgtattaatgtggccaatattaaggcagatcctgtcaccccctgcatgtcgatacattgtcaccacatgggaactgcaaggacatttttccctgtggatttaaacactggaactctgctgcatggcacacccctgccacatcaagtttcattttaacaatcacccataagatataacttcttaagaaaattttgaattctaacaaaatgctagaaatcacactgttgatacacagcgatggaaataatgaaaatttatagacagtgaaataaaaagatttaaaatttttggtggtttataaaggttttctcagttgttcagtgcgtgggttttgggattaggagaaaatgaggagaaactgcctccaccacattgaacatgacaactgatttgcaataatctaacaaagaagaaggatataaataatcattaatgtcatcctgacagccctgatcctaaatgtcagaattttatttcttaacttttttctccaaaaaaaaaatgtagcttcagaaaaacttctggaatggtggtatgaggccatcagaaaacctgattcaccatacaagcaatgagaacagcagtaaaaatgatataaatctacttttcagaactctgtacattaccaaaagcttacaaaattctgggaatcataaaaaatagtaataacagccagacatggtggctcatgcctataatcccaacacattgggagctgaagcagagcgattgctttatcactcctgggattttgtgatcagactgggcaacagagtgaggcctcttctctaaaaaacattttaaaaaagtagctatatgtggtggtgtgtgggtgtagttgcagctactggggaggctgaaggtggaggatcacttgagtctgggaggtggaggctgcagtgggctgtgattgtgccactctacttcagcctgagtcataaagcaataccctgtctgaatcaatcaatcaatcaattaaaataatgtggaatctctgtaagaatctgaagctttgtggtgattttatttcttttgctctctcccaagttccacagtagccttaaaaaccaacagcctcaaatctcctggatctagggaaactagaaaaatagcattcactgaagcaaccaaataccagatctggaattttctcaaaagccccattcccgtgcgactgtcattatttgagctttccaaagctcagaaaagcttcacgctctgtacttttctaaatgtgaattgtctcagagctcgcttggtttaaacagcttcatcctcaatacatttatcaaaacaatcagtgagatctgttaaggtcctgagtcagtgatacaagatggggtcaataaaaggctgaccaaaaaccttgagagaaaaaaactgggtgtcagaatctgtagaagattttgatgagctctgccatattcctggaaagacagaagatcactctcatgctcagagttatgtgcatggccaggtaaaaattaggaaagtccttaattttcgacactggctgaaatcaacaaggaaggctaaaatagagttgtaaagtggcggggttttgcagtcatgacccaacccctgcacagagcattcggcaaatgctgaggaatgtgttgttcgaggcgtttaagaacatgtctgtccaataataagctaatgactgatataattgagcagagactgcagtggctgcacaagcaaagaaaacagacttagagaattattccagtaccgtgaaacaataaatcatcatcaacaataacaactacaacaaaaccagaagcaattatgacaaatattttaaggaaagaatctgatttccagaatcgtcacattgtgtgactgagaagctccatttggcaaagtgaaattttgaggcagggacacagcaaagtactgtccatacacagggttaaaaaggaaagcaaagcaaaacataaaaacaaacaaacaacattaaaaataagttgacaaaatgatgtccagagatgcatttggtggttactacataaaaacttcaaattagcttttgtaaatgtggtcaaataaataaataaaacaacgttaacaattgttaaggaaagtacggaaagaatgcctcattacagagagaacattggcggggtgcagtgcctcacacctgcaatcacagaactttgtgaggccaaggcagacagatctcttgagcccaggagtttgaggctagcctgggtaacatggccaaaccatgtctctacaggaaatacaaaaaagctagctgggcatggtggtgcatgccagtagtaccagctactcaggaggctgaggtgggaggatttctggagcttgggaggcagaagttgcaagagcaaagatcatgtcaatgcactccatcctgggggacagagcaagagtctgtctctaataataatataataataataacaatagagaatactaataaagaggtatagaagaaaggatcattgaattaaagacagataaattgataattattctgttccaagaatagaaaaaaatgacaaacagtctgcacaacctgagagacgatgtgacaccaatcaaatgttccaatacacacatagtaagtttcagtccttccaccatgtgagctcgcagtgagaagatggcagtctatgaaccagtaagcacatccttaccaaacaccgaagtatctgcttgtactttgattttggaccttccagcttccagaactaaactctgacctattttttttggacatttgcatagtgtgggcctcagaaggaagctggctggaatttgacatcacagccactagtagtctgtgggttgtaaccccacagcataacatggggcttcagctgagcgtagtgacagaggatggagtccacatccaccctctagctgcagacctggtgggcagagacagcacttaggctatgcagcccttcatggtggctttcttcaaagtcattgtggtccatgtgtgcatcaccaggtcagcctctggctggcgttgacagcagagttgtactcactttacccagtcccactacgtggctcaagtctccagtacttcagattacatcagcagcaaattaaaaacagcctgcaggaagcatgagctatatgtgagcttccaagacctggatggcaggactggttcatcgcacccaagggctatgctgctaattactgtgatgtagaatgctccttcccaatcaatggacatgtgaatgcaatcaaccatgtgatcattcagaccttggttcaccttatagatcctgaatatgtcccaaagctgtgctgtgtgccaactaaactcaatgccattttggttctttacttcaatgacaattccaaaatcaccttgaaaaaaatacagaaatatggttgtaagagcttgtggatattgctaacttgaaaccagatgctggggacacacattctgccttggattccttggtcatagctgccttaaaaaacatacagaagcacagtggaggtggagggataagactttgaaaccatctcatgctgatgccttactgcccgagaaaaattttaacggaccttgctaataatttgctcacttggtaagtaacatgagtagttgttggtctgtactaagctgagtttggttgtctggtaactacagaaacttaaacttaaaaggtaccccccaagcccaccaaatttaattttagctatagttcaagctatttgggttattagtgagtaaatagggaaaataatctcaatggagttaaatgtattcttgggtaaagtatcagctggtttattagtgtctatcaaaggtacattttacagatagtgaaagttggggaagtaggaataactcctctattcacagatttcattcccaggaaggcaaattttatactggatccacagtccaggccatagcccgggctccttggggatgcctctgtctcagtctttgctgttatgagtttgtgctggagttctgttggtgtgaaaatatacttatttcagtcaaaacaaaccatatcattttcacatctcagtcctccatttgctgtattctttgctagtacccaaagtagactgattaaactttgaagtgaggcttagaggagtggaaagcatttgtgacaggctccatggtaactgtgtaacatgtgaaagcaatgctgcacctcttctttattggaatgactttttgaccagcacattaacttgaggactgccgactctaatatctatttcaggaaagcggtgctttgtctttttactacagagcataccacgtgattgggttagaaccaacaaaggaaataaaatgggaaagggtgccccacctttaagaatggctttagggggatgagtgtgccatttatgaatggaaattatgattttctcttgtagaaaggaaggctcagattaaattttagaatatttttaaaatatctttttcaccaacatgtactgggaaagcaatttcatactaaactgattaaatgatagttttataatctataactgcagtaatggttttttgtaaatatgaagtataatttattttatatctgttttgctgtaacattgaaggaaataccagacattttctttaagtgtttatttagaaagtaccaggagatggttccaagatggccaaataggaacagctccagtctacagctcccagcgtgagtgacgcagaagatgggtgatttctgcatttccaactgaggtaccgggttcatctcactggggcttgttggacagtgggtgcaggacagtgggtgcagtgcactgagtgtgagccgaagcaggatgaggcatcgcctcacctgggaagtgcaaggggtcagggaattccctttcctagccaagggaagtggtgacagatggcacctggaaaatcgggtcactctcaccctaatactgcgcttttccaatggtcttagcaaacggcacaccaggagtttatatcccgcacctggctcagagggtcccacgcctacggagcctcactcattgctagcacagcagtctgagatcaaactacaaggtggcagtgaggctgggggaggggcgcccaccattgctgaggcttgagtaggtaaacagagtggccaggaagctcgaactgggtggagcccaccacagctcgagaaggcctgcctgcctctgtagactccacctctgggggcagggcatagccaaacaaaaggcagcagaaacctctgcagacttaaatgtccctgtctgacagctttgaggagagtagtgattctcccagcatgtagcttgagatctgagaatggacagactgcctcaagtgggtccctgacccatgagtagcctaactgggaggcaccccccagtaggggcagactgacacctcacatggccagatacccctctgagatgaaacttccagaggaatgatcagacagcaacatttgctgttcagcaatattcgctgttctgcagcctccgctgctgatgcccaggcaaacagggtctggagtggacctctggcaaactccaacagacctgcagctgaaggtcctgactgttagaaggaaaactaacaaacagaaaggacatccacaccaaaaacccatctgtatgtcaccatcttcaaagaccaaaggtagataaaaccacaaagatggggaaaaaacagggcagaaaaactgaaaattctaaaaatcagagtgcctctcctcctccaaaggaatgcagctcctcaccagcaatggaactaagctggacagaggatgactttgaggagttgagagaagaaggcttcagacaatcaaacttctccgagctaaaggaggaagtttgaacccatcacaaagaagttaaaaaatcttgaaaaaatattagacaaatggctaactagaataaccaatgtagagaagtccttaaaggatctgaaggagctgaaaaccatggcacgagaactacgtgacgaatgcacaagcttctgtagccgatttgatcagctggagaaagggtatcagtgattgaagatcaaatgaatgaaatgaagagagaagagaagtttagagaaaaaagaataaaaagaaatgaacaaagcctccaagaagtatgggactatgtgaaaagagcaaatctacatctgattggtgtacctgaaagtgatggggagaatggaaccaagttggaaaacactctgcatgatattatccaggagaacttccccaacctagcaaggcaggccaacattcaaattcaggaaatacagagaatgccacaaagatactcctcgagaagagcaactccaagacacataattttcaaattcaccagagttgaaatgaaggaaaaaatgttaagggcagccagagagcaaggtcaggttacccacaaaggggagcccatcagactaacagctgatctctcggcagaaactctgcaagccagaagagagtgggggccaaaattcaatattcttaaagaaaagaattttcaacccagaatttcatatccagccaaactaagcttcataagtgaaggagaaataaaatcctttacagacaaacaaatgctgagagattttgtaaccaccaggcctgccctagaagagctcctgaaggaagcactaaacatggaaaggaacaaccggtaccagccactgcaaaaacatgccaaattgtaaagaccatcgaggctaggaagaaactacatcaactaacgagcaaaataacaagctaacatcatgacaggatcaaattcacacataagaatattaaccttaaatgtaaatgggctaaattctccaattaaaagacacagactggcaaattggataaagagtcaagacccatcagtgtgctatattcaggaaacccatctcacgtgcagagacatacataggctcaaaataaagggatggaggaagatctaccaagcaaatggaaagcaaaaaaaggcaggggttgcaatcctagtctttgataaaacagtctttaaaccaacaaagatcaaaagagacaaggctgttacataatggtaaagggagcaattcaacaagaagagctaactatcctaaatatatatgcacccaatacagaagcacccagattcataaagcaagtcatgagtgacctacaaagagacttagactcccacacaataataatggaaggctttaacaccccactgtcgacattagacagatcaacaagacagaaagttaacaaggatatccaggaattgaactcagctctgcaccaagcagacctaatagacatctacagaactctccaacctaaatcaacagaatatacattatcagcaccacatcacacttattctcaaattgaccacatagttggaagtagagcactcctcagcaaatgtaaaagaacagaaattataacaaactatctctcagaccacagtgcaatcaaactagaactcaggattaagaaactcactcaaaactgctcaactacatggaaactgaacaacctgctcctgaatgactactgggtacataaagaaatgaaggtagaaataaagatgttctttgaaaccaatgagaacaaagacacaacataccaaaatctctgggacacatttaaagcagtgtgtagagggaaatttatagcgctaaatgcccacaagagaaagcaggaaagatctaaaattaatacccttacatcacaattaaaagaactagagaagcaagagcaaacacattcaaaagctagcagaaggcaagaaatgactaagatcagagcagaactgaaggagatagagacataaaaaacccttcgaaaaatcaatgaatccatgagccagttttttgaaatgatcaacaaaattgatagactgctagcaagactaataaagaagacaagagagaagaatcaaatagacacaataaaaaatgataaaggggagatcaccactgatcccacagaaatacagactaccgtcagagaatactataaacacctctatgcaaataaactagaaaatctggaagaaatggataaattcctcgacacatacaccctcccaagactaaaccaggaagaagttgaatctctgaatagaccaataacaggatctgaaattgagacaacaattaatagcttaccaaccaaaaaaagtccaggaccagatggattcacagccgaattctaccagaggtagaaggaggagctggtaccattccttctgaaactattccaatcaatagaaaaagagggaatcctctctaactcattttatgaggccagcatcatccttataccaaagcctggcagagacacaacataaaaagagaattttagaccaatatccctgatgaacatctatgcaaaaatcctcaataaaatactagcaaactgaatccagcagcacatcaaaaagcttatccaccatgatcaagtgggcttcatccctgggatgcaaggctggttcaacatatgcaaatcaataaacgtaatccagcatataaacagaaccaaagacaaaaaccacatgattatctcaatagatacagaaaaggcctttgacaaaattcaacagtccttcatgctaaaaactctcaataaattaggtattgatgagacgtatctcaaaataataagagctatttatgacaaacccacagccaaagtatcatactgaataggcaaaaactggaagcattccctttgaaaactggcacaagacagggatgccctctctcaccactcctgttcaacatagtgttggaagttctggccagggcaatcaggcaggagaaagaaataaagagtattcaattaggaaaagaagaagtcaaattgtccctgtttgcagatgacatgattgtatatttagaaaaccccattatctcagcccaaaatctccttaaggtgataaacaacttcagcaaagtctcaggatacaaaatcaacgtgcaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacaaaataaaagaggatacaaacaaatgggagaacattccatgctcatggataggaagaatcaataccgtgaaaatggccatactccccaaggcaatttatagattcaatgccatcccaatcaagctaccaatgactttcttcacagaattggaaaaaactgctttaaagttcatatggaaccaaaaaagagcctgcattgccaagtcaatcctaagccaaaagaacaaagctagaggcatcatgctacctgacttcaaattatactacaaggctatagtaaccaaaacagcatggtactggtaccaaaacagagatataaaccagtggaacagaacagagccctcagaaataataccatgcatctacaactatctgatctttgacaaacctgacaaaaacaagaaatggggaaaggattccatatttaacaaatggtgctgggaaaactggctagccacatgtagaaagctgaaactggatcccttctttacaccttatacaaaaattaattcaagatgggttaaagacttaaacgttagacctaaaaccataaaaactctagaagaaaacctaggcaataccgttcaggacataggcatgggcaaggacttcatgtctaaaacaccaaaagcaatggcaaccaaagccaaaattgacaaatgggatctaattaaactaaagagcttctgcacagcaaaagaaactaccatcagagagaacaggcaacctacagaatgggagaaaatgtttgcaatctactcatctgacaaagggctaatatccagaatctacaaagaactcaaacaaatttacaagaaaaaaacaaccccatcaacaagtgggcgaaggatatgaacagacacttctcaaaagaagacatttgtgcagccaacagacacgtgaaaaaatgctcatcatcactggccgtcagagaaatgcaaatcaaaaccacaatgagataccatcccacaccagttagaatggcgatcattaaaaagtcaggaaacaacaggtgctggagaggatgtggagaaataggaacactgttacactgttggtgggactgtaaactagttcaagcattgtggaagacagtgtggcaattcctcagggatctagaactagaaataccatttgacccagccatcccattactgggtatacacccaaaggattataaatcatgcttctataaagacacatgcacacttatgtttattgcggcactattcacaatagcaaagacttggaaccaacccaaatgtccatcaatgatagactggattaagaaaatgtggcacatatataccacggaatactatgcagccataaaaaaggatgagttcatgtcctttgcagggacatggatgaagctggaaaccatcattctgagcaaactatcgcaaggacagaaaaccaaacaccacatgttatcactcataggtgggaattgaacaatgagaacacttggacacagggtggggaacatcacacactagggcctgtcgtggggtgggggtaggggggagggatagcattaggagatatatctaatgtaaatgacgagttaatgggtgcagcacaccaacatggcacatgtatacgtatgtaacaaacctgcacattgtgcacatgtaccccggaacttaaagtataataataataataaaaagagtcagccccctagcctggcagtgctgctctacaggcaccctcagccctgatcccttcactgcacctaggggacacagtttacaggactgagtcagtgggacaccctgttcctttacattcccagtcatgggctcagattctgcacttgtctcactgctggagggaggagcctgcatcagtcaccctcaaagaagacatgaagttatttcacctgtaaaggcaagaaactgttcgcagcactgggggcaggcttggggaagatgaggtttgtgaggatgttgagaattcatgcagctcatccttcagccctatagctttccagagaagtgtataatgggggtcactaggcatgtgagtaactgatttggtgaaagatgccacttcagatcaaaagtgcatttccccttccccaaggtgtcagcaacactgaaacatatttgactaactttatagaggaagattaagatagaggatgagagagacataaggcctcaggaatatcttagccaatagaaagcctgctggaagatgcatttccaatatgattagactgattgaaaaccttgaaactaaacacttccaaaggagactgggacccatttctcctgagaatgacaacacaaaaaatagtagaggaaaccaacaaaccaaaagcagacactgtttcagatctattgaaaatcctcaagatagtctcataatataatattcaaaatatctaggatacaattcaaagaaacacttgttatatcaagaagtagaaaaattcaccatttgaatgagaaaaggcaatccagacatcaacgctgagatgatttagggctgaaattacctgacagatatattgaaatcagccaccataaaatcctgttgatgagcaatttcaggcattcttgaaacaaatgaaaaaggataaattctcagaaaaaatagaagtcataaaatcaaactaaatataaatacaaataaaataaatgaaaaatttaaaaatacctctctggagagactcaagaacaagtaactatgaaactaaaatccacgcattagagaagacacttaacactgttaactagagaagcacaaaccatagttatcacagcccagcagggcgagcaatcagtctgctcagaagtgagaggcctgaaaaaaaactcctggtgtccctgatggtgaaatctggcccctgatcccagggttcctccctcttcgtgctcagagggctagacctagcagtgaagggttcccaacctcaccctatgcggcccctccagaaggcagagcccattcttgctgatattcccgatctccaataacacaaagtgaaagagaatgtcttaaccagagtactgagtcttggcctatctgaacatatttcaaagtttaaatgtacagtgagcataggatgctgagcagaggccccctggacagtggctggagttgggagcagtgcaggatggaaggacaggtcaggggccctgagcacctgtacctgcacctgcacctgcccagggtggacatgactcccgcatccaccagagggcgttgtggtctaagcaactaatcagagctccccagatcctctgctgttttccctccacctgctggtgtttctgtgccctccagatggtgttgctcctcccccttctatgaccacttttcagccataaccttgtctgaggtcaaaggagggggttgtgcaaccttcagaaagggagaaatttgcatggagccctaccactctgaggatacgcgtgacagataagaagggctggtgggatcagtcctggtggtagctcaggaagcagagcctggagcatctccactatggcctgggctccactacttctcaccctcctcgctcactgcacaggtggctgcctgcaaggaattcagggagcgttcctggatgtcacctgggctgatgatctgttcctcctgcctgggaaccagtcttcatctctcccgactgatctctgtgttgctctcttcttgcaggttcttgggccaattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcacacagtgctccagacccatggggaagtgagacagaaactccccagagcatctctacctgggccagtctcagcctgtctccaccagagagggtagctctcccatctctcctgtctaagtgcttgaggtgaactttgcttatgacttcctcttttccttttcaaaataccaatctgtttttccacaccttgatggctgattttctgatatgtgcacgatcaattgtgggataaatgtagtttataatcgggtctctgagccacaccatgattgatgttctggttggggctgccttgcacagtataagttattgacttgcatctctggcctctacccttagatactattaacaccctcccctcatttgtgacaacaagactgtcttgagacactgccacatgtcccatgcttggggacaaaatcagcccaggttgagatactcagttaaagagcatgtcttcagctactaagaagcttggctttgaaatgtgtttatgccattctgctgagcatgaggctggttttctaatttttgtttctggttcccatctatgagacaaaacaataacaccaaacttcaatgttttgatggttgaatggtttttccaagcaacaagaagtcagagattgtgctacttagaggtgtagaagccctaaccagatcctgtaacacagagtttagctctgactaggacagcacacaatgccttccatcaatctccaacccacagcccgcaggctgcatgcagcccagaaaggctttgaatgtggcccaacacaaatttgtaaactttcataaaacattatgatttttctgcaattttctatagctcaccagctattgatactaacagttagtatcagttttatgtgtgttccgagacaattcttcttccattgtggcccagggaaatcaaaagatgggacacccctgctttgcacttttgtacaatgcacatggaaatataatagagccttcttccttctaaggtcatgtgactcagccattgaaaggtggaagtgctgaaatgagctccatatgaacggaccttgaaaaattatgctcagtgaaaggaacaaatgcaaatatctagaaatgaaatgtctggaaatgactgtatttataacaaatgtccatgatacgtaaattcatggaggctgaaaagatcgagattatcctcaaaccttgtgataatttaggtgaaaaggatgatttcagaattggatagaaagtgatctacttcaaaaataagctggaaatgcctccacgaacagaggcgatgctttgcggaatcctaggtggagaagtgtatcaggtgcagatgaggtctttaagaatacttcttgttttgttttgtaaaattaaatatgaataagaacactgtgggccaggcgcggtggctcacgcctgtaatcccagcactttgggaggctgaggccggtggatcacgagatcaggagatcgagaccatcctggctaacacagtgaaaccctgtctctactaaaaatacaaaaaaattatccaggcgtggtggcaggcacctgtagtcccagctactcgggaggctgaggcaggagaatggcgtgaaccagggaggcggagcttgcagtgagctgagtttgcgccactgcactccagagcctggctgacagagcgagactccatctcaaaaaacaaaacaaaacaaaaaaacactgtgcttgctcgcttacctcctcctcaggtcatttcctgcagtctctaagaacagtccgcctggcttccccatctcctccctgagcgccagcatctggggcgtgaacagcacaatcaaggccacacctgtgagaccctcagtgcgtcagcagagctgtgtcctggtgatgtcaagggacacggggtcagcaggggacctgtgaggctgtctcagggggtgagcatgtctggccctgccagctgggaaggccctcaggaggttgaggggagctgagcacacagtgagctcactgagctgagatgggaagtgactgcagctgtcaggaccttcagggacactcagtctaggatcaggctctctcaccctgtggggcctggttcaggtcaactcctcatcctcctcttcttcctccagacaagagagacattgcctatggctgaggggtcctggaggtgatccgggtgcagggacttatttgaatgtaggaaattctctcccagtgagacctgtagagactaaaagagcgttaggaacattcactgttacggctggagtcttagggtgcagatctcttgagcacctgcaccatggcttggcccctctgctttttgacctcttccctccctgcccagctgaggcacatcctgctctggggagaagggtctatgcggtcctcagcccacctctgctccactccctttctcacagggctcattgttttctctttctctccaccctcctgggtctgtggtccacatggcactgacagcctctttcactgaccaagcctccgggactgacaattacaatcacccaccctggaaacagccataatactgtcaatcaaggcacagcttggattcaggagcacctgggacatgtccccaaacctcagacccagagggggtaacaaccatccctcagggacctcagggaatttcccagccccatgttaggcagtttggcctccctggccatctctgggctccaggctggcgacggtgctgattttcactatttagcacagaatggcagcctcgctgattattctctgattatctggatgctctgtgactccttctgtgcatctctgggatcatcattcagactcacctgcaccctgagcagtaacatcaatgttgtttgctatgacatttactggaaacatgacagggcagggagccttccctccctggtatctactgagattctactgagattcaagcagaaccagggctcagggtccccagcctcttctccgtgtgagtgggtgccgtcgccagtgctgaggctttccatatctttggtctcaagcttgaggatgaggctactcatggcacagtagtgcctctcacagtgccatggatgggatgttctctctaaaatagaagtctttttttttttttagtttggcccctttgataagtagattctataataattaaagaaaaaaagtaatgtcttttttggagagtagaaacactggtgaaagagaaaccgggaaggacttggcatggggggtgggtgggcttcaggccacggctctgacccccacgaaaggagagaaggaagggggattagtaggaactgccccagcccacaggcaggtcagacctcagacaaagcctcagccaactgagtgggttctttcccacgggtgcccattacaagtgccctgcttcctgcaggaagacctgcctggagggaccctggggtccccattgcctggagccagcccacgggcaggggacatgttagtcacttgtggtcctcctgcacgttctcccaaagaggcatctgagtgggacacttccacagccgccaccagcactgctgctgcattccccctcaggacaggggcagtgccttccttccccggctcatctacctgagccccatgtgaagtcaaagcttaggtgtctcagggctttcctccaacaggccctgcagccactgagacccttatataccctgagctgcatgctgtggagagagggtctgtggaagaccttggctcttagccatcgactcctctggggaacaccatgaaatcctcagactggggatgtcctctggagccatctttatcctcttcttcttcccagtatctcctgctccatgatctgggtcctgtccctggccctgttgcatctccagtgtctgatccatgccagcccttccttaaatatgtgttgaacccatttcccatttgcccaagaaatgagtgctggcaatgagctgcactttttttttttctaaatgggaaatgggtcaataaatgaatgaatgaatgaataacaacgcaacctgagtctcctgtcacatggttattttaagacctgcgtttttctttacccaggaggaaaatgagtacctgcagccgttattgcctctgaattgagctaacttgtttctacactgtcatgccatggtcacagtgggacagatgtacaccaagcctaccatagctttcagccctgcccttccacccgccccacctgtggcagtgatggcatcaaggcttccctcagagtcggcctctacccaccacacactctgggccatctcctgctctccaacagcctggggttcagtgatccctgtccatgtgttctacctcagagacacctgccactcctccccttccctaatttctctgccatcctgtttctccagcctcccaggaatgtcccctgcccaatctcatgtctcaggttctagaacttgtcctggaacttccccagagctgagtctctaataggagagctgatgacaggcacagccgtggtcaagccctctagccagcagatggaggagaatcagcctgagggccctgtgcatcctccctgctgcacacctgggcccatagccccctccaccctccatatgctcctgcagcccccacctcagtgtctgcctcagtgtctcctcccagcaccttcctcaggaagggcctgagatcttgcatggtgtgtttccccttggtgaactcctagtcacagcagcatcccgagtaagagcctcctggtgaagagatcgtcttggtgctccaccctggcattgtgtcctcagctccagggcaggtcacacgctttcctggaccaagattacatgcaggccacccctgctggcccctgccccacagagggaggcccggggtcaggggtggcaccaagaccacagctccattgatccctgtaggaattcttcctgcatgtttgaaagacaagagttacagaaacaaagcagagggaagattctgggtcattgcaaaaggagaaatttgcctgcagaccagcaggggacgcggtgagaccttctctgtgtatttctgcaggacaggtgctcacagctggggagccctcaactgacagaggcccagggctgctccttcatttcctcctgggactctgcagccttgtcccatctgtgcctggcagagtcctctacacatgaccctgtgtgtggtcccagcagctgctgctttctctggtcccacccgtggggcaaactcttgcttcatgccagcctccctgtccaagggcctggtccctgcgagtgcacctgggggagaggcaatggggaaacacatttgcatggtcagcccctcctctgtgagcccagtgacgctgggataagagaggcctggggcagcccacccctaggtctgtggcctcagaggcagctgtgtccactatggccctgactcctctcctcctcctgctcctctctcactgcacaggtagggacagggctcagagcccagggtggtccccagcctgatctgtccctcatggctcagatccctcagcagctgcgccctgaccctgctcctcactgtgctgtgtctgtgtctgcaggttccctctcccggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaatcacagtgagacagatgaggaagtcggacaaaaaccaaggttttaagcttgtcatttttactgaactggttaagaacttcagtggttaataaaatcacattaaatacaggattgttgttaaaaatggtggcacattataactctctcccatttttttcacataatgcccatagtgactctaagcagctaaaatcaaaacacaaaaacttataccaatactaagaaatactaacattactaaccaatttccactagtaaaagagttgtgaaacagctgaaatacatccagatggcataatacataataccactatatacaagagttgtataaaattatgtatcatgtatatataaaattatgtatcatgtatatgtataatatatgaaataaaatgtcagcagacattaccgtcttcccaccagtagccagcaattctgccctgcctctagaataaatggttaccacgggttgaataggcgaacagccctggcagctctgcaggatgactctcactgtttgttattgttttatttttaagattgcttttctttcctattttttttgaggcagagtcttgctgtcagccaggctggagtgcagtggagtgagctcggctcactgcaacctaagcctccctggttcaaacgattctcctgcctcagcctcctgagtagctgggattacaggcgtgcgccaccatgcctggctaaagtttttgtattttttagtagagacagggtttcaccatgttggtcaggctggtctggaactcctgacttcgggatccgccgtcctcggcctcccaaagtgctgggattacaggcgtgaaccaccgtgcccgacctcttttttttttttttttagtttggttttgttagtttagttttgttttatctctttaacttgacagtcagagatgatccatgtggatctctgcatgggtctgggagctgcaaggctcctggtgcatggcccggtcccgcctgccttggcagggctcctccacctggctcctggaggagcagctgcgcccgactaccctgcatggagcccgcggcttagcggcagctcgggaggggcctgatagaaacttccccctgagcaagcagcgccaaacccaggccgccacccaggatggaggctgcatcacccccggggagcccggatcctcgccagggtccaccaggagaagagcacatggcggagatgagcctgcggggctgggagagagagaagacacggcgaagctgcaggtgaagacgctgcactaaggccccacccagaggctgaggttccccgaccagaccagcagcagcgaggctgcccagagcggcgccagcaaggtggttctctccaggtcggatcacaggagaagctagccttgcacctggcccaggcaagaagcaggacatgggcttacgcagaagaatcagcaccgattccacatcattccccatggcaacggcctctacggtgctgtcagcaagacccagtgctagacccgagcctgcaccaggagctgcggagcggagggtgcgccccatcccgatcgtctccaccactttagctccctgggtgagggtgacacggggaagcttattatcgcggctgcccaaaacggggcgtggctgggtaccctgtgtacatagggtagatgctgaatgtgaatagcactgaactactagagggaggctggagaggcccacagtgtctatctaccatgattcattatttgggcccagaggattgcctaaggcctagtatttggctcagttggctcagtaacgggcactaggatgcagtatttgatcactcctatcctaaccaagtacgacaactggtgcaaacagactcaaaagcaaaggcaacgcaatgaataacttgctcactctggggccacatatgctgaataaaatgcctacccttgaaatgtctgaaaaccttacaccctgggaaaattgcatacagaacttgtgcttggagaatgacatgaactctaatcagggtaataacacttgtaaagttcctaacagcttttctttccttttttttttttgtttttgagatggagtttcgcagtgttgcccaggctggagtgcagtggcgcgacctcggctcactgcaagctccgcctcctgggttcacgccattcccctgcctcagcctcccgagtagctgggaccacgggcgcccaccaccacgcccggctaattttttgtatttttagtagagacggggtttcacggtgttagccaggatggtctcaatctcctgacctcgtgatccacccgcctcggcctcctacagcgctgggattacaggcgtgagccaccgcagctggcacttcctaatagcttttctgtgagtgtaacgccataatcatcttttaaaatgttttctcggaactaaaagttgctgggcgcctaaatgatgttgcatgatagttttgggtgattttactgcatctgtaattttctgtttaagtgagcaccgcttaatttgaaagctaatttctcacagtgtaaatctgttcattcctggtagtctattttctacaaaagtgtatttttacacaacattaaaaaatggtgtaccttcatctatgacagtacattacttttgacaagcagctttcaggcagaaattaagagaagtgttttatataaaatttattattttgaacagagtttgtgatttggtagttacgctgttgaaatttgaattttacaattcttagaaacttatattgatgcattcttgttaccaaatgattggcccattacattttgatacaaatagatttgttgttttggaaccattatttgtttagaaatggtcaatcttttagagagaaatacttaacaaaggattgtgggaagttttttttttcttcttctttaacggattgtaccaggtcttacttgaatgaaagtctgatgcttgctgatggcagagtgactaatctgcactagattgatgtttagagcagaatgttgggtgatctcaattgtttttatttatgtttgtgattttgttttaaggtaatcttaacatggtataagactctgtgacaagctaaacctactgcaatatagcatgttggagtcccctaagagttttaaaagctaatggcataaatgcctggagccaacctcggcagttatttcatagcagaagataccgtcttaatattccttttaaattcttttaaaaggcaaaataggatcatcctattttataatgtacaaatgtctgcagagattgtatggtttgttgtgttaatgtttcccacctaaaatctatcatattgccactttgcctaattgtagtcacatttattaagtaatgcagtttgtactttttattttgtaacattctgtgatttttgtacaacattgtatttgtacaatacagcaattcccagttgattgaatgaataaataaaatgtaaaatcatactttataaaaagatctatgtggctgatagaattctgacattcccctccaaatggaaagtgatgtgtttctttaaagtaaaggtagaggagtcttaaatataggtgttcctgcccctattgagaggttttcaaaacatgctcttaatttaacgtttaaatataccagagtcttagaatgtgagaataatgaaattggtttgttttaattttgtgataatattaaatctactggaaagaatattctcctttgaaaagattctcagctcagtgatcatagaacctgtacttgcgtttaattcaatgaggaaagacatagaaatgccacgttaatatcctcatttaggtggtttctcccttcactgatcagcctatgaatgtgtcaatgcagtactccccagtttaggcttaggtacttattgaaaggatgctgcctgagcatttttaataattgctatttcaagatcacattttggccatgaggcaggctgccactcactttaggctctgcctaggcaggaatgggtcctggaagacacatgttctctctctctctctctctctttcacacacacacacacacacacacacacacacacacacacacacacccctctcttctctctgggtacacattattctggacatcttcagtttccaggattctctatgtctccagctagaagtcagggcttagcctgtggtgatccagccaccctcaggttgaatctcgatgaagtcacaggaaccaccagtggcatggagggtaagggatcctgctatcaggttcagccaggaaatgctctggacacctgctggtggaagagtttaatgctgggcaatcacaagtcaggtcccttcttccagtcggcagttcagcctccctgactttctctgggttccagtcagtgcatgaggatgatggtgacatttattcaggggcagcacagcagcctcagtcaccaccaacagtcactgtcatatgagaaaattagatagaaattggccttccaactcttctgtcagatccatctttgccctttttctgcctgcttgagtgaatacgaccaagaccagctcaggtttttgctgatgctatcacacgtgctcctaaaaccagaaggcttaatggtattttctgtttatctttacggattcaatgaaaagacaccttttcttactggtctcccaatgaaaacataatcactatgtccacagtaacaaagatagccctcgttgttgtctgctgggatgagaagagcagcagaagtttggcaggtatggccctcatgggcttcacatgtccctacatctggccctggctttgctgatcaccctttgggctctgaacccacagggaagttaggtttctctttcttttgagattgcctctggaagagctgctctgttcccaggtgcagggcagcccctccgcagtaaggacccagctctcagagccatgaaggcctcaagcctccaggttgactccacatttctagtgcttgtctctggttctttggttggaaagatgttggatgaatagaagttctctgagacctaggctttgtgaatccaacccccattaaatccagggatctttttaacgaataaaatgaatcagggcccagtgatggtggggaaatgggacgtgagggttcctcaggccagtagtatggggagaacatccaaaaagaaaggaggggttccacttttgagaattgtctttttatatccatccacatattgacgaaaattataaaattagactaaaataccttaaatatataacatggtcaaaagaaaagaggtattaccaggataatattaaatagtaaaagaagtcagaggcgaaacagagcaagagacactttttttctgacagcatcattcttatgggctataatgccaaggcttgtgcagtaggagctgaaggaatctcacaggcgaccctcacgacaataatgacaataacaaaataagtcaacctctaaaagaagcccatgtagaattatccccaggtatgaaccacctggaggctcagcagaacattaagccttagattgggttcaagatgaccacagactggtgatgaccacaggcccctgggagcaacacactcacacgcctggtgatgctgatatctggtaaatcatcactgtgcatcctgaaacacattctgtgattagctctttgcagaccataactaacatgaaagaaataatgcctcagctgtaaacactgcagagaggacccactcattctactcccttaggtcatgagttgaaagatccatttgcaatggtcaggatgtccttccagaagagctgggtctgttctgaggggccacccgacttgggatcggagcccagcagggggtgctgttggactgttcctgagagggcagggctctgggccaggccacataggaaaatactggttctcatacacttgagcaagcagtgtcctcactgaagtatgacttcctgcacctgcaccaccgagcaggagccacttcctgcacctcaggagccactgagcactagactcacacgccaatgcttcctattttatcctccgccctcatggagtccttgtccaagcctgcccttcaagcagagacaaatcacacagcaggaacaaatttgctcaaaggaacttgaactacaatgtttcctgggcacagaatgagaaacacttggaattggggaagttcccatcctaacaacttagactcaggaagaagaaccctggagcttctccagcatggccagaatctcagtccacttcaaaatcctcagtctttagatcaggagttcttttagggatgaggtcaaggtttctgggtgcacattaccactgcctttcagtcctatcatctgggcatgaggagcttgttatctcgttctatccattatttctaaacctccttgtagagggctgggttagagagtgctaactgccatttatacagtctggacctttgtataaaattataaacacacacacatacacacacacacacaaacacaaacacacatacttattttgatgttccagcgaaagagtaaaactaaactcaacagaaacagaaacagatttgaataatacaagacaatctcattaatgaacatagaagcaaaactctctcagaatattagcaattagagtccattttatatcaatgaaggattatcttgagcatctgggaggatgtgggttgagacatttgcacagtcattggaagacagtgaacatgatttttgaaaaaacagcatgtttagagatatcaaccagaggtcagatgcttcaatcagagaaagatcctctgagttctcagggctgcttccctgaaaagctacgggagaaggaaatggagtgactggacacaatgccaggggattcattgaccctttggcttcccatgggcagcatgcatcagcatggtcttacaaggatgaaaaagggcatccctcaaaaaagaccgaccatttccccagaaattaataaagaaatatcatggccgggcgtggtggctcacgcctgtaataccagcactttgggaggtgggcggatcaggaggtcaggagatcgagaccatcttggctaacacagtgaaatcccatctctactaaaaatacaaaaaattagctgggtgcggtggcaggcgcctgcaatcccagctactcaggaggctgaggcaggagaatggtgtgaacccaggaggcggagcttgcagtgagcctagatagcaccattgcagtccggcctgggcgaaagagcgagactgtctcaaaaaaaaaaaaaaaaaaaaaaaaatcacagtattttcaccagtgcatttctgtttgagcgaatatgttgggtgaagaaatatataatatatacttttctaaatgaaatttttatctcacaaaattgtagaattaaatttttgttttggataagaaatcaagaaacaatcacacacattcttatgatctcatgaaaaccaggtataggaaaggaagtgacgaccccaaaattcatctaaaaagtgaaggttttggttcaaagataagagggttgtcatgttcaagacaaagtcactaccattcgtggtatttaaagctgttggtacaagtgcctatcattgccgattcccttcaaatttcttgtgtatgtttggatcttaaacatgagcacacacaaaaagagaaacagcaaaactagaaaacagatttacctttttgagtttccaactggaggagaaaatgaacaaagagtaagaatatcacatgataatgggaggaggagtgttaggaaggtgatgaggagcagttcagccttcccagcttggggacagtcttagtggagcagagaaacctccttcctgctgccacctgactctctagagtagatgaagaataaataactaaacataaaaagcccttaggaaaaagattgtcatgatgtcagtgctattaatagttcagttaataattctgtaagaatatgcaaaaacttactggctttttaaaaatttttatttatttatttcttttgagacggagtctcgccctgtcgcccaggttggagtgcagtggcgcgatctcggctcactgcaagttccgcctccagggttcaggccaacttactggcttttatatttggaatcacaacctgaaaggctgcagaacatgaaaggaagaaaactcagattgcagtgttcattctcttttatattatgagtttcctgcaagagctacatctgttattatgcaaaaacaaacagataaggaaacaagaattatccagcctcaagagtggaataaaacatgcactttttttgcttgtaggcataggtgagtaattcagacacggctgctgtgggtgactcatttccccttatgatggagcctcagcaaaaaagcttcacagattggggctgatttggtatgaaggggttggaatcgactgaaggtgacctcattgagagtctgcagtgaagccggccttggctgaatgacctacctgaggcctcccatgtggcctgggtttccaggaagctgggcagtcccagagaattcagagctctgacttggtttataaagtgtcacttccacagaaactgtcagtgccgagagatcactagtgccagatctggttaacagggaggggcctgatctcacccctcaacggaaggtgacgggaaaacaaaggaaaagctgtcttcacatcaacatgggcagataccactttaaagcatattctgtagcagggttcccactccagaagctgtggtacaggatgtgtctcctatggcatgggccaagggagggtaaaggtgagtttgacatctgtctcagtcaccatgaggtttttctgacaactaaatataaatatgtaaggtgtctcacagcacaatcatgtgacaataaatgcagtgcgtgccttcaatattgctctatcaaggaggctttccctccactccaggtgtgagcacgtggcttgcatgtccctccactccaggtgtgagcacgtggcttgcatgtccctccactccaggtgtgagcacgtggcttgcatgcccctccagcttcctgcactgtggtcatactgctgctgcctcattctcagcctgagcatccctacacaggcacaaactctatggctcaggctggtcatcactctgggtccacagtagctggtcagagagaaactgtcttcagccctgcccagcaggagaaaagagcattccagactgatcagctgggttcctgccatccagaagtccttgtctgtctggaggctcaaaacatgactgtgattcctttgaggactcctcccatacccaggctgtgggcttcgctgccctcctcaggacccgtgcagcctgttctatccctgcctcagctgcaggcaaagctgcttgccacaagctccctgctcataggatgccggagtcctcccaagggctgctcttcctggagaagaaggagaaccaggcagtaaggtctacctgagcatcatgggaaggaagtgatccgattctgactccggtgggcgcacacccttggtgctttgtgtctcctgctatcccagccacaggagtgggggaaatgtgtgagttgtagtcctagccgggaataatccataaaaggtgaaggtgagagaaggacactatgcatggtgtcaccttgttttcctcgttgtttcagcggcctgagtcctgtgtttcctgaaagatctgtggctcgaggtgacacgccctatcaggggacaggaatcaaagaggagaatctctgatggaaaaattcacaaaggaagagggagataaaaattgggcaacatgctcagggtgagaacgatggctttttgtccttgtgatagtttgctgagaatgatggttttcagcttcatccatgtccctacaaaggacatgaactcataattttttatgggcaaggacaaacaaccaaacaccgcatgttctcactcataggtgggaatcgaacaatgagaacacatggacacaggaaggaggacatcacacaccggggcctgttgtggggttgggggagtggggagggatagcattaggaaatacacctaatgtaaatgatgagttaatgggtgcagcacaccaacatggcacatgtatacatatgtaacaaacctgcacgttgtgcacgtgtaccctaaaacttaaagtaaaataaaaaaaaaaagacggctttgtgtcaagggctatttatttagtgtctctcgttcccattattaaataatttaacaacaaaaattgccttttctatgaattttcaggaaattctaaccatcattcctttattaaatatctagatatgtacatctacacatatgcatatacatgtgcatatatagacatatattatattatatatatttgtgtgtatgcatgtgtgtatatatttatatatatatacatgcatgtgtatatacacacacaaagacaaattaagaaatatgggaatatagtatacttctttaatttcttaataatgtccatttatatctaaaaaaaagatacccctaaggttgaaccactagaatcattttatttttaatgtggaacaatagaaagcttatggcccataaagatattggataacatatttttctagcaatatgagaaataagcaaaagtgtaaaacatttaaatacaataatttaattcaaaaatatgaaataatttgtattttttagttgctatgtttatctaccaagaaggcattatattattctgatgttcttacacattgttgaattaaagcttgttaaatacaaatgttatcatatgtgcaaatagcatatcaacatttctttttctctcatatattttcagaaatcactttaaaatgtagcagttcataatgttgacaaaatatcaaaatctataaactctgggtttaaaaaacaatgaaatacacagtacacataagaaaatagtgtcaaagctcactactataagagacaatgatcaatattgaaattttctcttacatgaagacgctcaaaacattttagcagtgactagtgaggttgtatccattctcttatgtttatatttatgtttaaaatattgtccttgagaaggagtgtaggtaggtataagcagaggtggctgtgcggatccaagattctagcctgcccccttgatacagcccattaccctagtcccatccaatctcacacatggcccatcatcatcttctgacttgagcggggagagagacggtgggtagagagggaggaaaggagttagttcagagcataggagacgtggtcagagagttggcagagggagggagggaggcacattctgtgggttcacgtggtgctttgacaactgtggatttacttctgaatgaagcatgaagtcattgagagtgtggaacagtaaaatgatattgcaaaataaaataaactaagattccagtgagcatgttgggaatcacaaacactcacagctgggtgaataaacaagtgctgccatctggagaaaagttcctcagcacacaaggagaagtgtgtttgcctctgtcaagcagaagtccacctatacagagacacaaggaaatgtttataaagagatccttattcggagcaaagtattggaagcaacataggtgttcaacacaagtggaatttataacacaaggagaagataaaatgctagccagttggaagtaatacaacttcttatgcgacacgaataaaaatataattatcagttgaaaaacaataacaacaaactcccaccaaattaaacaaaatcaaaagctctcaagaaaaaaacaatgtgccacttattttaaagcagaaacatgcataacgaattcttcaagcttatataacgggctttttggaaagtagactggaggcacattatttcacataaatgggtgtcttaggaagagatggagacacgtataatggctaaaaaatgaaataaatccatagagaggtttttagtgtctagtgataaaagtactaataatattacgtaattaaattccaaaaaattaatacagaaaaatattcttgatttgggggtggtaacagatgattaagtaaagcgagtctacatgagctgctgatgcagtggatgacaagctctctgcagctcattgttagtgagaaggcactgctttgccagaaaccccttttatttagatttctcatggtccctgggtccctctccaacaccatgagcagcttcagaagaggatcaggataaccagtgactctctggctaccatggcccagttgtgtccgagaggtaagaaaggtttgggatcttggacagagtgggacagtgggagaaattcctgagatggccccaaccagcctggaaaccactcagaacctgcattgaagtttagccatcagggtgctcttgagactcggtttgggctgcaacacagacctgtggggacaggggtcaccataagccaggccacctccacccctgggtcagctcatctcctccctctctgcttcagatctttgagtaaccagcacatggaggcccgggaaaagtcagagagcaagatcttatttaaatgctgtgactccacccccatgaaggctttgggagctataaaaaagagacttaggggagcccagtctccaaacagagcttcagcaagcatagtgggaatctgcaccatgccctgggctctgctcctcctgaccctcctcactcactctgcaggtgagagtggaccttacccagggatctgcacccacctctgctccagcttctccactccctggctcagtggactctgatcctgctctcacattcctttctgtcccctctacagtgtcagtggtccaggcagggctgactcagccaccctcggtgtccaagggcttgagacagaccgccacactcacctgcactgggaacagcaacattgttggcaaccaaggagcagcttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcattggacagcagcctcagtgctcacacagtgcctcaggccagtggggaagtgagataaaaactcaagagctccctcggcctcactgaacaggcctcacagagcactgtttaaactggaccacccaaaagacaagggatgcattcacaatagtgtacactatttaggactgttaaaaataggaacatgaagtgaaattagcaagcctgccttattaacaaatgtgtgtagggaacatcattgtttatatattagtagttacatatatataatactagtgcatgaacatacatatgcactagcaattagtaaaaaagaaacactaggtttaactaaggaaatatttattattccagagttttcttatccattccatttgaagatgctgggatcaagtcaccgagggtgctgctctctggccttgagaatccactcagcagggccaccagcagcccctcccttctgtggcctgctcatgccctgtcttctcattagaatccccttccctgctgtcacagggatccctggactcctccagatccaaatatgtccaatacatttggttgaggcctcctgggccccacattactgtgtaatctcaacacccacacactcaaaacagtgttcccatgcgtattcttctttcgactcatcactgtcctctaacagccatgggcagtgtgtggagagagcaggtgaagttggagctttggggtacagttgacagagatgttgacattttgagaaaaagaaaacacctatatagctgttttcaggataattttccatcaagataaaaatccacgcatgagagcatcactcttccagtgatgaatgcatggaggatccttctcactctattgttgggtagtgacacctgggaaacttactgtgttatttagtgtgcagacagctggtaaaccactcagctgactctagggaagttgaccaaacagtgtccccactgatgtgtgacttttctccacccatgaggccccactaccctgtcacctcctgagtccacctttcccattgcgttgctttagatttgaggcatctctctcttacctctttaaagtctttacccaagtctggttcaggaagtgctgatacacggtgagaacccagggtgcatatggatggagtgattctgtgcctaggagagcctggccaggggatccaacacagcttgtggccatcctccccgcagtggagcttctggagacagagctctgaggtgtccccaccacaccctggggcctttctccctcagttctttataaaagggatatttgtcatgggcttaggggaagaggccgctgaggtcacacaagacctgccttcttgctctggctcacaaggcacaagtgagctgtgaccctggactctgtgtcagtgctgtggtcacttggtcagaactaagggaagctggagaaatgtgggtagctttgatgcagtctggcaccagaagctccatcctgaagcactctgaaggtgctgatggctgttcactgtgctgcaccctgagcaggaggatgatcatcatcgcagacctagggtgacagcctcagagctgaaatattcctcctggccctgagaaaagtgggctaaagttctcccttctgcgtgtgttacccagtggtttgcccccctttcatcacctgtgaccaacatgggctcattggggatatttgtgctgtcatttctggcacaagaacccaaagatctaagaccataaaatgcatttggtctttcatactgtctattcccatcagggcagacatctatccattaatacattttatttaattttcttgtcttatattttcagagcaatgatgagtaatgagtgaggtaaggggtacctttgcatttttttgatctcagggaaaatgtcctccatgcagtaagatgatgactccggaccaagacaggtgtgtgtgtgtgtgtgtgtgtgtgcgcgcgcgcgcgcgtgcgcgtgcacacgtgcacacgcatgtgtgttaccatatcataaacaaatttatctgtttctgtattcttacgtgatttttattagggatagatattaaaatttgccaaacacattaaaaatctattgatacaatatgatctttggttgtgatgtaataatatggtattataccaaaacttttattaatgttgaacccaaccattattttaagtataaatcccacttgacaatggtgtataaatgcgtaaatctggtgttgaaatcagttcgttcctcaaatttcctggttcaagtgatcctcccacctcagctccttgagtagccgggattccaagtgggtgtcaccatgcctggctaattaaaaacaaatcttatttgtctcaacatattgcccagtctggtctcgaactcctgggcacaagcgatcctcctgcctcagcctcccagaatgagttaacattttattttaaaattttgcattaatatgtttattttattttttatttttaaaatttttaacttttattttaaattcaggtggtacatgtgcaggtttgttacaagggtatattgtgtgatgttgaagtatacaattttatctttttaaattgctcttaatacatatttttaatttaaatttcaacttttattttaaatatagcaggtacacgcgcaggtttgttacatgggtgtattgcacccgggttgtgagcattgtacccaacaggtagttttttacaccattccctcctctccctccccctcctagcagtgcccagtgtctattgttctcatgtttatgccatgcgtgctcaatgtttatctcccacttaaaaatgagaacacgtggtatttggctttctgtccctgtgttagttgcctaggattatgtccccctgctgcatccatgttgcttcaaaggacattattttattcctttttatggatgcatagtattccatggggtatataaactatattttctttatccaacccaccactgacgggcacctaggttgatcccatgtctttggtattgtgaatagtgtggtggtgaatatacaagtgcatgtggcctttgggtataatgatctatttgtctttggatagataccctgtaatgggattgctgggtcaaatggtagctctgttttaagttctttgagaagtcttcaaactgctttccacaatgcctgaaatacggtgtatacgtgttttctttactctacagcctcaccatcagctgttgtttttttactctaattatagccattctgactggtgtgacatggcgtctcattgtggttttgatttgcatatcttgatgattagtgatgatgagcatttctccacagttttgttggccactaatatagtgcagttttaagttcatagcaaaatacagaagaaggtagaaagatattccctatcctccctggctccacacatgtccagccttcccccttatcaacgggtcccatcagaaatgtacatgtcctgtaattgatgaaccacattgacaggtcattatcactacaagtcagtattttccttaaggaatttttctcgctgatgcacatcctatggctatgggtttgtgcaaatatataatgacatatatccaccattacagtatcatgcagtgtatttcccttccctacaaatcttctggctttactgattcatctctctctctcccctaacctttggaagtcgatgacttttctacttttttcctttgtttgactgtaatacacttgaaattatttccccctttttggactgtaatatacttggaatcacgtatcatgtcatttgcaggtcagctccttttacttactaataagcatttaagtttcttccatgtcttttcgtggtttgatagtgtgttgtccataaacatgtagaatatattaatataaagtactttggagctgatcacatcactggccattcaggtttttcaattactgtttgttgaatgacagtgaccagtcagatgacaggaagtcttagaccccctgagaacacagaagatggactgaggatgtcagggtcaccgaggactgcactgggtgctctcatggagggctcagtaggggtgtcctctagttccagtgagcctggactgtgatgggcactcagagaagggtcctctctagcctagcagagcccctgctcacaggcctaccagctgtcccagcagctttccctcccaggtccttccgtggggcagacagagtctcactgcctgttagcccttcctacccacaagaccctcagcaaaagatccttattcagtgctcagggagaggtggggcagatagcagctggggccacacctgcatgaccagctcctcctcgctgaggcctacagcaggtaataaactcaatccatcccactggaccaaagggagctgtgtctaccatggcctggacccctctcgtgcttgtcctcactccctgcacatgtagggaaaaggcctagagacctggggcagttcccagcttgtgtcagcccctctggctcagacttgccaacagcttaaccctgacacctgctccaacaatgtaaatgtttgcatttccaggttccctcttccaggctgggctgacccaggtgtcctcactcccagcatcttcatgcagatcaaacactcacctgcactcagagcatatcggctttcatatcggtggcaaaaataccttcttttccctacagaatccagggagccctccaactatgttctgagattatgctcaggctaaaatgagtaccaggcctctggggtccccagacaattctctgggttgagaggctcctccagagtctcaagttatttggtcgtctctggccttcaccttgaggatggagcagatcatctctctcagatgggctgacagggcatggcttacactgtgctctaggccaatgggaaaatcccctctgcttgtgctgcctgggctcccactaggcccctgctgtttgtgacaacagccagcactggtggtgacgcttcagccatgtatgccctacggtgagagtctgcagcccttccacgcaactatcacttgcagaatgtctgcatcattgctaatagcacattctgagcctcctcacgtttctgtgggcaacaatttccttcccaagacgtgcacatgatacaggagatttatttaccaaataagtttattaggaatccaattataattagaagatattcatcagtgatcgggggaaatacctggtataattaaaatagaatttgatgaaaatataaataaagaactaaattatgaaggtgtgggcagagagtctggacacc

SEQ ID NO: 912 - DNA, 5050 bp, Homo sapiens
tagaaacagtttctgggagagagattcctgtggaataatagcactgcgcactgtggcactcctactccagcctctgcaactctgattagccaacggggagactaggtgcagacgagggaacagacttgtccagggtcactcagccaagcagacgcaaggccaaagccacaacacaggtctccaaggtacaatgatcacaattaaaaaccatcacaattagccaggcacggtggttcacgcctataatcccagcactttgggaggctgaggcgggtggatcacctgaggttgggagttcaacatcagcctggccaacacaatgaaacccccatctctactagaagtacaaaaattagcccggtgtgatggtgcacacctgtaatcccagctactcgggaggctgaggcaagagaatcacttgaacccaggaggcggaggttgcagtgagtcgagattgtgccactgctctccaacctaggtgacagagcaagactctgtgttaaaaaaaaacacacacacacaattaaaagacaagttctcaggatatctgtatgtactacttgctttctttctttctttcaagacagagtcttgctctgttgtctaggctggagtgcagtggcacgatcttgactcactgcaacctccgcctcctgggttcaagcaattctcctacctcagcctcccgagtaggtgggattacaggtgcccatcgccacacccccagctaatttttatattttagtagagacggggtttcacgatgttggccaggttggtcttaaactcctgaccttgtgatctgcccacctcggcctcccaaagtgctgggattacaggggtgagccaccacgctcggccagtatgtactactttctagtgactcacttcaccctctctccagacggggagcatttttctcctaaataactaaataataagaacaaccatcatgtggctgtttactcaagcactgagcgaattacaagcaccatatcatcattcctcacacaaccccgtaaagcaaaaactatttttaaccccattttacgcatgaggaaaccgaagctcagggggcttcagcaacttgcagaacatcatgcaccagggaagaggcaaatcttgcctttggatctgtctagtctatctcgagatgcagcccttcaaccactatgatatcctggtctgctgcccggcccttgtgtctcctctcctggtgccaagatcaatagggttctctttgatacctgatgccttctgggcaggactctgtggcagccactgcagtgcccttcaccttgggagcccaatctggtcactggctcagaaaattccataaacagcaggctcagtggcaagtatggggacacgttccccatttgtaggctagcaacaggcagctttactgctgaaggaaaggagtggggtgggcatattgtcactaaaggaagctgggcggtcaccagcactggctttctatgcgacagtaacaatgataatgatgacgatgatagtaataataataataatagcagctattcatttaacatttcctaagtgctaggtactattttaaactttgttcatatattaaaccaattaatcctaacagttgtaggtggaaagaaaaattaaaaatctcgggaccccccccccccccgccaccaaacttcttatgcaaaagggacagttaagcccagaagctgagtcattgcaacaccctcttccaaatgaatagctgttacattatgcatcagccaggtccccgtggaaaggtggaaggcctcaggcatctgcaaaggactgcccccaaagatcattcaaaagtgaccttggctgccctcccataaacaaggacgtgccaaatgtaactttaggtctacgatctaaatcaaggtctttatttttatttgagacacggtcttgccctgtcacccaggctggagtgcagtagcacgatcacagctgactgcagactcatactcctggagtcaagtgatcctcccacatcagcatcctgagtagctagaactataggcacgtaccacaaggcccagataatttttcattttttattgtggagacaggggtcttgatatgttgcctaagctggtctcaaactcctggcctcaagtgatcctcctgccttctgtctaccaaagtgttgggattacaggcatgagccacagcaccagcctaagtctagctctgattctacattataataagctaataacgttgactataagcttatcttcccaggtccaggacaaagtcaagactcattctccaaccacccagagacatccataactgactcttcctttactccttttttctcttcatcattcaccttatcttatgtaaaatggagatttaccgggcactaaggaaagtctcacaagagtataagcatttgccttaccgcctacctgcccctcttcctacatgccttcctcctctttaagaaaatgtataaagactaaatttcctgaaaacctcctcggaaaagcagcctcagatgtgtctgtggcttatgtttttcccagacgtgccctgaagctgccttcataaacctcgatgattgagacttatgcttcagtcactcatttcagttgtcataggggaccagaatacgctatcccaaaatataccactttggcataaggattattttgagctgaaggcagttgagaagaagcagatataagaaaagctctctgccctccctgtgtttgcctaaaagcaggacagaaatttgcaaagctgatcccctaaacctccagcagaaaggacagaaattaatcactgataactttaaaccctcatcagcccaaggcaccagaggcatctatataacgaactttactggcttctatcagcttccccatatatttactttccacaatttgctgccctggaaattcaaaatccttttctttgtcttgtcccttgtctaaaaaaatttttttaaatgctgtaaagcccaagttcttttttttttttttttttttttttttttttgagacagagttgcgctcttgttgcccaggctggagggcaatgccgcgatctcggcccaccacaacctccgcctcccaggttcaattgattctcctgcctcagcctcctgagtagctgggattacaagtatgcaccaccacaccaggctaattttgtatttttagtagagacggggtttctccatgtcggtcaggctggtcttgaactcctgacctcaggtgatccgcccacctcggcctcccaaagtgctgggattataggcgtgagccatcatgcccggccaagcccaagttccaatcacccctttgagttactgaactcccagcgcttccaagtgtatgcacagctgcacttaataaattaagtatatgcacctcataaacttctgtttgtttttctcttgttaatctttcattagtttatttacagggccgcagccaatgcacctaagacaaatagcagaaaaagtgggttttttcctcccatgtatggcaatcctttgttattatctctgcttcacatatggagaaaactaaggctcagaaaggtggcgtcacttgcccgcttgctgcccagattttttgggcccagatgttctggctccaaagtctgagctcctttctccccatacaacctaccactgggcttctttcctcatttgaaattgaggggctcagtcctgaagaactcaggtgcctatcttgattctcactttcaagagcaagaaccagacccagaaaagtattttatttctctgctttcctttatcctgatttctaatagtgtttgtcaaactatattaatcatagtctgttgcattcttgtacatgccaggcacttggctaggcagtttccctgcactctctctagtgtttccagcaatccaatgaagaagcttctgttatcctgattttacgctgaagcatccgagactcagaaaggttcggtaatttgcctaaggtaacccagtgaagaagccactggtgggactgcagagtctagaactaacaggcttttaactaccactcctgcctgcttgcctgtgtcttctccccacattcccacagtgtctgagctcctccagagggaaaggaaggtgttacctgcacctccagctctagcaagaggctgagaaaatgctagatggattaatactgaattaacaaataagtagatgaaaggcaggaaagaaaaggagaagaaagagaaaaagaaaggtaaaaattaggatggaagaaagtaaagaagaaaaatgcagtgaatgaataaaataagaatgcatgaagttaaaaaaaaaaaggaataaaaacaaaagatcgagaaaatgaaaccagaaaaaagaactagattaaaagaatacccaggcaatccggtgccctgctggctctctttctcatcaggggctgctgcctcccaggctccccaccaaaagctgcttcctgagccctgggaagtggctgggattttgccaaacagcagtaatgcccccttaggccaggcaccaggatccctaaggttgatggcacgccataggcagagggaagcagagccttcacatcctggcatcagattccaccaaaagatccctagctgctgtcacttgcaggcaaggaagggatttttcacagccaggatggggattactgctgcggcgctgcctcctccagctctgcagaaaacagtcattcctgctgcactgtctggttgagctgctgaagaaaagccgacttgccttccagcccacccacgctctcttaacctccactgtgagctccgattgagcaattctcacatcctttcccccagggtccagacctgcttagggacacaatccttctcagaatggcagaaaagcaagctctgggggccttcaagaaagcctctagggccacagaactgggcatgacatcaggacccaagactgccccatccccagtgtgctgctgcaccctactttattaaagaggcagacaggagtggaaggagaaatccaacgttcctggagcccctgccaccaaacccaagg

SEQ ID NO: 913 - DNA, 9507 bp, Homo sapiens
tttgtctagcgtcttcatttcaacttcttgtctgttagcctcttcatttttccaaactttgggtggatcgtgaggccaggagttcgaaaccagcctggccaacatggtgaaaccctgtctctactaaacatacaaaaattagccaggcatggtggcatgcgcctgtaatcccagctacttgggaggctgaggcaggagaattgcttgaacacgggagacggaggttgcagtgagctgagatcacaccattgcactccagcctgggcaacagggcaagactccgtatttaaaaaaaaaaaaaaaagtaaaatgggctttgaaatcatatacaccttggtttgggtctcaattctgaacttcccaggtgtgagacactctttatgcctcaactacttcataataatagctgcttctcagggttgagaaggtagggctggagggaccatggaacaatgggtatgaaccattcaagtgccttctgatgttaggggctaactacgccctagtgaagacatttcctcaccaaacattttccaatcacaatcatgtacccagcttgaaatgtgtatctattttgtcctttataactctaagccaatcctaaaaactacattatattgagtatgtactatttgtcaagcctttttaatagcatttgcatatttttattttatttaggtttcacaaaaccctctaaagttagtactactgttgcttagagaagggaactggtttgttcaagtttttagcacttctttgttggttaaactgattaattaatccatgcattgcgtgtcacccttctgagatagtgtatttatattcttacaagagccttctggagactgaatactttttctccgaaggaggaccattaataagggaactctcaggtatggttgcaggctgacaggggttgtgctttgtcacaggactctggacacctttcaaattcttccatttacacatcagcttatcccttctgtgcatgatctattttctagacccatctgttcccgtgcatgtggtgttatttaatcaagaaaatattttatctcatttcctctttggtgtggaaggaataattcgacagcagtaaccctcaagcgacaatgtgcatcaagagaaaggagatgaggttgtctcaacatttaaaatgctcatgtgccacaaatcagctgctttacctctagggactgtccctaatgacaggttcccttacgtgctgaaggaggagggcacaatatgacgatatcctttgtagcattgtctgaaatcatccaacagttcatcaataaggaatgggtaagtatacaatggcagggccatatacgtggaatattacaaagcactaaaaagagtgtggcagattcatatgtgttataatggctaaacattattgctgaatgaataaggcaaattgaagaaaaatggatatagcatgtatgtacacacacatacatatacatacacatctactctaagatcacaaaaagggccaggcgcggtggctcacacctgtaatcccagcactttgggaggccaaggtgggtggaccacctgaggtctggagttcgagaccagcctggccaacatggagaaaccccgtctctactaaaaatacaaaaattagccaagtgtgatgacgcatgcctgtaaccccagctacttgggaggctgaggggggagaatcgcttgaacctgggaggcggaggttgcggtgagccgagattgtgccattgcactccagcctgggcaacaagagtgaaaactccatctcaaaaaaataaaataaaataaaacacaaaaagtgctaacaattatctctaagggcagcaaggagagaacctcattatatgtgtatttttgtgggtggatttcaaagagggcgttagtcttttccattatgtttaaatttttgtgatgttataattattatggatatacagtaattaaaatttaattaaaaatccaaactcttgcaatttctttttttatttgaacaatgaagtacaatatttttaaatgggaagattttagaatggaaacttgaaaaagggttctgtattcagtgccataaaaaagaaagcacatgagattgggagtcagggcgttcgactgtgtgacctcaggcaaatcacttccctcctctgggtctctgttcctcctctgtagaatgaggggtttgggcctagtcaatggttttctcattactttccagtgccccaggatttgccagaggtggctcaggtgccattgcaaagtgtatgtgcatgtgttggggcagggggcggtgaggcgtggagagacagagatagagaaataaagacaaatacaaagaaggttaaaaggagagagagagaaggaaggagaaaagaactgaaggcggagaaagagagggagagagaaaaagagagagtgaaaagattttcttttgtaaaagaaccactttattcagatatgattgacatgcaaaagagagagatttctaagatccattcggctcagctattctaagcagaggcaagtagcaacagaagctagacaactggctttaaatttgtaccctgtgtgttgcggggaggcagtggagaagcacctggctggaagttagagaacttgccatcggcaagaacagattcagcctgaactccagccatctggccacacaccggtacctccatgctggactccagagacacactgatgcttccagtcctttgtgtcgagcagaacaggcatgagaggaggaccagctgactggcctttcttcaggctctgtgagactggatgctgagttccagcagcattccttgtcaccttctgcttggactggctccgctacactgggagaggggctccctttcctggttttcaagcccctggaaggagagcagagcttaacttccagaagcagatcattactttcttcaaaaccatctccatctggacttcagaggagtaagcataccataatcagtgaaagaaggcatttgaaagaactgcttggtctataaaatgctatatcacatagtggctgaaaaatagtcattgaaagaatacattcttatgacttttcctttcaaagaagaaacgagataatggcaaacatttaccttggcattactagagatttgggttcaaatcccagctttaccacttaaatagtgtgtgtgatcttaagcaataatgataatgatagtaataattaataataatacacttgtgcaccagcctctctgctaagtgtttaacctttattttcttattgaattctttcagtgacactttaagatagatattaatacctccattttaaagatagagatgtatgggctcagagaagctaagaaacttactaaagtcacacactctaagagtgccagggtcaggagttgaacccagatccacatccacattctttgaaaagcattgcttttaaccattctaaaagacttctctgaggccaggtgcagtggctcatgcctgtaatcccagcagtttgggaggccaaggcggatggatcacgaggtcaggagttcgagacaagcctggccaaatagtgaaaccccgtctctactaaaaatacaaaaaattagccaggcgtggtggcgggcacctgtgatcccagctactcaggaggctgaggcaggagaatcggttgaacctgggaggcagaggttgcagtgagctgagatcgcatcactgcactccagcccgggcgacaatgcgagactgtctcaaaaaaaaaaaagacttttctgtctactgaagttcagttcttcctgtcttgtgagatgatcatgaggatcaattggaccaatttatatgtcctgtcctgaaatccagaacctggaatgtatcactaaaagcaagtggaacagagaaaaccatggctttttacatggagggaaatcttttattattaatactaaagcacacctgtggttgtgatttttgtgattgggtcacctcactatgggcaggtggcattttaatcccttgagattgtgcataaagatttttaccacctttgaaatggaaattcttcttctttcccccaaatatctccattacgctgctatactagtaggacgggcaaagcacattcaagacagacagagttggggccgggcacggtggctcacgcctgtaatcccagcactttgggaggtcgaggtgggcagatcacgaggtcaggagatcgagaccatcctggctaacacggtgaaaccccatctctactaaaaatacaaaaaattagctgggtgtggtggcgggcacctgtagtcccagctacttgggaggctgaggcaggagaatggcgtggacccaggatgtggagcttgcagtgagccgagatggcgccactgcactccagcctgggccacagagcaagactgtgtctcaaaaaaataaataaataaaaataaatgacagagttaggaattctgcaatgcactcctctggctgtggccactgctcccagagtgactatctctgctcattcattcattgctcctctgggaattggtagtctccatcaccgtgttgccaggcaaccaaaacagcacgtgcctcaggaggtgaacaaaccaatcaaaacacttgaaggaaaagctttacctggttggcctccaagatggaaaaggggctctctgggtggactcagggctgcggctgctgggatcagcatcagagctggagggaacccaggaaactagaaacctctcatttttgtgtcttaagtggtggcctgtttgactgtgaagtccacaaggttacaaagaaactctgtggcagagccaggaggacaagttggatctcccagtcttagtctagtgtttcatcccttatacctcatcgccatcatttcaagtcatgtgtgtggcactgtctatgtatgagactcctgcttgcagtgtgagggatgcagaagccatttagacgccattcctcattcggccgtctaacaatgctttatttcacttccataatgaaggcaatgaagcatagtgatgaaagattcaggcactcacagccagacagagcacagggttcagctcagcccgttactacttatgggagaatggatattacttaacctgtctgtgtcacgttttctcaaataaactgatgttaagtatgagaattaaagcacaaaggaaagttcggtaaatgttggccatcgttggagataacacttggggctcttgaacttagactctgaaactgggctgcctgggctcaagtctcagctctgcctcatactcaccacatgatcactgccaagttacttacaatttccaggatttgtttccctatctgtaaaatgagtgtaataattgaacctattaggttcattatgaactaaaataatttcatatgcataaagtgcttagaatactttctggtacaccataagtaccctataaattttagctaatatgatccatcaacaaatatttattgaatacattgtatgtactaggcactgacctaggagctctagatataaaacaaatcaaaaaaataggtaaatgtctctctgcttcatgcaactatgactgttattacattcttttttttttttttttttgagacggagttttgctcctgttgcccaggctggagtgcaatggcgcgttcttggctcatggctcactgcaacctccacctcccaggttcaaactattcacctgcctcagcctcccaagtagctgggattacaggcatgcgccatcgcacaccgctaattttgtatttttagtagatggggtttctacatgttggtcagactgatctcgaactcccgacctcaggtgatccacccgcctcggcctccgaaagtgctgggattacaagcatgagctgccgctcctggcctgttattacattcttaataatgtctgtttatttctcaattcctgcaaggacctgcaattcctgcaagcatcttaaatgcccagtatgtgtttggttcacatttgtattacctgtgcttggcactgggccaggggtctagtacatgttcagtaaatatttgtttaatatacatatatatttgtttaatatacatactgtgctatgtatagaacaatggtttgcaaccagagatgacttcgatccctctggggatatcaggcaatgtctagggatatctttggttctcacagcttgtggggtgggttagagaaggtggtggtggtggtgctactggcgtctagtgggtagaggcaagtgatgcttttaaaatcctaaagcaaacagcacagcccccataacaaagaattacccagccccaatatcaatagcaacaaactgaaaagccctggtaatacaacagagataaacaaagccttgtaatgaccccttccctccaaaagctcttgttctgtgcaaccgtgagagcatagcacactaagtactgtgcagggggcgggactgtgagaacatagagaagaggcacctgaacagctgaggcttctggcggaggtggtgtctgaggggaatcttcaagaacatgtgtgagtgttccaggcacattttgtgtgttctgggagaagttataggacttggggaaatgtgccggaagggtgaacagcatgagcaaaggctcgaaagtaaaaagtagtttgggtttcttaaagtgcaacaacagaacaggagtgggagcagaggcttggcaggcaatcgtggagagctgggcgtgatgtgatcagccagaatttccaaagtctgttttctaaacactagtccttcaacacatgccagaaataaaaaattaaaaaaaataaaaaaagccaacatcaaataagaatgagaaagtagtgaacgctacctcctacccttttggagatttgcaagacatgttggtatcatgcagcctctgacaaatcctgcattaaagaaacttgattgatttcatttagtttaacccagagtcttccaaaggtttttgaccatgagaacttctttcccagacacttatgtacctggattctacagaccccactttgggaagaggagccacaggctatgaagatatttatgggttgcctttaagaaatacagtgtctggatttgagttttgggaagatctctctggctcctatgtgaaagtggattcagtaggtaggagatgtttatacacgttgttaaagtgtgtgtcatgatgctgtgatgtattgattcctgggctgtctcctccactagactctgaaatttttgttgtagggggcacatttgtcgatcactgtatcccagtgcctagataagctggacagataataggcacatgctcctatttttaaatgaatacatgcatattgttttcaggcattgtactacacattgaggctgaacaagacacatggagcccctgttctcacacagttaacagaccagcaagcatgtagaagatactttatattaatacatgtttatggactggtggaatgactagcataataaataagacagaaagtggcaaggatcagaaattgggaagggcctatgaatctgtactggaaactagttacttgattacttctgatgtccaggggcccacgtttgggaactgctgtgctgccagtcagagatgaggtctctttaattggcctgccgagatcaaggccccagccttcctacctggctgttcctgactcttcccacgtggggctatcaagcctctggattctctgttctggagctactacccggccgtttctgatcttgttttgatcccctaaatgcagattggagcactacaggtcctttatagcccaaaccctgatgggaaccatcactttactggacaccaagtgggttgcttgcttctggtttccacctccctgccctccccatgcagaacgtactcctccctcatgtgacaccatcacatccctgggtccaaaagactgtctctcgagatctgctcaaaaatgcctatgaggcaaaacatatttctgttttaatgtaggctgtgtacacagttaagctctgttttatttttgatgtgcaaattaaaaagaaaaagaggaggaggaggagaaggaggaggaggtgggggaggaggaggagatgtctgtatggtattttaagagaggctggagcacttttcttcattttgtcctggataggattttccagggaaatgaaaaagaataaaaaggccctgattgactggttcatggcaaggggaatcattttcttagctggctgatcaggagacaatagatagttgtgattgaattaactggtggtttttaaattcctgctggtggaaaaacttcaccagaatcatttgggaagctcataaaaaagtgatgctcaggtctcatctgagatttattgaatcagggctctaaaggtaaagtaccagaatgtatatttctaaaaatattccgtggagatactgatacatagcctggattggtcggtggtgggctagtgtgggtcagtgatggagcacttctcagcttggcacaatctcattctctcataaagccaattctgactctctctcccaagtctaaatccaaactcagtgtcacccaccccagaccacagggcatagcctgaagaccttttctcatccattctccggtccagctcatgccaatgaaggttgttcgtagtcctggctgtcaaacactgatctatgaaacgccagggctggccttcattccagctgcaccacctgttaataatgctcagcacagacatttctaggcaagggagaaaaccagtttttcctgcggccgtctcgagggatatacatttcctatcattacagttcataatttccctgatgatgggaacatcatgtcaactctcatccaatttaaacaggtcgtctgttgaccgattttcttcccccatatggggtggggtagtggtgaaatgccttctatttctgttcaggaaaagacagaggattttgttttatgtactttaaacttcattcctaaagtttaaataaactttgcagacattttctcatttgccttcatcaacaactctttagtacaataaagggtcttgcaggtcccaatccatctctgtagagtggggctgaaatttgaaggatctgtgtgcacacacgtaaccctgattattgaaccctggaccagcctctgaatattaaaaatcatattttagaagtccaatctaccaatcaaaaggaattttaaaggagttttaagctatgccgggttctcttgaagaccaatacatggaatccattttataacctagaacaattttctaaactcctccttaacctttccctccattctctcccacctcttagatgctctagagcccacccctcataaagtctcctccactctctctaacacccaaccctgcaacttttatttttatttcctcttggcattccttttggatctctgagcctggcttcccattcacattcttcatattcttttgaatttatatcacaaaaccctacaaattgggatagcaagccaaaacatcactgat

SEQ ID NO: 914 - DNA, 638746 bp, Homo sapiens
aggtattgatgtggacacatgcaaaatggattcaaactgtcaatatgggttaaatcacatattatacattaataatctcttccactggtttctagatatttctggttgaaatctatcaagcaaatatatcttgtccccttaattataatattagctccttgaaggcagaggacccaccctgatactcctgtctacagaccttagctgtacaggacaaatctagatgttcagtaaggactgattaaatcaacctgacctgacgggtgcaggtagagtacctttcaagttaatttattcctttgagcctcatttcttcctctacaaaatgagggtggaaattttttttcttttctttctttttttttttaaataaaaaggagtctcactctgctgcccaggctagagtgcagtggtgcgatctcagctcactgcaatctctgcctcccaggttcaagtgattctcctgcctcagccccctgagtagctgagattacaggcgtgtgacaccatgcctggctaatttttgtatttttagtagagacagagtttcaccatcttggccaggctggtcttgaactcccgacttcaggtgatccacccgtcttagcctcccaaagtgttgggatgacaggcatgagccaccacacttggcccccctttttttccctttattttagagacagggtcttgctatgttgcccaggatggtctcgaactcctgagctcaagcaatcctcctacctcagcttcccaaagtgctgggattacaggctgagctgctgtgcccggctagggattgtaattttctctgctttattgggttgttgtgagggtggagagacaatacatgtaaattgcttagtacatactctagcatcgtatagtacatcatctgctcaattgttagctattaatttaacaatattaatttctgcctcctgctcaactaggagagagcctatggaaaagagtaagtgcagcagttctcatgcaaatgtgtaggtattcgattcagcctatagaagcacactggtctgttgcctatgtattgggataaggacaacagaagatttaccttttcacctatcttcttcacttttctgccatgacagggatgctttgatgggtctgtgctttagcaactgactaggagcgaaggtccaagtgggactctggactgggagcgagggctgagactaaagtcgccacatcaggctgcttgttccgttcactcagcaaatatttatagctaatctaaccagtttcagatatcgttcaagaggtgggggtcctgcaacagcccaggcttgtgcctttaccccatttcacagagaagaaaaagcgaaaaactagagaaaaaccacctctccaagaggtaaccgcacgcagcgcggaaggctgctagtgcgcaggcgccacgccccggtacgccccggctcttccggcgcgaggtcaccgaatcgactggccactggcgccggggccgcgcatgcgctgcgctgcctttcccgggcgctgattcctgagtgctgagcgcgaacccgaggagatgaagtaaggcgtcagcttccttttgaggaaggagcagcgggccactgggggtggtccaccgggactggtgtggtagagcgtctgcggggccgaggggcgggagcggcgcggggactggaacagctcgtcccctagttttgctcttcctcagctccggccggttcgcacttacttgtctgcttttctgcctaccctccccaccccccccgccaccgtgaagccctttaactaaggtgaagctgatcaacgagctgaatgaacgagaggtccagcttggggtggccgataaggtgtcctggcactccgagtacaaggacagcgcctggatcttcctgggtgaggtccacatctttcttcctcagtgctctccagattctcctgctcggtttccgactatttcggcattttcacccttcactcctgcttacattcatcgcccaccttcatatccatctgctgtctgcccgggaatccgtgttacatctcttttctgccccatttttagttttccttccctgccaaatcagtgctcatgagagttactgtttgccatttgctgtgctaaggttcagggactgttgttatttctctctcaccctctgacccattatactgctgaggaaattggggtgcagagaagttaagggacttccttaaggtcacatagctagtaagcgcaacaggcagaactatagcattctagaactcttggtcttagccacagctccatattgctaccaccaccctcccccattccccttcccttccagaattcactttgctcctctagctcctgctttctagtccatggccacgttaccattactgtattcactttatatcacaatcagtaattgtacaagtttgatgcttcaaagaggttattgtaccaaacattgtgctaagcactttatatacatcgttttatttaactcttataataatcttgcgagttacgtgctaatatccccatcttacaaatgaggaaataaatatttggaggggaaattattccctaggaaatgcttaacagtgtctttataacctttgtctatgtgtaggtggggttaatcatgacatatgtagactgattttgtatcatagctgtaaatttgtgggtaatgagcagatgaattcaacatgtttgtggaagcagaggtttgtgatggaaactatctgctttgtccataggattttgggtggcaggaggactgagtgatcagattagtttcgttagtggtgaccccgacttccactcaaaattaattactcctttttctgtactactggcaccttacatgtacttctgtcattgagtcagacttaatttctttctttctttcttttttttgagctggagtttcactcttgtcgcccaggctggagtgcaatggcacgatctcggcgcactacaacctctgcctcctgggttcaagcgagtctcctgcttcagcctcctgagtagctgggattacaggtgcccgccacctcacctggctgatttttttttgtatttttagtagagccggggtttcgccatgttggacaggctggtctcgaacacctgacctcaggtgatccaccctcctcagcctcccaaagtgttgggattacaggcgtgagccacggtgcccagcccagacttgatttctttaagggcagggcctgttgcttactgtttccacccctagtgcctggcctagtgcgtggtatgtagtaaacacttggtaaatgttggtggaactgaaatgtggttttctcttctaggagggcttccttatgaactgactgaaggggacatcatctgtgtgttctcacagtaagtgtcctttcatttcctgcctcctgagtcgacagagtactttgtttctgtaatacattttgtggcatcacaaaaaccacttattttcactctaggctgaatggcatccctgcatggggagggctggagcttctgttctagatcagtcccaggacatggttctagaatgttctgtgggagatccaagaggtttgttaatttgggagggcatcttggggatcctagtctatttctgttgtttttcactgaggcttgttcagcctgggcctagactggaacagactggactccttgggctcttgcaaactaggggtaacccatggtcacagggcccttctggcccttacctgtgtggcgtcatacgattggggcaaagcacagaggaaattggggtaaaaaacagaaggtcgtagtttgctttctttgtttctcgatgagtgtaaggttagtgagcaaaggcaatctctgcctggaggctgagaatcacagcccgaagggaacaagaatgaataggagacctgtatattcttcattctgctgaggtgttagcagcagcatttcatgggagagggtgttggcagctcatactggtagtagcagctggtaggagaggggctgggcagctggcctgcaaccccagagctaaacagcacagttagtccacagggctagaggaccttggcacaggtgcagaggaccactacgtttgggttttgtagtccttggaagcatagtactgtttcagagaagttggacagcatgtacaggtagcggaccatggcaaaaggggctggccaagcgaacaccggtagcatacactggcagagggattgctatgggaccatccatggacagagggccctggccgagtggttgagccacttatggggcagcaagacatgggaaaggaattgggcaatacccgtgagaagaaggctgtgatagagaacctgggcaacccacacaggtggagggccctggcagggacaaagattgcttcctccaacttctggatgttgggaagttcacagcaggtgcagcctataatttctacccctttgtggtacttctactcagccttccatcttggagctgttctacttgcattaagtaatgatgagctaacgtgtgcatgtttgtttattctaattatctattctctattctggttacgcacgttgctctccatgaagattgcctttgccgctgataacagtgcctttcaaaaaactactttgttggctgggtgcggtggctcacgcttgtaatcccagcactttgggaggctgaggtgggcagatcacctgaggtcaggagtttgagaccagcatggccaacatggggaaaccctgtctctactaaaaatacaaaaattagccaggcatggtggtgcgcgcctgtaatcccagctactcgggaggttgaggcaggagaattgcttgaatccgggaggtggaggttgcagtgagccaggattgcgccattgcactccagcctgggggatagagcaagactcccccatctcaaaaaaaaagaaaaaagaaaaaaaaactactttgttttctgattttggaaggtaatacatagtcattatagaacatttggcaaaataaagtataaagaagaaaatagaacatactcttaaggaaaaccttaatgttttggcatatctctttatcatttttaaaaaaatgttggacattatttccaatggtttgctattatgaattatactgcaatgtacattatagtatataaatttttgtatgcatccctcatggtctctttagtgaaagaggaatatggatcaatatgttagcattttaaagatgttttataaacattgccaaattgctctccaaaaggttgtaccaatttccacactcattagaatgcccatttttctgaatcctgattaacagtgactattttaaaaaatatttgccaaagggcttctcattattactttgctttgcctttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggtgtgagccaccgcgcccggcctgctttgcctttatttcatcatcagtgaggttgaacatctgtttatagatttgcagcccattatttttctttgtaaattgtctattcatatcctttgccaactttcttctacaagtattttccttattttcttgttgattttacatgagcccttcatgtatgaaggatattaactctttgcagtactttgttgtgtattgtattacaggttgaatatcccttatccaaaatgcttggggccaggcacggtggctcacgcctgtaatcctagcacattgggaggccgaggcaggtggattgcctgagctcaggagtttgagaccagcctgggccatatggtgaaaccccatctctactaaaatacaaaaagtagccaggtgtggtggtgggtgcctgtagtcccagctactctggaggccaaggcaggagaatcacttgaatcgggaaggtggaggttgcagtgagctgagatagtaccattgcactccagcctgggcaacagagtgagactctgtctccaaaaaaaaaaaaaaaagaacaaaatgcttgggaccagaggaccagaagtgtttccaatttgtataaatgtaatgatctatcttggggctgggacccagatctaaacataaaattcatttatgtttcatatacaccttatacacatagactgagggtaattttataccctcaatattttcagtaattttgtgtgtgaaacaaagtttgtgtacattgaaccattagaaattaaaggtgtcagatatggaattttccacttgtgataccatgttggtgctcaaaatgtttcagactttggagcattttgaattttggattttcagattagggatgctcagcctgtactatggacttattttttcttaatttgatatgttatacttatcattattctttcttgatgctcaaattttccctatttgagggtcaacatgagttccttcaagccagtgcctgtattctttttttttttttaattcttgttttgaaataatttcaggcttaatacaggaacattatcaaatggcataaagaatacctgtatctccttcacccagatcccccagctgttagcattttaatttagttgattgttctgagaaagggccttgctctgacacccacgctggagtgcagtgttaagaccgtagctcactgtagccttgagctcttgggctactgtcatatgtaatctacagaaaggtagtgttacttccttttttcatttcttgtatctgttttatctaattgcattggcctatacctccaatttagtattaaatagttcctaaacttagttgaattggctctagtatttctcattaagtaggatgctggattttgggctgaagtgtatgtatgtgattatgtaacatatctatcaattcctattttctttttatgactttatttttaaatttataaacctctaacttacctggaatttatctttttgtaaggcgtaaggtagtttgtttttctaatgttttttctttttttttttttgaaacagggtctctcttgctcaggtttggagtgcagtggcatgatcctagctcactgcagcctcgaactcctgggctcaagtgatccgccccacgcaccctcctgaatggctgggactacaggtgcacactatgcctggctaattaaaaaaaattttttttgtagagacaggggtctggccgtattgtccaggctggtctcaaactcctggcatcaagtgatcctatggcctcggcttcccaaagtgctggtattatgcacgtgagccaccgtgcctgatcttttttttctatttcctttttgttttcctatttctatcttcctttttgtttgtttgctttttttagagacagggtcttgttctgttgcccaggctggtctcgaactactggcctcaatcctcctgcctcccaaagtgctggtattacaggtgtgagccaccatgcctggcctttttttttctatttaattctgccttcttgtttgtttgtttgtttgttttagagacaggatcttgttctgttgcccaggctggtcttgaactgctggcctcaaacagccctcccaccttggcctcccaaaatgctgggattacaggcatgagccaccatgccgagcctaatttctgcttttatctctattaactgccatctgctttcattaggtttgctttcttcctttatgttcatcctttctcttcacaataaaattcttttaaaattacaaattttcctgagtatgacgttagccacatttcataagttttggtgtatattctcatttttgctattttctaaatagtctgccatttatttttttttaattttgcttcgtcttctctttcatgctgttgttaggagagtagctttcaagttctagttaggtaacttttttttatttaaaatatcatttccagctttataacattataactggaaacatggtctgttctgttttttgtagtataattattgaggtttacattgagacctaatccatagtcaattttaatacatgcttcatggattcttgaaaatgtcatcttgtaggattcaaagatatctatgtatctaatagtcctacattaatatttgttattataacagagtaattatgtatattaattaatctgattttagtttatttctgtccactttgtgcgtgataaacttcaaagtgatgtgttaaattctcccataactttctctattagtttctttttgcatttcaaatagcttttttaattaaaatttttgatttcttaattggctcataacgttttcctggcttatacctttgttgtgtatttaggcctttttcagtgtaaaataatcttcttagtctcatgtgatatttttattttggccttgaattagtctttgctctggatattgccacccattttttaattgggggttcctgttcttgtctgactttttctttgcaacctttctatgtcatcttgttctagatgcatctcttgtatacactatattatttgaattttgttttattaccttatctgcatgtttttgccttttaagtcaacagtgtcttactcttttataaaataaatagatatggggagattgttaacattaatctcgtgcgggacaagaaaactgggaaatccaaaggattctgtttcctctgctatgaagaccagaggagcacaattctggccgtcgacaattttaatgggatcaaggtgagtgtgcttattaagcaggttggttggacttttttcccatgtataggggtttcgttttctacctggttcccgcagacacaagggcagcacttgtgagcttggtgtgttgcgggggctgcagagatgtggagacactggtcaagaagagattccaggaaataattctgttggctcatggtcctgcaggacttgcttcttttccccatctgttaacaaaccatctccccaggagcataggcaccaggcctgcctctcatccaggcctctgtttttcacctttcttttattgtctactgtcatctctggtgtactggaggatgaagagactagcaaacattgctcttccatattgttgtgtgttgggggttttgggcttcatcatggcctcataatctagtacatagccatgtatgtctgtcatatatctccagtgacctagcatattgggccctagaaattctctagttaaaatctgatggcagattctacaaaagtaatttcatcctgaaattttctccccccagttccctctcatttccactgtcataagtgaggcactgagttcttagaaggagatagcgcaagtcaggcttattgatgctccatgtggttgctgcactcatttaggaaaagagctgcagttgaacagtgtcacagagttggtggggggaggcttgagttggagagtttgtcactgattcacgagtatggaatagctggagattatagaacagagtggaacaaggttctaggcttgatgtttaaggaagccagcagtcagagggcatcactgtaaaaggaaggttttccaaagtgtttcaaaatggagaagaggatacatgacagaagccacttaggccttaaggtaaaaataaaaatctgctcttgtattggaacaataaaagccaaactttaaattttggatgactttgcctagggagtaagtctgtatctgcctaaaaatagaatatttttattttaagtgaggtgttaattttttggggggtgggggagggggacagggtctcactctgttgccctggttggagtgcagtggcgtggtcttggatcaccacaacctctgttgcctgggttcaagtgattctcctgtctcagcctcctgagtagctggaattacaggtgtgcaccaccatgcccggcaaatttttgtatttttagtagagatggggtttcaccatattggccaggctggtctcgtacttctgacctcaagtgatccacccgctttggcctcctaaagtgctgggattacaggtgtgagccactgcgcccggccagaggggttaatattttgttgttgttcatctggagagatgtgattcgttgtgcaagaatcagcgtgagctgattgttccagtatggtggggctagagcaaggtgtgagggcttaagaaaaaagcaagtgcccttttcttgattcctttctccctccaaactattggtctgactttgcctcctaattactgggtggagaaagcagttgtagcattaagctagatttcaagaattccttctagttgccagaccttcctagggtatgtttcactgtaaacttaggttacagatcaagggtgattcattgtgcatctaaatctcagtcttccctgatgcttgtgctttgaggtagttttcctagtctttttcattttatggcacatacagaacatgaagatatttgtatgctgccccagagtaaagtgatgaggctgctggtacaactgccccaggcctcatctggctgcactgagagctgaatgtattaatatttaggtgtacatgctatgacacaccagttggacaggtctgctttagtgacagaatttaacaagaaggtaaaggatgtagttcaaatcatggttctctgtagcttgtgttcaaatagtttgacagtttggtatgagggctgtcttcactgaagcatcgcctgtcttgcttagatcaaaggaagaactatccgagtggatcatgtgtctaactatcgggctcctaaggactcagaagaaatagatgatgtgaccagacaactccaggagaagggctgtggggctcgtaccccctcaccaagtttgtctgagagctctgaagatgaaaaaccaacaaaaaagcacaaaaaaggtaaagcattaagacttaagagaagattctgggtggtcttaatgtctgctcttccttgcattcactgatagttgataatcaactcaagtgtgaaaggggaaggtgtggggaagcatagtttaattgggaaagcagggagtatcagtggaaggctggtgctatgggcagaattgtgtctctccccaagttaatatggtgaaatcctaaccctcagcacctcagaatgcgactgtatttggagataaggtctttgaagaggtaactcaggatgggaattaccttgtacagccactcgacatatcaaaggtgacagacatccaagttggcttctcggaggcactctcctggaggcctagacagtggctgcttcatgctgctgccaaggttgttctccttatgcacattccccacttcctagcatgtgaaagtttctgtcgcccaggctggagtgcagtggcacgatctcggctcactgtaagctccgcctcccgagttcatgccattctcctgcctcagccttctgagtagctgggactagaagcacccgccaccacacccggctaattttttttttttttttttagtagagacggggtttcaccgtgttagccaggatggtcttgatctcctgacctcgtgatccgcctgtcttggcctcccaaagtgctgggattacaggcgtgagccaccgcacccggctgtgaatgtttttgaactgtagcacctgtggttgatgtaacgtattcagaaaagaaaggtgctttttttttttttaagggagttcttttatttttttcccttttcttatttactgcttctttcttttatcctccagacaaaaaggaaaaaaagaaaaaaaagaaagaaaaagagaaagccgaccgggaggtacaggcagagcaaccatcctcttcgtcacccagacgcaagacagtaaaggaaaaggatgacactggccctaagaagcacagcagcaagaactcagagagagctcagaagtcagagcccagggaggggcagaagctccccaaatccaggacggcctactctggtggagcagaggacctagagagggagctgaagaaggagaaacccaagcacgagcacaagtcctcaagcaggagggaggcaagagaagaaaagaccaggattagggacagagggcggagctcagatgcacattctagctggtataatgggcgttctgaagggcgtagttatagaagtagaagtaggagccgagataaatcccataggcataaaagggcccgacgctcccgggagcgggagtcttcgaatcccagtgaccgttggcgtcactgaagacttcagctgcacagtagatttggaaataattatgttttttaaatgcagtcaaattcagttgggtggttactatttttgtatctaaaacttctggggctggattcttttaatcccttgactatttagagtcattgggagggctgcagtttcaacagctagatatcctggatattgtttgcaccatccattgtccctgtaccagagtatgtatcctgaactttggttcataaatatggctcttgaacccatagaccccagttgaagatggaattttcaggaaagggaaaatactagataattctagaattctagtcttcgtgttagatgtttatagcccagcatcttgggacctttccagttactaggtttggacagcttgatgtgaacgaatgggataggatttttaaaatcagccagctccatgcccaaaccttcctgtttgcagaactttttaatgtcttttctttttcattaaaacttttttgttcgatatgcctctttccacattttttccttgcaatgtatttattatttatttgtatttaggtgaaattcacataacataaagttaaccattttaaagggaacaattcagtggcatttggtactgaacatccacagtgttgtgtaaccattgcctctgtctagttccaaaacattttttatcatcccaaaatgaaaccctgtagccattaaacaagagctccccgtttcctccctcctccctgtccctagcaaccaccagtggacttcctgtttatgggtttgcctattctggatctttcataaaaatggaattacacaattgtggccttttgtgtctggcttctttcacttagtgtagtggttttttttttttttttttttttttttttttaaatttgagatggagtctcactctgtcgcccagactggagtgcattggtgcaatctcagctcactgcaacctttgcctcctgggttcaagccattctcctgcctcaacctcctgagtagctgggattacaggcatgcaccaccacacctagcttatttttgtattttagtagagatggggtttcaccgtgttggccaggctggtcttgagctcctgacctcaagtgatctgcctgccttggcctcccaaagttctgggattacaggcgtgtgccaccacacctggcctaatgtagtgtttttgagatccatccacattgtagcatgtatcagtacttcattcctttttatggctgtatcatatcccattgtattgatagagcacattttgtttatgcactcatcagtgagtggacatgtgggttgtttctactttttggctagccagcttcctttttgtattccagacataccaggctaccttttagcctttgtcctcttttcaagtagccactgttggtgggatgggaaccctttgccatcttcattgtctgtcctggtctgcctggcagttccttcttcttttgagttttagctttctcctttatctatcagtctcttaacgagtttggtaggaactaggtcacaggacctttaataaatactccctggtaaattatgaaaggttgaatttctgaccctgcaaaatgaaagaccagagctttaatagtgagtgcactaagttggacttccctttgtgttaatttggaccctcggttagacatgcaggagagttggagagtttgtgggggatgtagtaggggagggtcgaggagtctgggaaagctgtcagactatgatacagatctaacctctggagaagaaataggaaggaggggtgggtaggaaaagtcttgtgcagttctaagatggtttcagctagaccaaagtgagttgagccagagtcacctgtcagaggagccctgctacatcagccatcataagcagttcatgctattgcctcttggcctccatctcagccatcgtggctgctgtgctcatgtgcccattatgccattgctgtggtagccagtgacaaaggcctgtgaaccgggttaagtcatttcgtctgcttgcttttatatgtggcaaggaattggatcacacaattatgagggctggttaggcaagcctaaaattcatgaaacaagagctgacactggtgggatttcttcagggaaatctgttttcctcttgaggctttcaactgattggttgaggcccacccacagtatcaatggtaatcattacttaactgatcgtagatgttaaccaaatctacaaaatccactactcccccgttatcaacgggatatgttccaagacccccagtggatgcctgaaactggctaatgctgaaccctacatatactatgttttttctgtacatatatatgataaagtttaaattataaatgaggtacagtaacaacaataacagtaaaacaacagttataacaatatactgtaataaaagtcatgtgaatgtggtgtttctcaaaatatctcacgtatgtgatattttccgacaacggttaaccacaggtaactgaaaccacagataaggggggattactgtaccttcacagcaacaccgagtagcgtttgattgagcaactgcgtactataacctatgctgagttgacacacaacagtaaccatcacagtttactatcttgtctgtggaggggttcgggggagcagcttcagaggtttccacatggccttcctcactatgacagctctcactccaacagactaaggagccttttccacatggccttcctcactatgacagctctcactccaatagaccaaggagccctgggggcattcattactcctactgccaggtcaattccagttacacacttagggctaggaaatgaccactggctgggtcagcagcaggcccaccgtgaatcctgttttggccagaatttcagttatcacttggcctccataagcccccagtctaaccagggccgtgatgatgcttcctgtctctaggtatcagtcaacttagatcttgggtccagtgttccgccaaatgtttgagtattctctccccagtgtacatatacccaagtaagtggctgtaggtccctttggggaagtactgggcaaatcattacatactaaccattgtccttcccagggatccagccacctctttccagacctgaaaactggctgaagtatggcagctaagcaagaaagtaggactttttattggggcaagctcccttagcctcctgctcctccactcctcttcagcttgtagatagggagcaacacgctttttgacttgctcctagggacaccatgttccattagccatctccagaactccctgaaggtaaagcccccatggctgtccttcagaccttgtggttcgctctggtatttgtggcctcctgccttctggaggttaagcacttctgtctggtgtctcttactctggggccccatcatcccctttgacactgatgagcacagctctgtgatggtctctcactgtcagccttggcgtgcagaggtggccacctctgaacttaatgatgctggtgtccctctcaccagtgccttcctgctgacctcagtgcatgaggtctcccctgcccccccatggaatactgtcttctggtgggcttttgacttcatgtaatctgtccaccccagcatgcccacttcccttcattccttcctctgccatctgccagggcagcttaggtgtttctacttggcccagcattggccatcgctttcactgggcctttgagatccatcttattagaggctgctcacccgctgtgggccttgccaggaggttaaattgtatatcctgagaaagggctcccaagtctgaagttttgcttttctggctctcttgatatagtacctgtgaaatccaaacccaatacttccttgacttctgctagcctatgccagctaatttttgcagctctttggtgtatgttccctcctttattagggccagtactttcttagccagtttctgctgggattaaaccctagttaccagtttagtaaccagagagagaaagagaggggctggggacagctgtgagtgaggcactggttgcctagtgtggggagcagcgtctgcagcatcttctggcacaggggaagtgctagctcttagtagggaagcgtgggcccctctgcaaactgacagttgaaccagtgtgtttgcagagccagcaccctcagaggcatctgccagatgttcccatcccaagtctttccaaccacatgaagtcttgtggccctgacttcagcagaacggatctgctatgtgataaatattgaccgttacatctctctggacttgggcaacttgatcacatcttctctttggcttagccatatccattcctccactgcaggagatcagggcctctttgtaagctccatggaagccctttggctctcatgaaacagcgtttagttgcttgttaactgtcacccatttctcattacctgttgcagggcatcaagacaatttaataatactcttaagttatctagccatttccactgtctttgcaggccttatccctcccagattttcaaaagtctgagccaggatacctgcaaggccattctcccagttttcccaggttatctccacagacatctttagcagttggactaccaccctgtgccagtgtccattttaccaagcaggcagcgaagccatcccagaaccccatctcgccattgcctgtattcttggaccaccaccaggaccattcatgttagtttgggttctctgaaaggcagatgccaagatgagattagatgtatgagagatttaccaggggaaactcccatagggaaaatggggagggagtcagagagagcctagatagatgcacatctaacccctgtggaggacagagagaaggaagggtgggtaggaaaagtcttagactacggggtgcagttctcaaatttgtttttatttcgtttcattgtaaattgacaaattataattgtacgtatggggtacaaaatgatgttacgatttatgaatcataacaccatttgtggaatgaatacatcaagccaatattcaagtgatgcagttctaaggaggtttcagcaaaacaaatgtgtttctcaggagggacggttcaccacgggccctgagtgcccctgcacgttcttggcgagtatcttaaactaatgcggaaccattgctgcagatagtcactgtaaggaatttaaaattgtattagtcttgttcagactgctatgtaacagatattgactgttacatctccctggacttgggcaacttgatcacatcttctctttggctcagccatatctattcctccactgcaggcttcagaagcaatggtaggcctgtgaccaacaaatgaccccatgtgggctatgagcctacatggagaacaaacacccactagtcctgagaaacttcagataagaaagggagtatgctgtggaacttctcaaacctcgagaatctggccagttctctaggtttcagaacatcctgagacacacaaagtaaaaccttaagcattattgattaaactttcagagctgcacatttgcacgttagctgttaattttagctagggtgagcaacacccttgttgactattgctcctagggacaccatgttccattaaccatccccagaactccctgaaggtaaagcccccgtggctgtccttcagaccttgtggttcgctctggtaatataagctgggaccctccaattgctctctgaagtctcacccatggagtggacacactgccggggacctgttccaactaggactccagatgtctgtatccaggacttcccagcactgcttgatctgggtgtaggtattctccccagtttgttgaaaaaaaaaacaaacaaaaaaacccgtattttccttttacttttcccttttctcctactttagcttttgctaagttaactattatactcttttgttatgttgatcattaaactttgaactgcatttgagtgtaatattgcagtttcttttgctcgtgaatcctcaaacccaaaatgatgaaagtaaaactttcagcaaaacagtcacataggcaaccaagtagggcaaggtgaccacagtctgactactatttaactgctcacttcccaggggaggggcattggccactttgctcattacccaaaaagtcctgagccccttgatcctaggttcctcagctgtgattcaactgcctgtatgcgtagcgtccatctgagcctgttgcattgtcccgtggcacttgggggcaggggaactggaaaaaccatactgatgctcatgttgcttgctgtgttgtaataaactgtcttgtttgaacccattaaatttcactgtctatgttctacacctatgatgaagaaatggcaggtttttttctggtcattctctatgagatgggggctcttccttgacagcatccctgacccaaagtcatgcgttaggggagtcctttgcttcatagaaatggcctgacttagtgtctctgccacaccaggagatgcctgtagaaagtttggttttggtgaaaatgcagtgatgcatggtgagtttcagccactttggatttcagctgcagtagtgttgaatttcagagctcagtggtcagctacgctccctgcagtcagaggtctgaggggcacagatatatcttgctctaggcccagcctgaaacaactcactagtcattgactttaattaacctttgggaactgtgaatgtttacttgttcctttcatgagttgacttcacagaggacatttggaattcattagtggacaaattgctagtgacctcaaacctaaacagccacattgagtgaagtgctcatgaagaatgctttttagtttttagcatatcaatatttttttttgatgtggcctaattaacacctgaatctgtcagtctctttttttgtttgtttttgtttttgttttctgcttcctctaacgtattgagacatgtacctagtaagtacctgtcttggtagtttatggactcatgaatcctaagttggaaataatccttatctggtacaggccattccttctgcaaacatgttttgaagctctttgaaagaagtaacgtggtcatcatctaaatgggtattctaatgaagtggaaagtgctccccatggtgctgttatgaccaaagaataaagtcaagcatttcctggtgtcttttatctgaaaatgtaaacttagaagatataatttgaggagtgactatttgcactatgaatgatttaacctagacttcttcctcaactcaataagtggcccctgagttttgcaagtgttactggaaacagcacaaaatagatgataagagcaggtcatatttttcaacaggaaataatgaacaattacatttgtgataagcatttggtattctatagctgaaggatgatcaatagtaagtcatcaaagatacattggtccctagatggatcattcaaaatactgaagttatgtgtcaggggctataaagtggcaaaaccataggacacatgtgaattgtgttactctaaactatatgcttgtcatacagatgtatagccattgggatgtatatttaatctcaaaacaattcgctctctaaaatgaacatcagtcaaaaatttggttcctttttgttggcttagaatttaaaagattactttggggatgattgaagatgacctagcctctttaaagaagctgttcaaagaagcctgaatgaatgttttctttttttaaaaaatttttatttccataggtttttgggaaacaggtcgtatttggttacatgagtaagttctttagtggtgatttgtgagattttggtgcatccatcacctgagcagtacacactgaacccaatttgcagtcttttattccacatcccccttccaccctttcctctgagtcccccaagtccattgtatcattcttacgcctttgcatcctcatagcttagctcccacttacaagtgagaacttaggatgtttggttttccattgctgagttacttcacttagaataatagtctccagttccatccaggctgctgcaaatgccattaattcgttcctttttatggctgagtagtattccatcatatgtatatatatatctctctcgcagtttctttatccactcgttgattgatgggcatttgggctggttccatatttttgcaattgcgaattgtgctgctataaatatgcgtgtgcaagtatctttttcgtataatgacttcttttcctctgggttttttctcatgcctcatgtgaacctgaggcatttgatgtcattccattcactttaggctgggattaggatttgtttaagaaatgatattggtgatgatgataatatttctttgagaggaaggcatttatttacaagcagctaatcacaacagcaaaaaaccttcatgattattaacttaaatacctaagtttgttaggttttcattagtataccatatgattgttaaatgataaagtatactgtgtaattgttatcagagtgaacatcttactttgtgtgctgttttcacttatacatgcatttctatgtgttcatattatcactgtccttgtgattttcagttgctatgtagtattcttttctgctgatacaccacacctgtctcccacttggattgttttacttttttttacaattaatagtactgctatgaacattttaatattgacccccttaaaaatttttcatttcctttaaggtttccttggactgtgttctctaaagtagagttaccaggtccaaaagtgcagatataaccctaccttgtcttacttgctgtcagattgcttttcagaaagatcaaatttttaaaaccaccatcactgtagagttcaagtgtaattctttctgtacattcctggatttgatcattttattattttttgcttctcagaaagatatattgtgataccttcaatttattctaatttacattttctttcatggcaggtgaagctgtctgtgcatttttactatagtctattttttaaattttttctttttctttcttttttcttttttgagatggagtttcactcttgttgcccaggctggagtgcagcggcgcgatctctgctcactgcaacctccacctcctgggttcaagggattctcctggctcagcctcccgagtagctgggattacaggcgtgagccaccacgcccggctaattttgtatttttagtggagatgggatttgaccatgttggccagtctggtcttgaactcctaacctcaggtgatccacctgcctcggcctcccaaagtgctgggattacaggcgtgaaccaccacgcctggccagctggtgcaggttttgatttgctctttgtgattacttgactttggtgttctagatgaggcctatcctctctccatcaattggattttgccaagtgcagggcaacaggtatgaccgaaaagcatgagctctccactagccatatcagtgctgcaggtgtctcgaaggggtcaagaggattcctggaggcttgaaagcccctcggagaagtcagatctttgcaccaccctagatgttcagggatatatcttggaaatgaactattagggaacccctaaagctcacctgaattggcttgtactcacgaagccatgtactaactagacctgcactatctaataagggagtccctagccacatatggctatttaaatgggaataaattaaaatgaaaaatccagttccttaatcacactagtgactcaatagccacacgttgcttgtgactactgtactcaactgtgcatatatagtccaatcccattatcacagaacattccatcaaacagcactgaactggaccatttacacatgatgggattgtatgtagctatgtaatccattgtgaaaacctctctggatctttctatgcccctctaaaccctacttgtcctttgagggttggctcaattctagttctcccaggaaacatctcctgaccactccagctcacagcaatgactccattcttggaaccccccagagcaggggtccccaactccactggtctgtggcctgttaggaactgggccacacagcaggacatgagcagcagggcgagcaagcattaccacctgagctctgcctcctgtgagatcaactgtggcattagattctcatagggagctcaaaccctattgtgaactgtgcacatgagggatctaggttgcgtgctccttatgagaatctaatgcctgatgatctgaagtggaacagtttcaccctagaatccatccccaccctaccccacccccatttgtggaaaaattgtcttccatgaaaccagtccctggtgccaaaaaggttggggactgcagccctagagcacccaaaatacttgacacactgtcttattggtgtcatacttttgcttgtcagttagtcttatcttcctaagaaggctacagggacctcaagagaagagcttaaatcacacactgcctgggttcctcttctcatgccagaatgcatagcagaaacatttatcaaactctctttttttctagctgtcttctgtactttgctcttgttttcagtatttagaagaatcagcatgtacgacaccatgtcatgcttcaaaaaccatatatttttagaggaaggtcagcatgcttattgatgtcaggtgtagcacttcagcttctgtcttggtgaggtggcaggagtggggataggattgaggaagatttgggaaaattggtattagatcttgaaaacacctttgacagagcaaagaaaaatgataccttcttttgtaatttcaaagctctgtttgaaagtactgggcttagcatctatgaacgcaccaaaaggggtatggacatttatttgactttctaattgaggctgtcatgctaggggattgatagtttaggactcagaaagaagcatttctagaataacttatagttttgtggtttttttttttttttttttttgagacagagtctctctctgtcacccaggccagatgcagtggcaggatagctcactgcaacctctgcctcctgggttcaagcaattctcctgcctcaacctcctgagtagatgggactacaggcctgtgccatcatgcccactaatttttgtatttttttttttttagtagagacagggtttccccatgttgtccagactggtcttgaactcctgacctaaagtgatctacccggcttgatctcccaaagtgctgggattataggcatgagccaccgtgcccggccaaataacttacagtttttaaagcactgtcacaaagagtctttatttgctccttttcacacctctggggaggaagcaggagaggtcagtgaggtcagacacctcatctaaggattatatgggtaaaaagtagctaagttggcactaggaccagctctgcactccctgaatcctgatgcttcttgagccagctttgcagagcctgcctccctcgtcctagcagataactgtgtgaaaaaacttaacaagctaatttcacatgaaaaggtaaatttcaattcaagtgccaggttcatttcagaatgtccaggtgaaagcagcagagcattttaaaatgacatcagttctcacccactttgggtaaactttcagttgactggccccaacagatctgtttgttgtgtgagctataaaggacttgtgtggccaataacagtctccatttggacccattttttctgcaccacttgttttgtgcatagggcctttaaaacatatcctagttcatggtaacaaaatgattattgtatctgtaagggcagaaatgaacatttatctacattgctgatgcatcaagacaggatgtgatagcacatgaaaaaaaaaacaggggcataaaacacatactttcttatttccagtaaaagattaaattctcttatacctcttgtggttacctggtttttatcttctccagcaatataaccttgggaacctcaagaatctagggcttaaactaaggtagcagagagcaaatttacccttaagcaaagggggaaaatttagctttcaaattaataatgcagtactagaatatgctggtagttttaaaaactagctagagtgacctagaagttcactctaaggaaaacgccaaaatttgcagggacaaagacgaggacttgaagggagagatgggtatctgaaaaagcaagataaagacttttagttacagtattgaggtgtgtgctgcaaggccatattctggagatctcataggaggagaagattgaagctttggttttgaaatttggtgatgttgctaaaaatgtggatgcctagattctgtttcgtggaggtgctgactgggcaggtctgcagaggggccatgattctgcatcattaataagcaccctgagtgatcgtgatgcaaacagtcctggacgacactttgagactctgcctccaagttgcagtcactattagattctgcatgttgctcaagatcggcagatgactggtatcctaggatcacagcacacaggaagctcattctgagcagtgcagtgaaccctttggctaccaattcatacttttttccaaagtaaaactgctgaaaagacaaactgggcagtaggtatggcattcatagtgtgtaggaagtaggagagttcaaatgaagccagcttggtgagaccaattctctttccaaaagcaaaccctggaggattcaacagcttaacacagataccctgatgctgctttcatcagcttgtgggcagagtagtgaggttcatttggtcactgtgaagggagacgtgcctggggtgtttatggccaaagtaaatgggccatagtgcatgctaagtgctagggaattacacttcatactgtgaactgatttacattcccagtaaaactgtatttgtaaaaaaatgcatcataagctgtaatggatatgtgctagtccagaagtcctctttttattgtgaattttcttaaataggcatcattgtaatttttagtaagctctcctttgtggaccttctttctattttgagcatcttagcacaagtttggccatttgtgcatttctccctccaaaaggaagcagcatcagggtatctatgtcaagctgttgaatcctccatggtttgcttttgccttatcagagaaaaaataagttatctgaattgacgactgctgtgcagtgagttcctgtattggaccgaatgtagcggttggaaggaggtgtttctgctcaactaaaggtacagaagaatgtgcttttactacttggttgggcatgcggttggaaacctacatgggatattttttgcttgccactgtactctgcagactgtccttggtcactgcccaattctgggatacagtggcaactggaggtagccccgggctggcggaaagaaattgtatgggatgaaagtcacaagccctgtgaggtttgagccccagcgcagccgtttgttggctgtgcaacctcaggcaggtcatttccctccattttctcttctgtaaaataggacataagactcgtggaggaagcacagtatggtaggctatttctctttcgtgactccgttttctctttaataaaatagagatgacgctctgcagggcagatgtgagaaaagcacattctcagcagaatgtctggtacatagccgctgcttaataaatgttacttccaatacctgctacccctctgctgtgaggtgcaagtcagagagctgcatactaacctgcaaattgcaatctatatgcacaataagtcatctgtttcaaccccatgctggtggcagatgggggtgtgcaaggcaggagcccctcattccaggggggtgagtagacaggcatttatatccaaaatgacgtcactgagcgctggattataaaatgatatatattttgtacctgaaatgtcattatttgaagactatgcattggcgagaatgcttttgcattgaaagagggtgatgaactgcccggacaaaagtgaaatacttatcgtaggcccctgccctttgatggatagtgaacaacagaaatacctagaaaccctcaaaggatgaaaccactgtggcattgtacccagtaatctctgccctctgctcttcctgggcttgagttctcataattctggtcaattatgaccacccaggattggccccagacttggatgtggaccttggctgcccttgtaggatcatagcaaaagctcagttgtcccaggtcacaaaaaatgtcagccatgtctgcctctccctcctgggacttggaataaataaaacatgatgggtccttctccaagcgaagataatgttagcaggggtctggcggggagaagggggaaagggctgtctattttatcaccctgatctccttttcaagaattctcagcaattgtgcggtctggagcaagaaagtggcaggtggggtcgcagaagcacagagttgatgttgaggcgggcttagcccctggctttcctctggatctttatcaatttattccctcttggaacacagaggcagcatggtcccagaaggagacaaaataggctggggtgggtggcggggttacagggtagccactccatggtggtggcagttcaaaaggaagtggaaaatcaatgaaataaggcctaaatacacatgaggtgagagaagcgtgttttgtattgattgtgtggagagcagagtattatctcaagagtttgactctggttcttccgagaggatttgaggcagcttatgaattaagacgttgcaaagcagggtacttaaatggataaactgggacagggacaatggaaagcacttgttcttaaccctggctgcacagtagaaccaccgggagaaattttaaaaatatgcatgcttgggcttcactccagttgaacaggaatccctgagtgtgggacaagtattggtatatttttaaaattccccaggtgcctctaatgtgcagccaggttgagaagctggaggagcagatgctaccaaatccctgacatgagtagattaagtcagtggttcgcaacattggctgtatattcaaatcacccggagagcttttaaaatcccatcgcctaggctgcaacccagaccaactgaatccgaatctctggcgagagtcgggggagcgggcaggcatcagttgtttttaaagtttgccagatgatttcgatgtgcagcccgggttaaaaagctctgctctgtggccgggcacggtggctcacgcctgtaatcccagcactttgggaggctgaggcgggcggatcatgaggtcaggagatcgagaccatcctggctaacacagtgaaaccccatctctaccaaaaaatacaaaaaaattggctgggcgtggtggtgggtgcctgtagtcccagctactcgggaggctgaggcaggagaatggtgtgaacccgggaggcggagcttgcagtgagccgagatggcgccactgcactccagcctgggcaacagagtgagactccatctcaaaaaaaaaaaaaaaaaaaaaaaaaaaagctctgctctgtgtagtggttcccaaacatggctatacagtagattcacagggagacgcatttaggaactcctaacatagagactaaatttgactctgatggctaaagcattagtccattcaacaaatgtttgttgagcatctactaaatgtcagtcactatgttaggtgctggggatgtggttatgaacaaaacagacaaagcccttgctttcatgaagtgcatatatatacaaggaaatatcatctaccaggggatgagggcgggaatttttgtctgctttgataactgctgaatctccagtgcctggcacatagcaggctcctgataaacaactgttgaatgaatgaatactgactgaagggtgaattaagtgctatgaagaaaagttacagtgggataaggggatagtgtgtgtgtgtgcacgtgcgtgcacgcacctattttaacatggggtgctcagggaaggcctcactgagaaggtggcttttgagcgaggcccaaaggagaggagggagcaagctgcacagctatctgaaggcacagagttcctggcagaagaagagcaagtgcaaagaccctgaggtgggaacatgttggcacgttagagcagcagtaaggaggccagtgtagctgcagtagagtgacaacagagaggtaatggtgggaggggagagggtgggcagctcatgtagggcttggtagaccatggtcagggctttggcattaatggaaacaccacggcctctttttctgtgtctgacactggagaacatatgtattcatatatggagagaatactattttcctggagtgaaatgccagcagaaatgtctatgctactccataaaggctgctgagtatcttaatgaacaagacctccacagcatggaagtggacccaaggggttgccgctgctggctcgggtggcctgcttattcccttattttgccccacccacatcctgctgattggtccattttacagagagctgattggtccgttttacagagtgctgattggtccgttttgacagagtgctgattggtgcgtttacaaaccttcagctagacacagagtgctgattggtgcatttacaaacctttaggtagacacagagcactgattggtgcatttacaatccttcagctagacagaaaagttctctaagtcaccacctgactcagaagcccagccagcttcacctctcagcatcagctctcattggaaacttcccaagagggcttagggaagggggtttctagggatcacacctaggactggccactcttttggagagctgcgtagaaagggtcagtccccagggacattgggaagtagttggaatcaacactcatttcccccagcagtgccccttcctctctgaagcatctgttccctctctgcctgttcttccaggcctcacctggtctacctgggagtgccatgtaacacactttcttcggattttttgccagaggctccaggaacagagctaattggtgggggaggggactgtgttaagatgttaagaggcaatcgtggcttactctgcacttggacaaggacaatgactcaactcaaaggtgaagactttgatgaaggggttttcgggccccaggagccagccccagtggaagagatttggccccaggaaggtgtgaacaagggagagcttcttgaggccccacacagcacaccacacaagcggtttcctttattttatattggcaaccaggccatttctttcagggccccactgcattgcactgaggggccagcagaaaagacttaccttcatggagcttgcattctctggatctagatctgtaagactttctgtgatcaagcacaatattggaaagcagttacttctgagacatgtatatattattggcacaaaaataatctcaatacttttattattaaagaatcagaaattaagcaaacagtaaaagctgaaagaggtgagatccctagaatgctgggcacagatcttggctctttcctcagaccctgggaaagatggtaccctgggatagatggtgtgttgttatgagaaaaacgggactgtaatggatccccaaactgggagggaactgagagaccaaagaatgactcagataagtccagcttgacaagcagatgagtttattaggacttacctacagtgcgctcctgggcagcagcaggacaactccagagatccaccccatcccccatctctgagctgctttgaagctaatattatggctctttgcctactgtgtatgtgcaacgagactgttttccttggtaggttctcagatactccacaggatgttggggtctcaggcacctgctcctcagctgggcaccgtggccttggctcactgccagccttcaggtttcaagcagcggatatagacccttaagtaacctggtgggggacccgtaacactacaagtatgacatggtggaaggagcaccagccagagtgccaagagagacaggctttgcaaccagctgcccatccttgcacaaccattcatattctgtgggcctctttgctcatctgtaaaatgggagattaggctgtgcatggtttctaataacccctacaatgttctggttgtagacagtttttttttttttttaaaaaagaacgagtcttctaggtaaaggaatgacagaggggaaggtgccagtcacagggaatagtgacttcctgtgaaatatggagagtgctgaggcaccaccctgagtcccagaaaatgtcaatatgccagtgactgaaattcagactgaggagatagaaatgacagtgagagacatttcaaaaagatccacagctaatagtaaaaatagccctggacttcacttcgcttcactacttagagctgggtgaacacttgagagttattaacttctcggacactgtttcttcagctgtaaaatggggatgtgaccattttctcaagaggaccagatgaaatcatgtgtatgtatttgatatacattttgtaaatgtataaagggcaaggaagggaggactcctgctagattactctttgggtcaagagttctagaaaaaaaaaaaaaacagaaaacctcagttacccggaatacgaagatctcattagttgaattgtttgatgaaattggttaaccagaatatcctctaacctctaaattttattatttgttgctagttgttctacagtgtctcaatgtactttcttcttcttcttcttcttcttttttttttttttttgagacggagtcttgctctgtcgccaggctggagtgcagtggcatgatcttggctcactgcaacctccgcctcccgggttcaagtgatttctcctgcctcaggctcctgagtagctggtagtacaggcacacaccaccacgcccggctaatttttgtattttcagtagagacggggtttcaccatattgtccacaatggtctcgatctcttgaccttgtgatccacccgccttggcctcccgaagtgctgggattacaggcatgagccatcgcgcccagcctaaagtgtctgaatgtactttcttaccttaggaagtcttgtacactgcacatatttgaactaacattttctgatgattgaggccatgtgaatttatcagggccatcattccaaatatcagtttttaatgtgtgtaggctaaatgcataccaacccatcgggatatacctaggaagttgttttgaggaagagggcacagaagaattccaggtatttaagagccctagataaactgattcaagttaagattttatgatttattctgtgaaactaagaattcgtatcaccagccctgacctccgcactgaatgtagacttaaatagccaatgacttgggtgatctctccacttgaacgtctgatgggcctctcaatctcaacagagcccaaacagagttcttgtctgcaacgctcttctccacctttgctcctctcagagtctttcctgtttcaccaaatggcaccaccagccagccattcagttactcaagtcaaaattgtaggaatcatcttgattattctttcttcctcacctccaacattcagtccatcatcagattctgctgactccactttcaaaacatattctgaatttgtactgcctccactgctacctgctagtccaagccacagtcatctctctggttggcttgttgtaatagccttctaactggtatccctgctttaatcctatccctactcagtttattctcccacttggagcaagagtaagtttttttttttttttttttttttttgagatggagtttcgctcttgttgcccaggctggcgtgcaatggagcaatctcggctcactgcaaccttcgcctcctgggttcaagcaattctcctacctcagcctcctgagtagctgggattacaggcatgcatcaccacgcctggctaatttttttttttttttgtctttttagtagatacggggtttctccatgttggtcaggctggtcttgaactcccgacctcaggtgatctgcccgcctcggcctcccaaagtgctgggattacaggcatgagccaccgcacccacccaagagagatttaaaaaaaatattaataagtgatagattatgtcacttctttgcttaaaatcctccacaggctttctactgtgaccaggaaagtgctccacactcctttccatggcctacaacagaccctgtgtgatctggccctgaccatctctcttgccaggtgctgttcactgtcctctggacatggcctttcttctcatcctagggtctttgcacttgttgcatcctgtgcttggtcccctctgcttcctgtggctccctccttcttatcattaaggtcagatgttcctggacttcttggaccaaacaaatgaatctagctagtccctctctatcatgtttactcttctttttttttcatattcatttatgaatcccacaaatatttactagcacctactatgtgcctattttctttctttctttctctttttctttttctttctttctttctttctttctctttctttctccttccttccttccttctctctctctctctctctccctccctcccctccctcctttctttcctttcctttctttttcttttcttctttctccttttctttctttctttctttctttctttctttctttctttctttctttctttctttctttctttctttctttcagatggagtcttgctctgtcaaacaggctggagtgcagtggtgctatcttggctcactgcatcctctgcctcccaggttctagcgattctcctgcctcagcctcccaagtagctgggactacaggtgcatgccaccacacccagctaattttttttttctaatattagtagagacggggtttcacttgtgttgcccaggctggtctcgaactcctgagctcaggcaatccacccacctcgggccctcaaagtgctcatgagccaccgcgcctggcttatgtgcctattttctaggtatgtgagcatacagtgaacagacaaaaatcgctgccctcatggagctaacattctagggaagggagatagccaataaacaaataataaatatctatagtctatcagatggtataagagctagggggaaaattaaggcaggggtggaaggtatggagtgctgggatggcagtgaggttgcaattataaagaggatactcagggaagccttcacttagataatatttgagcaaagatctgaaggaggtgaggtgtgagttatgcagatctctgggaggatgctgcaggcagcctagcaagtgccacgactctgaaaggagaatgcctgacatgtttaaggtcagtgtggctggagtgtagtgattaagaggaggtgggcacagagatcatagagggggagtggtgtccagaccatctggggatgtataagccattgtaagggctctggcttttaccctaggtgagatgggaagtacttattcctatctagagttatatgtttatggccccctgcccccacccctccaccacacgttagaatgtaaaactcgtggaaggcaagaactttatctgtcttattcaccactgtatccctagcacttagaacagtgttcagcacaaagaaagtgctcagggaacatttgttgaatgaattgtgcaggcgcaatattaccaaaggatataggaactaggcatgacctagtttaagcaatgaagttggagaaaacactgacattggattcaggttgacttatactctgactcactgtatgaccttggacaagtcacctcctcaccctgaacttcagtttcttcatctccaaaataaaggggttttaccagatgattttttttatttccataggtttttggaaaacaggtggtgtttggttatatgaataagttcttgagtggtgatttctgagattttgttgcagccatcacctgagcagtatacactacccaatgtgtggtcttttatccctcacccccttctttctgactgtcatagcctgtaattctacaacgcaggaaatacatcagtgatatatgaccttctgactatgatatgttcaggaattctggtatacttaccactattctatggttcatcttttaatgaatgttgtttatacttctgggtggagaggatagttttcttaactccttgagtgggttgtaggctcagaatagtccaggtcacctctagccctgtggtttgtatttcaactctgcctttccagtaaacatgacactcctacttctagtccagtgtgacagccatattgatcctgaggagcaaaaccttaagtcgtaaatattttaatgagccagttctaacagagacaaaaaataaagtgggatctatcctagctaggttttaaagtaagcaaataaatttaggtttaatctttagcttcaaaagcttttttatatattttaatagggcaaagctagttatataaagcaaatatacactcttaaaaagatgattaaatcctagtagcattggctctggtccccatataaacgaccaatgtgacaaacccttattttctagatctcagagaagcacagtaattgtaaactcatatcacatcagatactctacactcaaatcattaataaaatctcagtagtgactcagacaaagcaaactaattggttcctgttaactagttaactgatgcagtactcccctaaagtaggtcaatctactggaaaacccagtattaacttcaggtttgacaacaggaagattcatccgtgtaatgaacagtctccttttaaatactatcgaatttaaatgaagaaaaataagtcaatcaagtcttctgttactttggcacttggatctggggaatgatcatcatcaccactaaatatgaaaggtaaaagacatttcatttttctatgcattttacacatgaagggatactggttaagccaaagagaaatctgccaaagtcattatgcatacagaagcaaacctggaatgatgtgtctgagttctcaaatcaagtgaaaatcattgctacattgacttttgtttagtcttactttttatttaaaaaattttttttaaatttcaacttttattttgggttcagggggcacatatgcaggtttgttacattggtatattgtatgatgctgaagttgtgtataattgatcctgttagagaaatgcaaatcaaaaccacaatgagataccatctcacaccagtcagaatggctattttgttaatttttaatttttgtgggttaatagcaggtgcatatatttatggggtacatgagatattgatatctttgatacagttatacaaagcataataatcacatgagggtaaatggggtatccattgccctcaagcatttatcctttctttgtgttacaaattatccatttatactcttttagttattttatttaatttattttttttgagacagagtccagctctgttacccaggctggagtgcaatggtgtgatctcggctcactgcaacctccgcctccagggttcaaatgattcttttgcttcaacctcccgagtagctgggattacaggcgcatgccaccacgcctggctaatttttatatttttagtagagacagggtttcaccatgttggccaggctggtctcgaattcctgacctcaagtgatccacttgcctcagcctccgaaagtgctgggattacaggcgtgagccaccgtgcctggtcatcttttagttattttaaaatgtacaataaattattgttgactatagtcactccgttgtactattaaatactagatcttattcattctatctaactttatttttgtatccattaaccataccccttcctcacccttccacactaacattcatggcttctggtaaccattgttctactctatatctccataagttaaattctattaatttttagcttccacaaataagtgaaaacatgtgaagtttgtttttctgtggctggtttacttcacttaacataatgacctccagttcaatacatgttgttgcaaatgacaggatctcattcctttttatggctgaatagtagacaattgtgtatatgaaacacattgcctttctctttttgtcttaagtgaaaaattttaaatttaactttcttggccgggcgtggtggctcatgcctgtaatcccagcactttgggaagctgaggcaggcggatcacttgaggtcaggagttcaagaccagcctggccagcatgacaaaccccgtctctactaaaaatacaaaaattacccaagcatggtggcatgtgcctgtagtcctggctgctcaggaggctgaggcaggagagtcgcttgaaccctggaggtggaggttgatgagatcacaccactgcacttcagcctgggtgacagagcaagactctctcaaaaaaaaaattttttttcttttctttttttacattctaacttttactttaggttcaggggggtacatgtgcaggtttgttacataggtaaattgtgtgtctcatggatttgatgtacagattatttcgtgactcaggtaataagcacagtacccagcgggtagttttttgatcctcatcctcctctcaccctccacccttgagtaggccctggtgtctgttgttctcttctttgtgtccatgtgtactcagtgttttgctcccacttataagtgagaacatgtggtatttggttttcttttcttgcattaattcgcttaggataatagcctccaactatatctttgttgctgcaaaggacacaatttcattcttccttatagctgcatagtattccatggtgtatatgtaccacattttttttcatccaatctaccgttgatgggcatttaggctgattccatgtctttgttattgtgaatagtgctgcgatggacatatgtgtgcatgtgtctttatggcagaacaatttatattcctttgggtatatacacaatcatgcgattgctgggtcaaatggtagttctgttttaagttctttcagaaattgtcaaactgcttttcacactggctgaactaatccacattcccacaggccgtgtaaaagtgttcctttttctctacaaccttgccagtatctgttattttttgactttttaataatagccattctgactggtgtgggatggtatctcattgtggttttcatttatatttctctaatgattagtgatgctgagtattttttcatatgcttgttggctgcttttatgtcttcttttgagaagtgtctgttcatggtcctttgcccatttctttaatgggtgaaccacatattctttatccattcatctgttgatggacatttagggtgcttccaaatcttggctattgtgaataatgccgcaatagacaaaagagtgcagatatcatcactttgatatattaatttcctttcttttgtatatagtgagattgctgggtcatatggtagctccatttttagtgttttgaggaaccaccaaactgttctccatagtagttgtactaacttacattcccacaaacggtgtatgagggttcccttttctccacatccttggatgcctatcttttggatataagtcattttaactggagtgagatgatatctcattgtagttttgatttgcacttctctgatgatcagtgatgtggaggaccttctcatatgcctgtttgctatttgtgtatgttttcttttgagaaatatctgttcagatcttttgcccatttttttgattggatgattatgttttttcctatagaattgtttgagctccttgcatattctggttattaatcccttgtcatatgggtgttttgcaaatattttctcccattctgtgagtggtctcatcactttgttgattgtatcctttgctgtgcagaagctttttaacttgatgtgatcccatttctccagttttcttttggttgcctgtgcttgtggggtattactcagtacatttttgctgagactgatgtcctggagatttttccccaaagttttcttgtagtagttttatgatctgaggtcttagatttaagtatttaatccattttgattttatttttgtatatggtgagagataggggtctagtttcattcttctgcatatggatatccaattttcccagcaccatttattgaagagactatcttttccccagtgtatgttcttggcacctttgttgaaaatgagttcactgtaggtttgtgtatttgtttctgggttctgtattctgttccattggtctgtgtgtgtttttatgccagtgccatgctgttttggttactatagctctgtaatatgatttgaagtcaggtaatgtgattcttccagttttattctttttgcttaggatagccttggctattctgagcctcccatgattctatgtacactttaggattgttttatctatttctgtgaataatatctggtattttgatagagattgcattgaatctgtagattgctttgggtagtatggacattttaataatattgattcttccaattcatgaacatggaatctcttccaatttcttgctgtccacttcaatttctttaatcaatgtttgatagttttcattatagaggtcttccacttctttggttatttcctaggtatttaattttatttgtggctattgtagatgggattaatttcttgatttctttttcagattgtttattgttggcatatggaaatgctactgatttttgtatgttgattttgtgtcctgcaactttactgaatttgtttatgtgttctaataggttttttctgtggagtctttaggtttttccaaatacaagatcatattatctgaaaacaaggataatttgacctcttttaatccaatttggatgcactttatttctttctctggtccaattgctccggctagcacttccagtactgtgttgagtaacagtggagaaagtgggcattcttgttgtgttccagatcttagaggaaaggctttccatttttcctcatttactgtgatactaactgtgagtctgtcatatatggcttttataatttgaggtatgttccttctatacccagtttttgaggatttttatcatgaagggatgttgaattttatcaaatgctttttcagtgtcaattgaaatgatctaataatttctgtccttcattctgttgtgatgtattacattgattgatttacgtatattgaaccattcttacattcctgggataaatcccacttggtcatgatgactgatctttttaatgtattgttgaatttgttttgctagtattttgttgaggatttttgtattaataatcatcagagatattggcctatagttttctttttttgatttatctttctctggttttggtaacagagaaatatggtcctcgaagagtgagtttggaagtatttcctcctcctctattttttggaatagtttgagtaggactggtattagttcttgaaatgttcagtagaattcagcagtaaaaccatcgggtcctgggcttttctttactgggagactttttattatggcttcaatcttgttacttgttattgatctgtttgggttttagatttctccttggctcaatcttggaatgttatatgtgtttaggaatttgtccatttcttctaggttttcccatttattggcctacagttactcttactatccactaatgatcctttgggtttctgcagtatcagttgtaatgtctcctctttcatctctgattttatttatttttaatccctatttttttcttagctagtctggctaaaggtttgtcaattttgtttatcttttaaaaaaaatgacctttcatttttattgatcttttgtattgttttcttcatttcaaattaacttattcccgctctgatctttattatttattttcttctactaattttgggttcagtttgctcttgcttttctagttcttaacattagattatttatttgaagttttccttctttttttgatgtaggcttttatagctataaactgctctcttactactactttcattgtatcccataggttttggtatgttatgtttccattatcatttgtttcaagaatttttacaatttctttcttgattttttcattgacccgctggtaattcagagtatattgtttaatttccatgtgtttgcatagtttctaaaattcttcttattaatttctagttttattctgctgtggtcagagaagatggttgatgttatttcaatttttctgaatgctttaagacacccgatcttggaagaccatcattaaaagtcttacttttgctgttctctgggtctctgagtccattctttgggtttggacgggtgagtttgtttctcacatagagtcaaaaactttagaaatctacctggtgttctattgtactgtggctgagctggcactcaaaccacaacacacagtccttgccactcttccctcccctttccaaaggcagaggagcctcaccccatggccactgccaccacaggtccccagggagtactgccagactactgccaatgttcccttaaggcccaagggctcttgagtcagcctatcatgaatgctgcctggcctgggactcaccattcagggaaatagtctcccctctggcccatggcacgtccagaaatgccatctaagaaccaagttttggaattgggcaccccaagagcttgcttggtgctccaccccctgtggctgtgctggtacctaaggtgcaagacaaagtcccctttacttttacctgtgcttttctcaagtggaaggagtttcaccccatagccaccatagttgaaaatatatatgcacagtctcacctgaagccagcaaatctcagagggtcacccaaggccctcaacgtagttcctgggtattgctgctggttattcagggcccaaaggcccttcagttagcaggtgacaaatccttccatgactgggtccttcccttcaaggtagcaggttcccttctggcccaggataagtctagaaatgtcatctaggagctagagcctggaaaaagggcctggcaactctgaccagggccctaaggctagctggtatccaagaggcaaaacaaagtcctccccactcttccttctctcctcaagtggtaggaaaaggtctcttgtagagctgtgagctgtgcatgcagcctggggttagaggtgaggtggtggcagcactcccttaactgccctggcaagtgtttcagtaggtaggtcacatgccccctgtttaatgtctctgggcccagttcagcattaggactcacataaaagttgcagtccttgtggcctggcccatctttcaagtttttttaaggcgccaagggcattttagcccatgatagcaaggtttgctggaactcaagtttcaaccgctgtgattggtaatacgcctctgcctagagctggtttaaatgctccctccctgggcaggaatcagctgaatttggtctggttttcctttctgctctaacaggacagcactgagttcaatgcttcacaattgctgtgctatctttctgccaacaaccagagatgctctcagcaccacgctaccactgcagaggtggggggacatgacaattcaagactattttttctacttctgcagtgcttctttcagtgatatgaagttaaaaccaggtactgtgagtgctcatctgatttttagttcttatgaaggtgtttttcttgtgtagatagtttaaaattggtgtcctcgttggggacgattggtggaaccttctattccaccatcttgctttgtctctgcaccttgataacatatttttctaaacttcttaatagggaactaatcatagagcaatataaatatatatattttttcatgaaaaaagacaaggtgttggctaacctggattttttaaaatgatgaataatagtcacaattttgaaggcctttggatgtttgcctctgcccctaacactttgaacatattttccaaaaaaaaagcttcaaagaataaatcctcatttctcctcacctccctagtcaaatgtcactttccattttgcaatgttaaagacagctcaaggagaagacagttataagtaaataaatgtcttttcccatttctgtagcctttgatgatgccacagagcctttacattaatttgagttaccaatcctagatctcaacatctcattataacactgtaaaccagatttttagataaatgttgccctaaaggaatgccttttgtgaaaaagaaaataaaagaggaacttctgtaagaaatggaaacaatcaattttgattatgtgtctggtggaggggaacaatggttcaaaaaataaaaaatcattctatatggctttggaatttgtcactgtatgggcctttaatattcatgtatttaggctgggtgcggtgggtcatgcctgtaatcccagcattttgggaggccgaggtgggcggatcatgaggtcaagagatcgagaccatcctggccaacatggtgaaactccatctctactaaaaatacaaaaattagctgggcgtggtggcacacacctgtagtcccagctacttgggagactgaggcaggagaatcgcttgaacccaagaggcggaggctgcagtgagctgagatcatgccactgcactccagcctggcgacagagcgagactccgtcaaaataataataataataataacaataataaattttctgtgttgggatgttttggtatcttaaaatagcaaatgaggccctgcaagtggatttcctgactgaggagtagtccaggagttgtctgggtttcctaaactcatttattgttctttctacaattcccagccctatgctggggatggatggccttgctatccagatcgctgcacagtctgtcttggctgggctgcctatgtctagctttccttaagacagcttttgctcccatttagagtggcagggatagttgttttggattaaatatcaacttccaatgttctctgggctataaagagatggttaaagtgctgataaaggatgaaagtgaagagaacaggcaaccaagaataagaactgtgacagatatgtctgcaaatgattaagcattgacttgggggtaatgttttacagtttagtcacacaggtcatgtgcccaaggaactactcatatataaatgaagactaccatgtaaatgctaatctaattttgaaaacccagagagaaaaggacatttttgagctggaaaggatcttcatctggtccaagaaactaaagatcaaggagattacattaatgtcccagcccattacaatctcagtattcgggactaaaaattagtacccatcaatgtatttactggctctgagacttagttaaatcggctggaaaataatgctaaggaaaacatgctcctaggcagtttttaagccacaagctatatccctagtgtgaaagctcaccatcagtgcaagagactcatttataccaaggggctttggtattaaatgagaacgtggggctggatcactatagctccatctctggacaaactcctacatagtaaaagtgaaataggaagagtgatatctaaagagcttgcagtctaatgtttgttgataaatgttgctaagtaaaaacaatactactgtggagtcttaagtttgaggatataaatgaccagtagagctggttgagctgatgctctaactgacccttgtgcacctatatagcacaatgataatgcatatccataaaaaaagaactatgggaattgtaaaagattgcatttcttctgagttgataaatgaggactataattccagtcactctggtttgctgtcaagggtatttccctgttctctttcttcaagaaatggcagttcactctgactggctaataaaagctagcttgacacatttacactgagccacagggctgatggggtaagtgccaggaaagcagaggattgtattggatgaatcaagagcatccaattctactgagctgagcaggagcaaattgaccatatttgacaaatgcattcagtagacctacctgaggaagaaagtcacaggaggacagcaaggtctcactagccactcgcttcttttcaacactgccttatgcatttacttctaacagtttcacattcagtcatcctgtcttatccaataagtttgtccttcttcctcctttctgcagcagaggagtctaagtgactcctcccacttattgatgctcttctcagtgcttctatgctgtgtccagttctagctaaacactccatctgcattttctcagtaggctgagtttttatagaaataactcctaggtgttctgcagcaatgtctggatcaatattgattggtagtttcctacagtaaagaatcattttaattgggtgtttctcttcagttaaatcctaatctaactttttttttttttctgtagctcaggctgtattttaacagcatgctcccacaccttttctttctttctttctttctttttctttctttctttcttccttccttccatccttccttccttccttccttccttcctttctttctttcttttttgagatggagtctcgctctgtctcccaggctggagtgcagtggcgcaatctcggctcactgcaagctccacctcccgggttcacgccattctcctgcctcagcctcccgagtagctgggactacaggcacccgccaccacgcctggctaattttttgaatttttagtagagacggggtttcaccatgttagccaggatggtctcgatctcctgacctcatgatccacccaccgcggcctcccaaagtgctgggattacaggcgtgagccaccgcacccgaccctcacacaccttttcaacacttcgaccaatgtccatatcaccaaagagatcagtacatgaatcttttgagtgaattgcttctactggacaatttaaaactttactaataatcaaagaagacaccttataagggaagaagttgtttgtacgtttaatattataataaagttgttcctgtgttccaaattgttgtagtacatgattataagcagaatcaataacctgagaaataatttctgtactttctggacttgaaaaaccattcttcaggattagcagctataacactaatgttttctctggaaatttcagatgtcatggattttcttaattgagatgcgattttatttaactcaggctttgataagttttagcatctttgcttgaggcccttggcaacttaattagtctagccaagaacaaggccaatattttatcgaaaatcatggcattaaacacagcatcttttctgggtgaagtctttttctttgacttaaggacatcaataatcttaaccatgttttccagaattttgacagtttccataactaattctgaatttgatgcttcttcctccacttgagggtaaaattgagtttcctttaccattcaaaattgagaatttttttttttgagaccagagtcttgctctgtcacccaggctggagtgcagtggcactatcttggctcactgcaacctctaccacctgggttcaagtgattctcttgcctcggtctcctgggtagctgggactacaggcgtgtgccaccatgcacacctaatttttgtatctgtagtagagatggggtttcatcatattggccaggctggttttgaactcctggcctcaagcaatccacccaccttggcctcccaaagtgctgggattacaggtgtgagccaccgcacccagcaaggacattgttcttacgcattaaatctttctacactgaaatattacccagagtgctttaaaacactgttataagcagaataactactttttcaatagttgcactgtctgctaaagacagggtgagtgactctttgccctgtggtacgactttaatctgacttttagacatatatttttgaagtaaatgtacgatttttaaggttagtttttgcatttcagcatttagagacttgttttgttttttatcaattttggaaacatagataaaagcgttggtaaaaaaagtatagcaatatcttctattatgttaaaaggcagtttgtaagcacgtgatggctgactatgggggacccccgtggtttagacatgtttaagcatattttcaacaacactgtcaacttctgtacacttatatgaagttagctctccagaaaaataggtcagcagctgattgccagccacttcctgtacaactaaactgatttctgaaagtattctgcagccactggtgacaaaattttttatgctttcatgaaatccaaattgtcgctgattattttaaatagtctgaaccactaaatgaataatttcatcatcattaggatgtaaggattgtacatcctgtataatcaatcatatattcatctttggagaccactgtcataattgaatttacttcatttgaaggtaatccagttctgtatacaaattatcttcagatatttctgttgcagtgttggctactgtcgagaattttattattattattattattatactgtaagttttagggtacatgtgcacaaggtgcaggtttgttacatatgtatacatgtgccgtgttggtgtgctgcacccattaactcgtcatttagcattaggtatatctcctaatgctatccctcccccatccccccaccccacaacagtccccagagtgtgatgttccccttcctgtgtccatgtattctcattgttcaattcccacctatgagtgagaacatgcagtatttggttttttgtccttgtgatagtttgctgagaatgatggtttccagcttcatccatgtccctacaaaggacatgaactcaccatttttaatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcgtgatttataatcctttgggtatatacccagtaatgggatggctgggtcaaatggtatttctagttctagatccctgaggcatcgccacactgacttccacaatggttgaactagtttacagtcccaccaacagtgtaaaagtgttcctatttctccacatcctctccagcacctgttgtttcctgactttttaatgatcgccattctaactggcgtgagatggtatctcattgtggttttgatttgcatttctctgatggccagtgataatgagcactttttcatgtgttttttcattgtgtaactgtcttcttttgagaagtgtctgttcatatccttcacccactttttgatggggttgtttttttcttgtaaatttgtttgagttcattgtagattctggatattagccctttgtcagaggagtaagttgcaaaaattttctcccattctgtaggttgcctgttcactccgatggtggtttcttttgctgtgcagaagctctttagttaaattagatcccatttgtcaattttggcttttgttgccattgcttttggtgttttagacatgaagtccttgcccatgcctatgtcctgaatggtaatgcctaggttttcttctagggtttttatggttttaggtctaacatgtaagtgtttaatccatcatgaattaatttttgtataaggtgtaagggagggatccagtttcagctttctacatatggctagccagttttcccagcaccacttattaaatagggaatcctttccctattgcttgtttttctcaggtttgtcaaagatcagatagttgtagatatgcagcattatttctgagggctctattgtgttccattggtttatatgtctgttttggtaccagtaccatgctgttttggttactgcagccttgtaatatagtttggagtcaggtagtgtgatgctgccagctttgttcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtgagttggattcttaggtattttattctctttgaagcaattgtgaatgggaattcactcatgatttggctctctgtttgtctgttattggtgtataagaatgcttgtgatttttgcacattgattttgtatcctgaaactttgctgaagttgctcatcagcttaaggagattttgggctgagacgatgggtttttctagatatacaatcatgtcatctgcaaacagggacaatttgacttcctcttttcctaattgaatgccctttatttccttctcctgcgtaattgccctggccagaacttccaacactatgttgaataggagtggtgagagagggcatccctgtctgtgccagttttcaaagggaatgcttccagtttttgtccattcggaataatgttggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggtcctgtttatatgctggattacatttattgattttcgtatgttgaaccagccttgcatcccagggatgaagcccacttgatcatggtgggtaagctttttgatgtgttgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagctcctccttgtacctctggtagaatttggctgtgaatccatctggtcttggactttttttggttggtaagctattaattattgcctcaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggataggtggtgatatcgcctttgtcgttttttattacatctatttgattcttctctcgtttcttctttattagtcttgttagtggtctatcaattttgctgatcttttcaaaaaaccagctcctggattcattgattttttgaagggttttttgtgtctctatttccttcagttctgctctgatcttagttatttcttgccttctgctagcttttgaatgtgtttgctcttgcttttctagttcttttaattgtgatgttagggtgtcaattttaggtctttcctgctttctcttgtgggcatttagtgctataaatttccctctacacactgctttgaatgtgtcccagagattctggtatgttgtgtctttgttctcattgatttcaaagaacatcttcatttctgccttcatttcgttatgaacccagtagtcattcaggagcaggttgttcagtttccatgtagttgagcagttttgagtgagtttcttaatcctgagttctagtttgattgcactgtggtctgagagacactttgttataatttctattcttttacatttgctgaggagtgttttacttccaactatgtggtcagttttggaataggtgtggtgtggtgctgaaaagaatgtatattctgttgatttggggtggagagttctgtagatgtctgttaggtctgcttggtgcagagctgagttcaattcctggatatccttgttaactttctgtctcattgatctgtctaatgttgacagtgaggtgttaaagtctcccattattaatgtgtgggagtctaagtctctttgtaggttactaaggacttgctttatgaatctgggtgctcctgtattgggtgcatatatatttaggatagttagttcttcttgttgaattgatccctttaccattatgtaatggccttctttgtctcttttgatctttgttggtttaaagtctgttttatccgagactaggattgcaacccctgcctttttttgttttccatttgcttggtagatcttcttccatccctttattttgagcctatgtgtgtctctgcatgtgagatgggtttcctgaatacagcacactgatgggtcttgactctttatccaatttgccagtctgtgccttttaattggagcatttagcccatttacatttaaggttagtattgttatgtgtgaatttgatcctgtcattatgatgttagctggttattttgctcgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttctctgtaaagtattttatttctccttcacttatgaagcttagttttgctggatatgaaattctgggttgaaaattcttttctttaagaatgttgaatattggcccccactctcttctgacttgtagagtttctgccaagagatccgctgttagtctgatgagcttccctttgtgggtaacccgacctttctctctggctgcccttaacattttttccttcatttcaactttggtgaatctgacaattatgtgtcttggagttgctcttctcgaggagtatgtttgtggtgttctctgtatttcctgaatctgaatgttggcctgccttggtagattggggaagttctcctggataatatcctgcagagtgttttccaacttggttccattctccccgtcactttcaggtacaccaatcagacgtagatttggtcttttcacatagtcccatatttcttggagggtttgttcatttctttttattcttttttctctaaacttctcttcacgcttcatttcattcgtttcgtcttccatcgctgataccctttcttccagttgatcacatcggttactgaggcttgtgcattcgtcatgtagttcttgtgccttggttttcagctccatcaggtcctttaaggacttctctgcattggttattctagttatccattcatctaattttttttcaaagtttttaacttctttgccattggtttgatcttcctcctttagctcggagtagtttgatcttctgaagacttcctctctcagctcgtcaaagtcattctccatccagctttgttccgttgctggtgagaagctgtgttcctttggaggaggagaggcgctctgatttttagagtttctggtttttctgctgtttttcccccatctttgtggttttatttacctttggtctttgatgatggtgacgtacagatggggttttggtgtgggtgtcctttctgtttgttagttttctttctaacagtcaggaccctcagctgcaggtctgttggagtttactggaggtccactcgagaccctgtttgcctgggtatcagcagcagtggctgcagaacagcggatattggtgaactgcaaattctgctgcctgattgttcctctggaagttttgtctcagaggagtacctggtcgtgtgaggtgtcagtctgcccctactggggggtgcctcccagttaggctactcgggagtcagggacccacttgaggaggcagtctgcccattctcagatctcaagctgcgtgctgggagaaccactactctcttcaaagctgtcagacagggacatttaagactgcagaggttattgctgtcttttgtttgtctgtgccctgcccccagaggtggagcctacagaggcaggcaggcctccttgagctgtggtgggctccacccagttcgagcttccctaccactttgtttgcctactcaagcctgagcaatggtgggcacccctcccccagcctcgctgccaccttgcagcttgatctcagactgctgtgctaccaatgagcgaggctccgtggacgtaggaccctctgagccatgtgcgggatataatctcctggtgtgccatttgttaagcccgttggaagagcacagtattagggtgggagtgacctgattttccaggtgccgtctgtcacccctttctttgagtaggaaagggaattccctgaccccttgtgtttcccgggtgaggcgatgcctcgccctgctttggctcacgcacggtgcactgcacccactgtcctgcacccactttccggcactccccagtgagatgaacctggtacctcagttggaaatgcagaaatcacccgtcttctgtgtcgctcatgctgggagctgtagactggagctgttcctattcggccatcttggctccacccaccgagaaaatttttgatagaagagaagaaattatactctaaaaattcacaaggcagcattgtagtatatggccatgatgcctgacattttttgcaggctgtttggggcaccttttcgaccttttaaatgaactcccaagattctagaggcaaacatactgaagctggaacctcaccacaaagtaacaaggttagctgatgctgaaaaacttctcctattactgcattaactagccttgtgctaaattttcactgttactgttatgtccttacaaatggagtcttgccatctatattcctgcaaaatattgcatacagatgagcaaaaaatcatattgatcaacattttatcaattgattgtgtgttagccattaaaagtacctcatctgaaggaggtgttttagttgcaggtggcattctatgcatggatggtattttgtctataattatcattttttatcttggatggtgctttatccacagatagttctttctgcctgagaggtactttatgaactgatgtaactttatctgcaggtgggaagggctgatttccctgatctgggtttaacactttaatttgagcatctgaaaactcctttaacacggaatcaatcggtttcatagctgcctcatagatctcatcttgatttatgtcactggttacatttcaacatgcatcatctgtgtctggtgaggaagaaaaatcaatttgttaattatttcagagataacttcttctaagaaattggctgacaaaatcccagggttattttctggtgggttttgagaactgtctggtttactaggtttacttttaatctctttatctttacttttctcattctcttcctcagttgcaggaacattttggttagctcaatttgttgaagcaggctgcgcagaatccttaccatccacctgagttacatctgctgcattatcttctagggtctttgggattttgaatcacctatttgtccttaaaaagaagatatttctaaatattgctgtaaatgctttcagtgacattttggacatgttcagaatgtgagatttgtttatcatctgtaactctttaagctggagaatctctcttcttctcttggatctatttttcaccttgattttcagagatggtagtttaagaggtatgttccctttttctaatgaactttctcttttttatcactcttcctttttatcatctattttaatatctagttccagtccaacgttcttgtgttttgtgtcattggtactcggtgaaaaatgctggtataccttctcatctagacctttttctagctgaattgtctttcttcttgatttcatcctttgtaagtgctatattcaaatctggaaaagttgttgaaataacttttgatacatttccactatcttctctaattgaacttccccctttcttttcctcctctttctttttatccaccacacctccagctaaccctaatgctagggtactttgccgttcataatgctagttatatcggtacatattggctcatgaatggtgccttttttcattgatgtctccttctttttgaaaccttccttttaattaaatactcatctacctatttccaaagtgtcctttttgtttttcaggcctgatgtagatgactgaacaaattggattcctgatatggtttggatatgtgtccctgcccaaatttcatatcgaattgtaatccccagtgttggagatggggcccggtgggaggtgattggatcataggggcggagttctcatgattggtttagcaccatccctttggtgctcttctcgtgatagagttcttgtgagatctggttgtttaaaagtgtgtagcacccccctccccctgccccctttgctcctgctcctgccatataagatgcctgctcctgctttgccttccgcctgaaggaatgaataaaagctccctgaggcctccccagaagcatatgctggcacaatgctgcctgcacggcctgcagaaccatgggccaattaaatctcttttctttataaattacccagtctcacatacttctttataacagtgtgagaatgaactaatacagttcccctttaaacttccatttatctttttaaaggttttaaatggcaggtgttgaattctttggataatgttatccacatctagaaatgaaaagaaggtggaagaccagtctcctgaaaaaagcagttgaattttgaaagcagagatcacctttttggctaaagtagcaataaactctataacaatgttacttctgtcatttcccccaatattgttagatccatatatttctacgacttcatcatacacggaatcagatactttatcaactgtctgtttatccattggtggaaaagaaaacatttcttcagcatttattagaattttaatttcacttttcctaaattatcccaatcgggtcatttgtaaaatttatagcatttccatgaggttttattccaatatttctttgtccttaggattttcagcaatactttggagagtataaaacttgcaaacaaggtcaattataacgtcgtccagaaatgtagcagaatacacagaagactgtggtagggacagtgctttttcattagcaggattcaagaattcaatgacatggtcattttcaggtgagtcactggaagatgcttcttcatcacataaaaatgtctgcacatggtgatctataatttccttcataataaaaccagctattctcccaaggaacgagccttcctttttgcatgtattgttctgtgcttcagcttggaatttaatttttttcataatattgttaagtatggaatcaacgaagttctcaattgcccccagttgcatgctttctgtgtgctcctctgcagggacaaatctaatctcacgttcagaaatttctaatttcaccagtcagttctgaaactgcatcaacaaactcataatttggcagcacctctccctcttttagtccagtttcagtctcagataaagggaatatacatgctggaagcacataaatcatgtcttctaaaagagaatgaagcaaaacagagatgcatgaaggcaagagatggctatcatcattgatgatgttgagtacatttctgatgatagtctcatcttggagagtggagtaagaagacattaataattttcctgaaactaatgactctacctgataatcataaatttcttcttatagcaaacaatatatttttcatccaaaaccaatgacatcattttgtatagccctatatatatgaatctgagacataatcatttaatatttttcaaaaattaggttgatgacttttttggactatttctttatattcttctgaaaaatacagatttttgtcctacttatctgcaagtaaaattcgtgatgtggtgaactccagcatagttgattttactaatgttgtaacaatatcagtaatgttggcttttgctttatgtggattttggccacataaagatattatgtgagaatacataaaagattttgcataaaagcccagaaattacttcctccaaaaagatagctgaattcacgatgaaggacaattctctttgtttaggatctcttgctctttgattatgagtttgatcaacagtatgaagaaaaagttttatctccagataaaaatgactgaatatgatggttaaatatttcttttattatataacttgctatttttgtaataggtatattacttatgccagataaaaatgactgaatatgatggttaaatatttcttttattatataacttgttatttttgtaacaggtatattatgtgtttttaccttttgtaagagactcgtatagatttgaatgagaaatatcactataaatggcatcaaccatagcctgaacatcattttctgaaatcacattttgtttttcatttccatatttaataatgcatattgcatgtttagaaattattgacatgatttcatcaatcaatctcatgacttactgaagtctcatcatgaaagttctgggtcttctgtactgaagtccaataaacttatctgagataaaacttgagtgactattttttctgaacgtgtcatgataatacggtggtatatattgtacacgtctatcttcagagtatttatttactaatatcataatgaattctctttaccaaatcatcagcattgagttttgaatatgatttttttttaagacagggtcttctgtcgccctggctggagtgcaatggtgccttctcgactcaccacagcctctgcctcctggactcaagcaatcctcccacctcagcctcccagactagctgggaccacagatgtgcaccgccatgtctggctaatttttgtatttgtagtagagacaggtttttcgccatgttgccgaggctgatctcgaactcctggcctcaagcaatccacccgccttggcctcccaaagtgctaggatcgcaggcgtgagccacggcacccagccttgaatattatttaaaaggcagctttggtatgacatctggatgaatttggaaatcagaaacttcagccaggataattttagctaccctctcagccaatgtctttgtgtcattgagaaaatctttatcaggtagttgttcctgttcatatccttgtaaaactttgttatttaccacatcagaaattttgacaattacatatctactgggggaaaacacaattgtcccttagtattttctaggatgctaacttggacttttgaaaattcttctgttgtcaaatatattattacttcagctgtctccaaaagttcttttttctgaatctcttactgattttgtttgtgcaatgcttaacactctatggaatattttgcttaaaactccagagatcatgtcttccaagaagtctgagaagtaaacaccagtagaaaaactgtggccttcttgcatcatcaaaatatgtatattatgaaggaagtaacaaatttccatatacaaatggataaagatgttgacagatatttctaatgataaaatctgccattctgtcaatagaaacattgttactgcttgtgatagcacgttcagctgcttcctgagacccagagttttgcaaaatatttctaaatactgaattaacgagatgctgagcatcatcctctgaataaacagagttggtttttcttcatcttttgaaactctaattccatgttggaaacttttcatcttaatatcactaattagttttggagagatttcattgaaatttattcctgatctggagtttcactgcatggaagcaagctagatgcagaagaaaatattctggataacagtactttgattgtgtcttctaaaaatgtgtatggcaataaggtgttatacagagataaatgctgccttgacttcgtagatttactaatggcactaaagatattcttaataatattttctgttgttaaagtggcataggaagctgacaaatccccagaaaacagttgatgaaaaagataaacacaaatagctgccacaattaaattggtaatatcttctgcaaaaaatatcactgtctttttggtaatatcttctgcaaaaatatcactgtatttttggtaacatcttctgcaaaaatatcactgtctttgagttctttactatcaacctcaagggccagcccatgctgtttcagaacattcttataagctgtattgacaagttcacccacagtgtctgtatctacagtgggaaaggattgctcttggtaatcacaagggatgcaaattttagctttgttgaaattgttatttattgaatttactatttttggatcattttatccagttcatgctcagtgttatagctcaggttgaagacctttgataaaagccttacaacaatttttcctacaaatgtatgagggtaaaaacctatagccagtggtgatggggttttctggggtctgtgtgactctgtgacttcactgagaacctccttaaccatattggatatttcatccaatggagtctttggacaaggtaagccctcgccacacaaaaaggattgaatgattttcaataatcttgactaataagactggctgtccagtcaatcataatttggctttggcctgctgtaacttttctgtattgacacaagagagtcagacatctgaaaaatattatcataaacagattccactatattttggaggtctttttctatacatagatactaacgaccatatttagtgagccaaatcttatgctttgaaaatggctaacataactttacttattatacaggtggatttctcattaaaatctgaagtcattaaatagttccttcccaagcatgaagtcttgctgtatagagaaagagtggagataatagcctcctgatgacatcttctaaaaatgagtgtgataacatggtaatgtagcatgttgaatgttgaacttggtaaataagttatttcaggttattctgaagtttctgcagtatattttcagctttgagagagtaatatgaattaggcatgagcctttcttcaaaacacaatgggagttgctagtctcaaatctctatcagtatgccattagttatctgctctgctactggggtgatagtgtgtgccagatgattaccacaagtcacttgcaatttatattcccgtaaagcatcgttataaactgagtcaacaatcttacgagcacttttttttttttgagaacaagtcttactctgtcaccctggctagagtgcagtgagtggcacgatctcagctcactgcaacctccacctcccaagttcaaacgattctcctgcctcagcctcccgagtagctgggactataggcacacaccaccatgctcagccaatttttgtatttttagtagagatggggtttcaccatgttggccaggctgtagactagttggaaacatatcctttcttcaacaccctataaaacagtgacttgagcattattaaactcatttaccatggggtaaacacctaatatactcacctcattgaactgggcctcagtgatatttatatttttttttgcccaaaatgaggtatagagattaagaaaaatgcctacaattatttcctccaaaaatgtggcagagtaaactcctgggttcatgccttctagatgttgcatgctatgaatggctgctatatttattgcttttctcctggtcttcaaagaggaggtagacaagagggttttcttggaagttgcttaccaaataggcttctatttggaacagatagctcagatactatccagtgcccccttcaaaggcttgctgtcataactcatgaaacttatagagccttttccttatcttgattattttaattctggcctttttgcttttaggaaattagaaagtctccttcttttcctatatgcaaagaatgcaaaggatggacatcttagaggttgctgtacgtggtgtgattgtttttccattaaggattttacaaaactatgggaataaaactaatcatatattcttgatcgattccctccagattttccaaaagttcttgtattaggtcatttttgcattgctgtaaagaaatacctgaggctgagtaatttacaaataaaagagctttagttggctcatggttcggcagacagtacaagaatggtgtcagcatctgcttctggggagggcctcagaatgcttacaatcatgatggaaggcaaagggggaaaaggcacttacacggggagagcatgaacaagagagaaggggaggtgccatacacttttaacagatcttgtgagaactccttcactaacctgaggacaattctaagctattcatgagtgatcctcccccatgatctaaacacctcccaccaggccccacctccaaaattggttcattgttttcctgtaataaccaaatccttcttcctctgtattttgaagtacgttgaacagttgacattctgctgacatttcatcagaaagagggttatttgtaagagagttgtttgttgcgcattctcataaaagcattctaataagtttcttgcacacaaatttcagatgaaaaactgatttgggggaaagccctagattatttctaggtatgcaatgacttttctgattacttggagatgggaatattttcattgctattttaccagaatccatatcccaatttggccattcatctggcaaaaccaaatctaaaacaatatttacatttttattgactactttagattcacagtttttaggctaccaaccagagtgcctaaattacatgctagagaatttagtttatttttctgcatgagtttatcaatttgggcagtaggagctgatttccagtctctggagcctgcttgtcttttcatagttttgcttttgttgcaattggccaaattagggcttctaggcaaagaaaatgatttgtttcttccattgccataaggctgatgatttattcctatttctttgtacagaacatggatgactcctattaagagttcccgaaagagatcatcaaagtcacagtcacagccactcttgggcagtaaatatattttgtttttacagaaaccatttgttgggtaatgtctgcttttaaaatgtcactattaaacaggattcaaataatgatttcagaaatgcttaaagcaagttctctgatagaaattgactgactctccaacactttgtaataaactaaaataaccttgttaaaagctgaatcttgactttccagtgctttttgttttgacccactgtcttcggtgcaatcagacattctggaaattatataggaaataaacaattcagtgagatgttcatagaatcagataagggaaaaattgatgtttatgctttgtagaggctgttttgattcatattttttccttaacagtgtggaaacaatagatactttttcattatgaggaccttaaaacagaaaacattgctattttttaacatgcattcaggaaaaatgttgatcattcaaaatactgacaacattttgtatatgaatttcaccttgggtgcacctcactcaagaaataggaaaacctagttgagaaaggaactgggttttcttcatgtctctatttcctatctatggaatcccacttcagcaaggaagttaagaaggtagcccagcagaactcaaatctctaagtgccggtttcttccctgaatagctatgttgctttaagaagctggaaatcctagggcagagaaataatttctagttttagtgttgcagtgccctagtacgattctagtgatctctaaaggcctcatataattcttgaaaaaattttcacctattcagataattatactatttagtatatattaaattgaactgaatgaaattgctgatgttcaacagtttttgacatacaaaatggctatttcttatggttcactccaatacatgtatgtaagcattcatagaaagggagtgcaaatagagtctttgtaagcatggacttaaagtataaccacatcaaaccaatctggttcaacttttatgtataaaaatgtgagttgtttttcagttatcatggacccccccacccccggttgaaggtcacataacctgagcgtgcccagatgaaccacctgtgcaaccacagggggaactgaagtacttggacagaagagtggggacagaattagaagtgaacaccacatggcaggatccaggatccaaccagattgagctatggcatcaccccatggcaggatccagtcagatcacacctcccagctccaacacattgcaagatccgatcatatcagcttcaacacattgcaagatccgatcatatcgcacctcattaccctatgcttataacccctccatccccaccctcagcccccagcttggggagacagatttgcgcatttcttactacctccttgccagtcgactcagaataaagctgctttttatttttttcttaaaagccagggccaatgtattgacctctatgtatattgggcaacaagcccatttattactaggtaacaaaagtattatagctaaaaagaatttgtcagacaccagaacatgagcagaacaagaaatttaatgccactgttcttataaactgtcaataataaagctaacaacttaactatatacttcaaaaagaaattgaatcattactttgccatcaattacctatacatgaggtctgactatgatgtaagaagtcttgtaaagaacctaaaaaaccctcttgtaacttcttttttgaaattgcctttagagcagttgtatgtaccacacaaggaaactgatctcatcatttcatattcacacctcatacccaacctaaatcttctgctttaaactatgcctatttagggcatgttggctcacgcctgtaatcctagcactttggaaggccgaggcaggtggatcacctgaggtcaggagtttgagaccagcctgaccaatatggtgaaaacctggctctactaaaaatacaaaaattagctaggaatggtggcgggtgcctgtaatcccagctacttgggaggctgaggcaggagaattgcttgaacctgggaggcagaggttgcagtgagccgagatgacaccactgcactccagcctgggcgacagagcaagactctgtctcaaatgtatatatatacctatttaatcttatctgtggaaaaggaaaactgaacaacatctctccaaataaaaattatgtaaatgcaacacattttattctttaggatgctgaccagttgaaacacacaaaactattatagataaacagccactccaaatacaaggctgttttcagagaagcagaaaatacagcttcttgaggggagggtaaaaacaaaattcttaaaattatcattgatttttcttctaaagttttgccaactttttataaatcatctttcacttacctctggtttcaaagttcttgaaatttgtgaccgtagatgtagtaacatatcttgctactagatggattttatttggttccagttcctgttccataaaagcaacgacttgaacctcttcaaaagttgcaatttttttttctaacctcgggtacctgtttttccactttttcaataaagtgaaatctccacttgcttcaagtttgggttttctttttttctggctttataggtgattatttttccaaatattttaagcatgttttttgttcttcagacatcacagacaaaaccttttcctttgataccaaaaaagtcttccttgtctccatactttcattaatgggtgtggctgaacctggaagaccataactcagcaacatagtattgatgatattttctgcagctaaacatattttgagtggacgaatgtttgtctgtatttggtttgagtgaagcactctttgattttcacctccttccatttctctgaaggacatggtgtgctctaatgctgattgtgcagagacaccggatatctgagatagtttttgcaaaagactgactttagggagatggctgtttcttcttatagctggatcaaaatgcatgatgtcttagacatcacttctacaatatgatggtttaagctctaattcaagcctttccattgcaccagtggttttagttgtatctcttgcagaatatctgacatatgaaggtagatttgaggaagccctgtcttttcttttcatatcttcctctgaataaaacaccaagccagtgatttgtagaggatcatccttgctgataactccttttaactttgaagtgggcatttctattttgtttgtgaattcagcccaattaacagtgtaagcgttttcatttccttgaggcagattttcctttggatagtttttgatcaatgactcatagaaacgagtacactgctctataaaagttctgatgatctgatttgttacagtgtttttttcaaatgcactaattgaagatggttacacttggcattttcctttgtctatcttgttcttaattataccaatcatgtaatagcagtattagtaagcaattctgaatggaatgaatgaaactattgaagggcatcctgtatgttttcctgggaaattacggtatttgatttagattcatcaggaaacttatgcagtggttgtaatttggggaatattttttcattgatgatttttgttggacagcaaaaagttttcaataggcattttcacaatttcagagaaagcatctgtagtaacatgcttaaattgtacgtctgcaaatgactctaaggtgtttagaactccctggaagatcttttcagtgatttggtggctggagtgcaaaaaaaaatgtcttttaatgttgttttatagattgatacattggtgatgttgtttgttcttaccagagcttgtcttttgcttgagtttcttcactatctgttatgaacagcaaagtcaagaagcataactctaatttttcaaacaacatttcaacaatttcttggccaactatgccaatctgtgtttagaaatcctcagctctagtagaagctcttttaaaattatggtgggtcgggcatggtggctcatgcctgtaatcctaacactctgggaggccaaggtggaaagatcacttgagcccaggagtttcagaccagcctggacaacacagtgagactctatctctaaaacaaatttttaaaaataaaataaaataagataaaataaaataaaataaaataaaataaaataaaataaaattatggtatctgtttttacaagcctcaagaggtaacaaagttaaaagtgaaagactgctctaatttttttgcttttaataaaatttcattcaaaacagtctcagctaccatcaatagcttacatttttcacttcccttgtcacttgattctgtttaccatttatcaaatatttgttgaaaagtatcttctttaggaaaaattttctccagctgcaaagagacatcctccaaagaaaaacgtgcttctggatttgcaagataggttgcacttaatttcttctgtgaaagtttgaggttatctggatgtgagccatttattgtgtgagtcaaattgttcttgcttacatttaatccttgcaaaactatatcaacttcactttgctgtcacaagttgatcagaaggtaaagcttttacatttactattgttctactttgtgtcaccattcgaaattcattcacagttgtttccagaatattacgtactccatcattggcatacatttttagttccacagggggaagttttgttttcactaaggggtttttggcatcctctgttgacagcaggtattgcagcccaatggctgtctaggaccagctgccttttggagtcttctcttcaggacctaccttggttttgcttttggccttaacactactaggccctagctgtgtttttctccccccaaattagagcaaataaatagcttttgattttgtttcaatttttaaaatctaaaacctggtctagggctacccttaggaccagctttagaatgcatggcctcagagatcacatttcatcagactgacctttagggaatgaactcacttctagattcagcaaagcaaaatttgtgatcttttggagaacactttgaaccaattcccccacttgtaatggagaaaattgcaataatgtggtttccaatgaagtgatacttctaatgcctgtgaaagaataagttggcagcatcatatgttcagggggaagactttttttcctgcttatttaaatcccctaaagcatgacaaattcattggtaattcatcactgccagatgcttctaattctctcctggtctcattattttcatataaggatgtcacaactatcgagtacatttttccaaaattacttttgattgtgtcacttgcgacactgcttatatacaactgcaagaagtgtgggtgtgtgtgtgtgtgctgtagttttaatgttagaatcagatgttttaattttagaatcagatgtcaagtgggagggttcattaaaaggaagccaatagtctatgtgttccattaccctttgatacaccttctttaaaatttccttaactgcacttaagaaagcaggtggttattttttttttcctgtctagattatccatttctaagtatttcctctaaaacccttctcaggttttctcttctgatataatttggttttgatatgggtattttgataagaaagttcagtattgtcttctttctttgacccagtaatatttcattttgtacaaccagttgtgtgaagagactagggttctgttttgagtaaaaagtactttcctttaaagatattttatcattcagactcttcaagatattgtttacagtttcacttgcaatgatgttttcttggaatgaagtgttgtttgatataaatacatcttttggatttctagtttctacgtcattttaataagcatcaagacagtccttgcaatgacgtcagcatattccttaagactagcttgtaatatatgagttgtgggcccatgtttttctctgtaattatggattaaatgtgtaatccggggcctcttgacagaatgtttttacctgtagatattttcaggctattcaaatctgatgacatttggtttgattcaagaaatacgctgtcatcttgtttacaatttgtttacaatttctgggctaacaaataatttttccctagtcttaaaatcaagagtaagtagcaaatctattctttctgtggcaaaagattttaacctattcaaaacagctttagtaataaagttagttagcactttctgcacatgggtcaggagcagattgtctggtgtcttgtttcttaagcatagttgtctgattatcatcagagtaagctgatttcagctgtatatctgttccttttctcagaaatagaaagctctcccttttcttatcatttattgagttcataacaggaggttgttgacactctgctttgggaaatgcatcagacaacatcacggacgatcttgcagaaatagaatcatttgcatttatgccaagcatgacagcagaactaagattttgaggaatgatgtttaccatatgattggaaatcatagcaacgcatgacttaggaactaaaagtgttgaaatagacacatttgcatactcaggaatcattccagaatttgttcctaagcatgttatatttaagactaaatgcagcaagtgggaaattattcttgtccagtgttttctcacaaatgtcacttcagatacccacaatggtatctagtatttggaactggggttttgttttttcctttcttaagacagggtcttgctctgtcacccaggctggagtgcagtggcatgatcacagctatctgcagccttgaactcctgggctcaagttgaactcctgcttcaacttcctcagtaactaggactacaggcttacatcatcatgcctgtctaatttaaaaaactttttgtagagatggggtcttgctatgttgctcaggccagtcttgaactcctgacctcaagcaatcctcctgcctcagcctcccaaattgttgggattataggcataagccactgttcctggcctgatgtttttttcgataatcactttgaaaagcgtttccacaacatcttttagccaacctagatcaatttctctgtcagatatgtttttttcatacttgcctttagcaaatacaacatctaacactgtaaatctgacttgtaatactttctgacaccacaacattatgggttaagaatttacaatttttcattctatacaatgcaaatataaaaaagttgttcatatataaaaattaatttttgtatactgaccttgtattctgcaaccttgttaaactcatgtattaattccaatagctttttgtagatttcttaatattttcttcacacataatcacattattgcaaataaaaacatgcttttttctttctttccaaaaaaaagaaggaactttttatttctttatctaacttaagtttgattcattgtaaaatctgtctagccacttgtgtcacatatatatttaatttagagacagtcaattgacatattgaggcggactttcctgacttattatgatccactgaacaacagaaaaattgatcgccagaatacgaatctttggttgataaccatgattgacttaaagcagttgtatactgttgtaaaggtaaagtcattggaactgtgacattgatatgaggaaaaaggagacattttactttggaagcagtaaacatttcaaaatgtgctaatattgactgtataatatcttcaactagatttcctttggttagtttatcactattgaatctggcctgaagcatacgtggatttctgtccagcagggtggaataaacagaggcttttcctccactggtgtattcaggaaaagagatatttgctggaatggtgatagtgttacacttattttcatttgcattatgtctgtcacagcagtggaatacggtttttgaaatatggttctaacaacattatttgcaacaatgattacatctgcttcaagcactaaagaatccattgttttattccagggattgaacagatgtctgagcaactggctcacttccagcatgcggaatgtcatataaatgggactggaggagaggaagaacatttaactgatcaataaaatcattcttaagatttccattcaaaatatttcttataatggacacaattggggactttttggctctttgagttctactttaatttttttcagtgttcttttcaattcctcttgctcaagagactctgatttagtttcttcttttggaggtcttttctctccagcactttctttctctgtatctgcagaatcttctagatatgactctggtccagctcctccaggaagaaaatttctgtaggctggcctttatctgtaattttcaatgtctctgttttctgcttcagtttcattaaacgtatgtggaggcattccatcccaaattaaaatgactagcttcttaagcatttgtttctcttgtagtgggtcgtgtacacatttccaaatctggcaagctcacatttaatttggtttgaatagccttcaaaattgcacttgataccttctttgtatgaatgtgtaaagtggactgcaatagttcttgatgtgcgttagctcaaatgttggaactttcactttccccgtctgtcttgttgctctttttatttccattgattatagtacccacagttataaaatttcttttggcaagcccttccaatttagcaaaaaccatttcaatgatatatgaagtcacaacttttcatttatttggatacttttattttgtgctccctctttccctgtttcaggggcagtagttttccccttattggtagttgtctcttgactgccttgctggatccccctggacaccatgctggagattatatcagagcatctgctcatttcctcaataagtgaagcaaatgataagctgtcagggtcaatatactccaagatagctttaaattctgaacttgtgaaactgctatccacctcagcactacacaatcgtgtaatgatatattctagaattgtatgagaaatgagctgaatatcaggctgcaatgcagtgattgttcttaaattctcatcgatccactctctggttcactatcagatggggagaatgtgaatgatcttctacgagctccgattacatgtcatataaagtatctccagttctatctaatacttgtaatttggcacatttgtgaacttccttttgcctaggagggcactgaaaatgagaaaatgtttgttgatcaatgtcaacaattccatatgaaaatataggcctcagcttctgtgaagggagtggaacattgcttttatctgtctttccacttaacacttcacaaatacaatttactaatgaactttcaataatgtcattgtttagctttgtgacaacagcctaattcctttccggttttatcaaaaactactgtatctatatacttcttgggaggacccttctccctaagatttagattcttctcattgtatttcagttccttcttgatagcatccagacaatttttcccactttagttgtgtatacactaagttgagatttaaacaaagattccttgccaggtgcaggcttcaaactagcagcatggctttctggtttgaagcatttttgcaattttgaacaaatacgtgactttggcatcttaaaaattttatgagtgttttctttttcttataaatttgtttaagacccttgtagactctggatattagacctttgccagatgcatagtttgcaaaaaatttatcccattctacaggttgtctgtttactcggttgatagtttcttttgctgtgcaagaagctctttagtttaattagattccatttgtccatttttgcttttgttgcaaaaaaaactgacttgtaatactttccgacaccacaaccctataaaaaagtggacaaaggatatgaacacttttcaaaagaagacatacatgtggccaataatcatatgaagaaagctcagtatcactgatcattagagaaatgcaaatcaaacccacgaggagatactatctcacatcagtcagaatggctattatgaagtcaaaaaataacagatgctggtgaggttgtggagaaaaaggaatgcttatacactgttggtgggagtgtcgactagttcaaccattatggaagatagtgtggcgattcctcaaagacctaaagacagaaataccacttgaccaagcaatcccattactaggtatacacccgaaggaatatacattttatttctgtcattttattatattttattttatgtcattttattataaagacatatgcacacatatgttcactgaagcactgttcacaagagcaaagacacggaatcaacctaaatgcccatcagtgatagactggttaaagaaaatgtagtacatatacaccatggaatattatgcagccataaaaaggaatactatcatgtcctttgcaaggacatggttggagctggaggccattatccttagcaaactaacacaggaacagaaaaccaaataccacatattctcactgataagtgggagctaaatgatgagaacacatgggcacaaagaggggaacagacacgggcctgcatgagggtggagggaggagggagaggatcaggaaaaataactaatgaatactaggcttaatacttggatgatgaaataatctgtacaacaaacccccatgacacaagtttacatatgtaacaagcctgcacatgtacccctgaacttaatataaaagttaaaaaataaaaatggaattacattttcaaaaattctatgagtaattttatcattaatatgaactaaaggctcactttcttcagactaaccagggatgttttttagggtctatactaagcacagctaaaaatttcatcttgtttttactctctaatcatatttctaatagctctttatttggtacaccagtattatctagagaagtttggtgtactaatggagaaaatgaaatgtttggtggtgttaatgatgtgactagaagccatgtgtaatatttttaatacaccatctgctattcctgagctactgcatggatttctgatgcagagaacatctggttcatacattcttaatgtgacagacctcatggtttttctaaggtaagaagtaaagcttcttgaccatttttattgactgaatggccatgggacacagaagatatgtctttgagcacttctgctaaaatagttgtaattatgtttttggatgcattttgtatttgatgttttgcatcatggctaaaaacccaaatgtctttgttcaaataggacttgtccatgaaaaggtttttagttattaaaagctgggaggtcagtctttaacccccaatcacaaaatgctactttgtcttgacaagcaggctttgtagttgagttggcgtttcttttgcatttaagaccagtatttccccttgttgaccagtgatcaggaacctgttcttgtaattttgctttttcatccttgataggtgaaatcagtagattttccacaactttgtttattcttcattattgtctttggaataaaagaccatgccagggacattaacaagttgatggtcccctagatacgttgctcgtattcaggggaccatgaactactctagtgccagagagtctgttctctttttcagtgccaaaaagactgctcgttctggagcatctactctcttggacattgttttcattggtttctgatgtaagtgagtcaagatattgacaagcagctgaaacatgatcactgtttctttagttgcagtaaggctttgattattaactctgatttacatataacctagtatagtgtcgattgcttcctctgtataatgaaccagagagaactgggacaaaatatttgacactaaattttgtatttcttctttggcaatcaaattggctgtatcaggttcagtgctagattttcttttgctggctctttgaaggaacgtacctgttggatctttcatatgttgctgataagcaggttcccatgtgaattcaagatgagcaagttcattttgcttagaaaatgcaagagtcatcagcttttttacaatcatgtaaaccatatcctctgcaatatcactcatgttctccaaagtatatgtcagtgaagcttttaaaggattttcttttggggaaatgaaatgttctcctctagctgatttaaagtgtactgacacattttattgtgaaaatacctcaatacatttttttctgtgaacttcagaccagcttctcaagtatgttttccacaatgtcagcagccgctgaagagatatcaacattgcagagcaagtcttctttgtcagtttggtcaacccaaacttcagctgtaacagaggaaagagtgggtttggcctgagttaaatcagacaacacttctagaaaaatgccatctaaagtcaactcagttttctcttttaggtaacacttaaagttaacaaaagcattctttaactcctgcatctcatttatggcttttgcttttccaccagaaatcagtgggtttttttttttttttttttttttagacggagttttttgctcttgccgcccaggctggagtgcaatggcgtgatctcgactcactgcaacctccgcctcccaggttcaagcgattctcctgcctcagcctcccgagtagctgggattacaggcgcctgccaccacgcccggctaatttttgtattttagtagaaacggggtttcaccacgttggccaggctggtctcgaactcctgacctcaggttatccacccgcctcggcctcccaaagtgctgggattacaggtgtgagccactgcgcctggtgaagtcagtgggcattttaagccatccgttttagtggtagcatccctagatttctttgtgcctgtttccatcgatgtgataaggtgactatcgaatttacagattttgagccggaggtatttatagatcttattatgtttaatttcagaggttataggttgtcctttcctgtgatgaattttttccacaactgttgtttctttgtgggcagaaggtggcattaaaagtgtgactggtcgccccattgacctgtcaggtgtctttatataggacactgaaatgtcttaattgtttcaatataaacatttcactgcatgtgatacaacaacctgaactatctgaaaagagagtggagtcagcagacattgggtatgtactattttacaacatttcttcatattttgtgattgctgggtataatatactggtcactgctgccacaattcatgtcattgtattatgaattatacttttcagttcttcagaagttacctggaaaggaggtgagcagggatacaaagaaaaccaaatgtaaatttactctattctagggatgggggctggcctttaattccatatatcaaattacagttagtcatggtatatagaaagggatctctttagaacatcagattaatttcaaattggtttattctctaagtctgtgatctattttttgaatatgattctctttgattcaaaggcacttgaaagttttatttttagcatttactactggggatcaatgactttctggaagaaaaaaaaatagccaagtgagtgtctaggctcatacaaaaccagtgctttggcaagaagtaaaaattgtgtttatgatccaggaaatatttattaaaaatatgaactagattacttctaacaaactgtattaggctatttttgcattgctataaagaaatacctgaagctgggtaatttacaaagaaaagtggtttaattggctcacagttctgcaggctgtacaagcatggcaccaacatctgctcagcttctggtgaggcttcaagaagtttactatcatggtggaaggtgaagggggaagctggcatatcacatggtgagaacgggagcaaaagagggagtgggggaggtccaaaacttttaaacaaccagatcttgcatgaactaactgagcaagaactcactcatcacaaagggatgctactaaaccattcatgagaaatccacccccatgatccagtcacttcccaccaggccccacctccaacatcaggaatcatgtttcaccatgagatttggaagggacaaacatccataaacatccaaaccatatcacaatctatttcatgaagcaaatttgtagtcaaaatatttaggtgcttttgtggagatagcatccttctgcttaggcatctgtttaggtaggatatgagggcaaaaaataaggtcccctagtggcagatgtcagcccgtgactctgctgtcttcctccttcaaatgactgtttatatatgcaagcaactacagctaattgttgggaattaattgatgggtgacaattagcactaatgatttagggaggatcaacagctttgggtccaataaaatattatcagtctaaactttcttggatagaaaggcagaagacagatcatgaagacaaaaaacacattaatttaggtagaaaaagaagggctgagttggaattgggactcaaagagccaggaaggctaagcagcagagggaagttggggtccatttttttctgagctgaaatataaactcggtgaccaaacttgatgaccatttcctcagtgattaattgtactgtcacagcttatactggcccaggggtagatgcaaagtgcatctgtagaactctgtgttctctgaaagggcagtatgtgcgaattgacccccaaatgccaaggagctgagaaaccaaagaaagaggcagaaaaatccagtttgtcgatttggggtgatttattaagggaacttacagacagaatcgtggtcttgagtggtcacaagacaagtagatctccacaccacaatcccccagacccagggcttatatcttggaaaaaaagcatacgttctctggaatgaatgtgtaagtggtatgagcatcccagccaatgatttctgcaacaagagttgttttggaggaaacctacaatgaataggtgttcctacataaagggtaatatatcaactagacattttgggggcgttcttggactcttggggttagtcagaagttacacagcaggttagcatttaaaataaagtcactccaaaaataagcaagggggaaaggattccctatttaataaatggtgctgggaaaactgtctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgtacagcaaaagaaactaccatcggggtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggacatgaacaggcatttctcaaaagaagacatttatgcagccaaaaaacacatgaaaaaatgctcatcatcactggccatcagagaaatgcaaatcaaaaccacaatgagttaccatctcacaccagttagaatggcaatcactaaaaagtcaggaaacaacaggtgctggagaggatgtggagaaataggaacgcttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacatgcacacgtatatttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatattctcactcataggtgggaattgaacaatgagatcacgtggacacaggaaggggaacatcacactctggggactgttgtggggtgaggggaggggggagggatagcactgggagatatacctaatgctagatgacaagttagtgggtgcagtgcaccagcgtggcacatgtatacatatgtaactaacctgcacaatgtgcacatgtaccctaaaacttaaagtataataataaaagaaaaaaaaaaggaaaatgtggcacatatacgccatggaatactatgcagccataaaaaaggatgagttcatgtcctttgcagggacatggatgaagctgcacaccatcattctcagcaaactaacacaggaacagaaaaccaaacaccgcatgttctcacttgttaagtgggagttgaacaatgagagcacatggacacacggagaggaacatcacacgctggggcctgctgggggttgggggtgctaagggagggatagcattaagagaaatacctaatgtaggtgatgggttggtgagtgcagcaaaccaccacggcacatgtatacccatgtaacaaacctgcacgtcctgcacatgtatcccagaacttaaagtataataataataaaaaaggaaatataaaaaagaaaaagaattgtcatcaatcttgaaaaataaaacaaaataaaataaagtcactctgtccacacactctctactggtttatgtccttttactcattgcagatatattttggtaatataaaaatccctttgcgtatcataaaatagtatgtttttaagttgttactctcaaaacagccagaacaagagtctttaccttccacaggaactgtacttctcaaggctgtagatacaagtcagtggcagcaaaggctggatgcctagcatttgagcactaggagaatgataggatccctataatgtggttgttgcctcccccacaattatctccaaagttagctctgagattgttcaggtttaggccaacattcaaagaaaatttatcaccttgctgcgtgtaacatactctcttttgacccattagagggttgagggccaacccagggaagacttattttattccactctaattcccaaatgccttaattcatattttgttgcatgacataaaatttaccattttaccattttaaagcatacttcagcagcattatgtacgttgacaatgtcatgctaccattgctactgtctagttctttcacagcctttttttttttttaaccacagataagaaagcggcaataagtttgaaaaacatactttgggatgacagcatatggttgaaaacacttgttttacataaatatgtcctaaatcaaacacctctaagaataacatgtaaacattaacggggaagatacttaccttctgtgtctaaattggcctaaatccaatccattccaatagatatgagctgataatttcaatatgtattatttccttatgaccacagatcatgtacaacagacctacattcttatgcttaggatagcattcctaatcttaatacataaaatagggacattcttaaagtttttaatgaagtgaaatgtgagaaatagaataggatttttcagcttactttcactataccactagaccaagaaatatctttttggtgccaattttgtgcttgttgcacagtctatgaattgaacagacatatgtgtgagtatgccacttccctgaacctctctttgttcatgtttgatccatccagccccagagttgtggttcatcaaattcaccttcttatttttgcttggtccacgttacagctctcaggtggccaggtcatttcttttggtggtgtggccaacttaatagtcttcttactcccaggaaaataaagagacacatccaaggcaccctggctcacccacctcaggggcaggacgctcagccctgagccaggtctgctgtggtctgcaaagggatttcccttaatgacttcccattatggagtaggtttgtgatattcaatgcttttcctgttctgtctggacctcctaaggctccccaaactacccctctgagcccccttgcccaaagggccaatactctttttaacaataactttggacccctgtaaaacctgagattaactgagattgaaagtcatggaagagaaacaggcaaagagggagactgactaatgtcaacagatgatggctggctttctgattcacagattttttttctcttataacatatttgaaaaaaaacttaatatattgttttcaatgaatactttttcctgacagggattttgatgaacagatttctatggacatgttgctctacatggagacctgctttagtatcattatccagaaatattcattaaaatctacttatgaggtggggagtggtggctcacgcctgtaatcccaaaactttgggaggccgaggtggctggatcgcttgaggccaggcatttgagaccagcctggccaacatgatgaaaccctgtctctaataaaaatacaaaaaattagccaggtgtgatggcttgcgcctatagtcccagctacttgggaggctgagggaaaagaatcgcttgaacccggaaggcagaggttgcagtgagccgagatcacaccactgcactccagcccgggtgacagagtgaaacgccatctcaaaaaaaaaaaaaaaaaaaaaccgcttatggtactagatggcatacaaacatgttagaaagtgttagagtaggaagagattaataacatgcagactaatgaacaaatattgagcaaacatatatatatatatatatatatatatatattaaataattcattcaacaaatcaatgccattgagtgttactatgtgccagacactgtatggtcattccaatataacataggaagtcctataataaaggggtatatataatgcttcaggagcagtgacagagggtgtctacacagattgtgaggaaggttctctggaagaggtgacacgaactgaatgaatcttaaaggataacacgttttaaagagggacactcaagttgtagccaaatgaaatagtaagggcaaagaccctgaggtgtaaataacatgatatgtttagggaattgaatgtcgttcagtatctctggagcacagaatacatgtagaatggtctagagattaggcaggtgaggtaggcagtggacccagattttaagatgtattttgtgcctcactgggagtccctggaggatttgaaacaaagcagtgacagcaaggaataaggacctagtacgatatgttaataactattttacaagtaggttttgaagaatgccaacaaataataattttctttttctgtctgaaaatctatctgcagctcagagaattgtttcttctcatgattcatcaaataagtcagtgtctaatttggattagaacatagaatagaatattgtgatacctagaaaagggctatatctaatttggtatttaatatgatcagaaaatcacaattttaattcatcattattgaataatcatctgtagattctttcccactgtgggtcagagagaggagactaggagttttgaggaggtaggtagaaagtgaatgatcagaaacctctgatcaagcagggcaagcagaaaagactcgcccagccactccactcttcttacaaccccatgctcttcccagctcactacaaaataaatgtggctaagtctaagttggatcaagagtgtaatattagaatctgggagaatgttccaaaaattattagccctaaattataaaatcaatctctcttgacttttcagacatcaaaactgccatcaaaatcactgtcaagaaaaattatgtatgatgaaattcactgaaaaagtaacatattaagttcttttctaatgttaaaagagaaaaatctgtgacattagtcagtctccctctttgcctgtttctcttccttcactttcaatctcagttaactttgggtttaacaggggtccaaagttactgttaaaagagagtattggccctttgggcaaggtgacccagaagggttggttggggagacttaggaggtctagccaaaacaggacaagcattgaataccacaataagaatgctctgaataatggaaagtagtattacaaattagagccagttcaaaatcaaggtgaattggtatttatttttctcccaataaatataaagtgtattgtgagtaaccaataaattccaatgatctgttttaaaagctttacttaaattctatataactttttgagtttctttgtgtacgtttttacgtgtgtttggttttgaaaaggaaggagctggaattagtagtatgcaagcctgagaaatcaagtgtgaagataatactgttgtggtggttttagagtatgtccacaaattcttggatacttctccctgcaagggtggaggttaattctcttcctcttgagtgtgggctgtacctagtgacttgcttctaatgaatagcatatggtggaaacagttgtgtgtaacttcagagataagatcataagatctactgtgacttcaacccctctctcttggaacacttgctctgggagaagccagctgccataatcatgcggctactccagaagccctatagagtggcccatatggtgtggaactaagacctcttgctaacagccagcaaggaattgagaccttctgccaatagccctgtgagtgagcgagcttggaagtgaatcctctagtcccagtcaagccttcaggtaactgcaggaggccaggatgataccttgactgcaacctcctaagacaccccaggtcagaaccatctagctaagctgctcctatattccggaccaagaagctgtgaggtcattttttttttaaactgccaagttttagggtaatttgttactcagtaataaatatctaatggaacttctgaaaaaaacatacctccatggtttttagcaattggagaattaaatatcctgaagaacctaaatgtgtaatacctactagaaatacaatgggaatataatacaaatacaattatggtggagaatgtcaatgcacctcgttgatggctggacacatctagtagacagtaagaaaagatagtctagtagacagatcagtaaagacaggttaattgaatagtataatccataaatataacttaatattcatttagacttttatatactttaaatagagaatatacattttttgtatgtccgtgaaacactttcaaatatcaatcacatatttagccaccaagaaaacattaacaacttcggtatgctagagatttccaggctacattctctgaaactaataaaaataatgtgatgcaaaataataatttctcggtaataaagaaacatactatggacaactctcagatcaaaaaagaaattaaaaggggaaagtataatctacctgaaaaattacaccttatattaagatctatgggaaataacaaaagctgtttccatgggtattgatataaagtgttcttttcattgtttctctcatgagtctcagaccagtttctccaactgcctgtttggctattccacttagatgtcctattggatgcccacaggcaccttaaactcatactaatattcaaagctgaactaaatatttttcttccaaaagtgttccccttgctgtattgcctatctactgaatggcaccactcttcactatccacttagttgcccagtctaggaatctgggtgttgtcttcaactccttcattgcctatattcaattggacaccaaacctcagccattcgacctccttagtttaagtcagatctgggcccagttctctatcctcattgccaatgcctttgttcaggagtcatttctcactttgactattgtaataccctttttaattgtagtaagaagcgtggtattacggttaggattggttgagtgagaccgacatgggttaaaactctggctttgccacatgctgtgtgactttgggcaagacaatttaccaccctgagacttcgtttgcttatatatagaatgatagataaaaatagtagtgacttcactaaattattgggagagttaagtgagagaatataaagggtttacatggtatctggtacacagtaagtgttcaataaatgctgttattattattattgtttctttcctccaatttctttacttctaattccattttacctcttctgaaaaggcaaattctgaccatattatttcccatgctgctttttttgtttgtttgttttgactgagtcttgctctatcacccaggctggagtgcagtggcgcaatcttggctcactgcaacctccgcctcctgggttcaagcgattctcgtgcctcagcttcccaagtagctgggattacaggcgcctaccaccgtgccccactaaattttgtatttttatagagacggggtttcaccatgttagccaggctggtctcgaactcctgatccacttgcttcagcctcccaaagtgctgagattacaagcgtgagccaccacgcccggcctgctgatattttccagtacttgctcttgattaacaggataaaaggtaaatgcttgtcatggcctaccagaattttaatgaccagtccttatctaccagtcaagcttcatcttctgcaattctctaacttgaacttttaggtaaaacaattctaaaacaatttgtatttccacaaacacatgctttaatgtctatatcttggtaaatatattcccttttcctggaaggttctctctaccaccttccatttgtttgcctagaaaattctttttcatccttcatgtctcagctcaattgtggcttcttctgtaaaagcttccttgtgcttccactagattttgtacatatctccagtatgcacttatcatattgggttgtaattattgacatgactgttccccactaaactgtaaaattccagggtagggaccatggcttttctgctttgtatgttaaataattggcacagtgcctgtcatgtagcagatgctcaacaaacgttagttgagtgaatgaattaaggggttgccagatgtgcttaataattgttgctaatatttacctggttcatagctgaagcttggtttcttgggcctttttacacttaaatcagcatgtctcacctatatataccataagaaaaataaaaacaataaaacaaaagttccccaaggagtttttaaataatgtgaacactgggtatttttcacatttaaaatataaaactttaagaaagtgatttaagaacttatttcaaaagctcatttataataaatatccatgttttatttggtttatatgacatatgctatttgtagaactgaatttgtagaactcaaaggttcatagaattcattggtattctaaaattaactaactgtggaatcaccctgataagcatggaaggtaatcaactgaacagctaaaaagaatatgtgtggcttttaaacaaagctaagtataggagagacatttttagagaactggaaggcagacagcaggttaaaatgtgactctttggcttggccaagaactctgcttgctttggtgattgtacaggtagataaatgcaacaaagtcgactttatttttttccacatctgagagctggacacaagccaccagaagtacatttcctaacactgataggatgggtgaaacaagttggaaaatagtattgtattctattgtaataaaggtgtttatgctgtttctcaaaataatgagagatatttgtgaccatttgatgtacttattttgcccaacatatttcaaagtctcctttaaaaactggtggtctaaatttgtttattgatattttttggtaaaaatatgtaatattaggcttgccatccatgttaaaataaggggacactttttcctggctctgtattgagaccagtgaaaaaattaactcctgatttgcaactactaaactatctcaaagtagttaagtttcttcctttagatactgaacatactgattatccatgttgacttagtagcacaatgccttgcacatagcagatatttcataaatatttgtttatacagagaagcatattatggcagacatgctaccttttagccattacacataagcaagtctgtcacttagtatgcaattaacacaggatatgccaatgacattttctactttagttatctaaaactcttttgggaagacttcagtaaattacctgcttgatgacgtctctctcaaaccatgttacctttttagaacagcaaaatcagttaatacagtgctaacagagccaacaatgtggatttgattcctataataatcagttggtatcccacagagacaatctatgctgtgacaaggggctgcgccatgaatatctgctgctaactttacagcattagatgactaaggactggtaaccaaggggacagaatgagacaatatggctgtctctgcacaacccatcagcactagaagacaagtgattcacaaaaacccaatttgatgcttcatcttcagagcactagtatgtatcttgaagttcaagtagctcaccagttagcctataacctaagggctattaagtgggaacactcaagttgcttcaggtaattactattaagaatgaaggcaaatataacattcaaatttgagatttgtctaacaaatctcaggcccaccatctttctttttctaactgacaaattgttactggtattccctacatttacagcttggtgacattaacataactgatagccaccagtgtcagtagactaaagtagcacagggctattactggggtttgcatttcaatttttgtaaaaccttactttaggatggttaatttcagggaataaggctgttctaaattgacatttaatgaacgaagttgttgtacaccaatcttgatcataatttcatacttcatttgttctatctacatctggtacaaaagaaatgttacttgcctcttgtctcagaatatctggtaaagattgtctggggacatttgttgttttagcagaaacaactgaagcatgaagtgaggcactttttattcctggggaaaagaagaggtactattaaattgagaaaatgatatagttctccttcctgggctgccataatgtctggaattaccatagtcaaggatacatttattccggttaaggcagtagctccaaggataagatgacttgatgaggtttttaaatttcccctgcctacaaacttctagtggcttgccacttacctcagggacaagtctgaactccctaacttcttgctgtaacttcctttgctagctttatctccctcccaatgagaatgaaatattttgtactttattcagtagccaacagctaccactgaggacttttgagtagagggattatatgccccaaactgtattttggaaaggttacattcacagcaaaatgtagagcaggttaaaaggaagaaaaagaacatataatggagtactattcagtcataaaaagaatgagattcagtcatttgcagtaacatggatgggactgagggtcattatgttaagtgaaataagccaggtacagaaagacaaacatcacatgttctcacatatttgtgggatataaaaatcaaaacaatttaactcatggacatagagagtagaaggatgggtgaccatttacaagaggctgggaagggtagtgggggtggctagagcggaggtggggatgtttaatgggtacaaaaaatagaatgaataaataggcctagtatttgacagcacaaatgggtgattatagtcaataataacttaattgtacattttaaaataacttagagtgtaattggattgtttgtaactcaagtataaatgcctgagaggatggataccccattgtccatgatgtgcttatttcacattgcatgcctgtatcacaacatctaatgtaccccataaatatatatgccaactatgtacccacaaaaattaaaaaacaaaaaataaaatgaaaaggaaaaggaaacattttactgaaaaaaaggaataagaagacattggaggcaaattatggtaatcattaagggcagggataacatgaatggaaaggaaaggtaaattacacagaatgtggcaactttaagatgtagaatatgagcaatgggaaaaagcgaaagatgagccaagttttgtgcctggataaaaaaggaggaagtaagaacaggttttggggtgactggaagatgatgaattttgttttgtgcatattagatttaaagtgctcaatgactacccagatggtgatgtcctagtgtgcctggtggccgtgggtatgtgtagaatatgcatgggaatcttctgtagggactagcagagacttagctaacctctagttcagccttgcggagatgggaagcaggatgtattttcatgtctgaggagaaggatggcagtagaaggtagggacctttttggggagaattttctgcactgggactcccaaatcatactatgttatgaacttactctgcctatcagtaagggcagccattgcaggaactctaacttctccacactttgcaaatcccaaatgacctattcagctaaaaaacaccccagtatgtaagataataacattcataatcatgaatatttttaaaatcttcctttactaaaaataagcacagattttataatcaggaaaataaccagctgtatgacaaaactatttaattgaaaaactacagaaaaattatgaatattatttattttcttacctccttcatttgaaggacatgacagtttagtcatttctttatctttctatatggcttagtattccagagaaaagcattaattagtaattaagcttctattattattttttcaccctgcatgtggtatctgataattaagcttctaaaagagacttttgcctactctacaggcatcaaattaatataatatcttcccctcatcccctacctctctcccaagcactggtctcaatgctaatacatattatcaaccacttgctggacatctctcacagacacctaaacttaactagctcattatgtacccatggactcacatctttccaaattcacttcccttcctgcagttcatattttagttaaagatgtggtgattcacccagtgctccattctaaaagttcagatttgccccgtttatttcagtaaggccactccaattcaatctaatgcttattgggtgcactgcttagacctgaaaaaatatatttaattcctgacctcaagaagcttatcatccagtaaaacagtcagacaaatatgatacagtagaatgagttctgagacagaggtaagcctaagcaccatggaagcacagagaaaagacaccctactttgtgaaaaacctatatacaaaaactgaataatataataataataataataataatcatcatcatcatcatcctcatcattgatatggtttggctgtgtccccactcaaatctcaccttggattgtaataatccccacgtgtcaaggtggagataattgaatcattggggcagttttccccatactgttcttgtggtagtgaataagtctcttgagatctgatggttttataaatgggagttcccctgcacaagctctcttgcctgccgccatgtgagacacgcctttgtttctcctttgccttctgccatgattgtcagacctctgcagccacgtggaactgtgagtccattaaacctctttcctttataaattacccagtctcaggtatgtctttattagcagtgtgagatcagactaatacaatcatcatcaatctccctctcagactccacacatctattaagtcaccaactccagacatagtctaactccaaaatatcttgaatctatatcttccctttcaccctcatgctgctgcctgtttgggcccttatcatttttatctgaactatcccagttcagataaactgggatagttccaaactatcttgtctccaaactatcttgtctctaatctcttttctctaccatctatctcaaacactgcaactggattatctttttagaaattcaaataattcttatgtcatatgcctactcagaaaccttcaatggttccctgctactgagaggatatagtcatacttcagcaaggtgtacaaggctctgacttcaactcaccttttcagtctcatctcctgcacttctctggctatgctggctcacacctccatgctttcaatgtacgcttttcacttgtatctgcaacattggctcactatatcctcacaactactcacctggaaaattcccactcacatttcaggacctaatttaattaaatcctcctttaataaagccttcttcaacctctctaggcaggactaggctttaaatcttctacactttcactacattttgcatcaatcaaaactcccattttattataagaacttttgtttatgtaagtctgacccttagaaggtgattatgtcttttccatctgtatattctgtgtcacccactttttcctttttccttctttctcacttagtacaggacctagctcacagtaggttctcaacaaatgttaactttcatcatcatcatcatcatcaccataatcatcatcatcatcatcaaatgtttaagttactttctgctaaattgcgtggtacatttagcatgaagcttactcagcaccttctttaccagggagaggggtgtgacctgtgtcttaacacaatgatctctagctagtcagcaccaagccagtgaatgggatatcctatagaaataagttaactagacaaactaatgatcaatacaaacatttgaaacacaatttcttctttttgttctgtcgtgttactctatacattccatcaaggatgtaattgcttcttcactttttgatagcaatcttggtaccattttgagaatgatgaactggccctaaaagtaagtaaaagggaaatcatatcatttttaaacaactttgttaaattatgattgaagtacaaaactgtacatgtttaaaatgtacaatttgttcagttttgacatatatatatacatacatacccatgaaacaatcactacaatcaagatagtgaacatactgatcacccacaaaagtttcctttgccctcttatagttcatccccctctgtactgtcccgcaggcaatcaccaatcttgctgtcactataaattagttcgcactttctagaagtttgtatgaagggaatcaaacaagatgtactattttttgtctgtactgttttctttcatttaacataattattttgtgattcattaatattgttgcctgtatgagtaattcattcctttttattactgcatagtattccctggtatatatgtatcacagtttacccatttacccattgaagggcatttaggttgtttccagttttcagctatgatgaataatgctgctatgaacattggtgtttgattctttatgtggatgtataatttcacttctattgggcacatacctaggagtgtaatgactgaattgtgtggtagatgcaagtgtaacttcatttgcccaactattttccacagtggttgtgccatgtttacatccccatcagctgtgtaagagagttctaggtcctcttggtctttgcaaatgcttggtatgaacaagtatattctagccattttactgaatgtgtagtggtatctcacagtagtttaatttgtagttccctgatgagtaataatgttgaacagcttttcatgtgtttatttgccatctatacgttttcttcagtgaaatgcctgtttgcccctttttatgagattgtcctgccttttgccaactttataacattgttgcaaaaatattatatgtattttatattctacatctttttacaatgagaatgtattctagatgtaggtcaggaggcccatatttttcctgtgcttacctttggggcctgacagatgtgaaataaccattgtgcaacagggctattatttcaaaaattttatatcatttctaattcttgactccttcggtactctttatcctagtcttccataggcatctactggtttggtagtggaggtaggggaggtagagtagagaagtctactcaataatttgtaacaggaggaattccatgatacacaccaaggtaatattcagcacctctcatcccaaaataggatgacacaacaagacagttcccttgtaagccatgattgtctcaagaatttccctaaattttttccctgttttgtgtagcaacaacctggaatgcttagctactagagatagccttgccaccattaaaggttatctggggtcaggaagaaggggtatatgacctaggagaaaggtaccaaagaaagatcactcctttagaagctcagagatagtaagaagatggaagagtagtgtcagagagaggctggagagcaaagaaatcagatgtggcttcacatttgccttattctgggccttggttgctttagataattgaagttaacatggagagcaaacaaggggaactatagctccactctccatttaagactctaggaagatagatcttaggttcccccagtccttgcttccaccttttcctcacctgggccatggcccagcaacttggcagtatagtgcagtcaggcccagcaaggttctctctgaggttttggtttcttaagccactcttggttcccatgtggtatagtcatggtccagaaggggctgaaagtctagctggggagctggccagggggagtcactatggtggaagtgagaggactctaccctgagtgttatagagaagccaaccagaattggggtgggggatagacaagaaagccagagggctctactaagcccagggagaccagagcatgagtcagtacactagtggcagacttaaattttgaatgccagtaggctaagcgctatctgagtggagacagaaacatctgtttggagacccaaggaggcagaggacatttcgtctaagcaccctgactttgttctgcctttatgaggtcatggaggccagtgcttctcaaacttgaacatgcatacccacactgggatcttgttaaaatgcagattctgattccgtagggctggggtgaggcctgataatctgcatttctaataagcacctagatgatgcccatgtggctgacgcttagaggagtaagaacataagtcaaacctcttacctcaggcacatggacgccatctttggaaaagaagcagtaagatggggaagcttcctgaaagtctgagccattttgggggctccacaaaggcagaatctaaaggagtatgttaggaaaatcaatgactgagctagaaagcaaaacaaaggaagacacttcaattcaacaaatagtgccagccctacatgtgttcaggaagcctactaaagaagcgggttgaaacattaaatgacagctactactcaggtggggttttctaaaaggaagaggggaacaagagtgggcaatactgggggcacactccactgctgcagaaaaatatgtggcagaataaaatatttctgctgccagtgaagtgacataaattacttttgggcccgaaaggtcccaagtcaaaggaagggcagggttttgagcaagacccatgtcttggtcctcactaggtccctagtgctgtggttccattcagcaatctgcaaggatagttctccaggtggaacaagtgagatgcaggtaaaaaacttccgtaggaggtggaactgctgagaaaggggtggcagcagcagtagcagcagctagtgatgcacaggctgaaaaaaatacctcagaatcttgttgggaatggggaagtacagaggagagatcagaagcaggggctgtggaaaactcagggctctgatcatgcttggagagttgtcaactgcaaaatgtgggctgccctgctcatgggagtgtggaggcagtgacaccaactgagtagttagggcatctaatgcagatggcaatagaagctgtagcactgttggtgagaattactcaaaatccatcatttgatagacgagaatagaggatttatctgcatgataagcaggtcattaccaaatccagtctttccacaaattactcatttctaatgataacatttcaattaaatttttgtccttggtgtggtttctgacccatgggagtgtcactcattttctttctctttgagggagttgcttaaagaaacataatgaaacatttatttttaatagtggggatgacaaaagtatcccagatagattctattcatccttccatgcccaataagaggagagccatatgccgatctacatatggggttgtggcggaggaaatgggagatgacaggcagtggttctcgatgggaggtaattttgtcctccaggggacatttgaaaatgtctggagacatttttgattgtcacaaatgatgggtgttgtgtttctggcatgggtagagggatgctactaaacatcctaccgtgcacaggatggccctccacaatggattctgtggccccaaatgttaatagtgccaaagttgagagaccctggggtagagacgtgtgatgggaaggaaagaaaattacctttagagctgcgcgccgcggcggcggaagatggctgcggccgagttggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaataattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacccggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccaggttatacaggatattgctctaaaaacaagagaaatctttaccaacctagcaccgttttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagaggaaaaaagcacatcacgacaaatgtgaaagccttcattattacacgttccagtttgtctcgctgtgtaggcataagctaatggtttattttcagaaagctgcctgaaacgttgctttgtattcttctaggaagaactttaatttctcctgaggaactctactttctgagccaaactgctaattttctgcggaactgtctagaagatcattcaagagaccctgcagttgcactttctcgtaaaagttaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtgtaggactgaaacagtgaccttatattattgctaagggaatatgagattaacttcctacaggggccaaaaccagagaaaggcttccagcaacttcagtgaaagtagtttggccacatgtcaagccaattgtttgtattatttatgtacctttttcataactggaattgccaaataagcatggaggtctaaatgatgtacttgttagtgtattcattcatattgattgtaaaggattatttttcactcagtactgatgtccttggaaatcttacctggaaacatgtttgcaaaaaacattattggatctttcatctttttcttggtattacatatttgttcaataaaaattaaacaccctcccttttttttgagtgagggcagggagtacctgaaataagacaatgtttactaaggcaaataattgaaaattaaatctgcactttatggaaatgagaaatattaacatcttttttctcatttttttgtattactgtattagctaatgatcaaagttgttaaaattataaatttatgatgcagaaataaaattgaaatattttgatattcaaaaaaaaaaaaaagaaaattacctttatactatcttgtctaattaaagctactttggctctaactagccagaattgtcttctgggagaagggaacaactactttctgttccatgagaacacggcctgcctctgtgtgggaggcagaccagcataataactgtgctggagatcctccaagctagcggcaatgacaattcttggttgttcctcacagcttgacagaggcaaccatataaccatatacatagacctcatctgggaaaaaggtgattacagctcctgtttttaaccatttagattgacaaaaggattcctaactgcatgtgtgctaattgggttttcattagagttttaagatgtgtgtcccttgtgtctgcatggtagaagatgacagccttgttatagtggatatgagtcagttgcatatgtgaaattgatatcctcactcttctgtcacctctataatatagtgaacttaaattcacttatattttctttttcaaaaagggtttgaggtggtcccggtataagatgcctacctgatactttctttctgctagaagtgggtgttaacagttgaaggttaagagccgtatggctgcttacatgatcttttatggaggaggcggaacattatagcctcattatttcactgaactgaactacaagcttgtcttattgactcctcttttataaaattttaattccttcttccctatcatattgtctattcttatcagcaccttcagcatctttttttttttttttgagacagagtctcgtctgtcacacaggctggagtgagtgcagttgcacaatcttggctcactgcagcctctgcctccagggctcaagcaattcttctgtctcagcctcctgaatagctggtactacaggcacatcactgtgcccggctaatttttatatatttcttttgtaaagatggggtttcaccatgtgtcccaggctggtctcgaactcctgacctcaagtgatctgcctggcccagcatctgaaagtgctgggattacaggcatgagccactgcgacagccaaccagcacctctttttaaaacattctcttacacatatccttcctcatttaattttttaaaattttctgctctttttctctttctctatccttttccctccctctttcttccttcttccctctttcttttgctttatttttccatcttttgctctatattttctttattgattcctcctttcagaacttattttttctttcttttctttctctcttgttttcattatttcttgcagtggcgtttcttatggactcttctttgttaaacatctttctctctctctctcttccactctttccttctctctctttctctttaatgcactatcatttttgtaattttttttactctccccttttcaccatcccctctcaaatttattttatcattgacttctcctttcaaaacttttccttttctcttttgtgtaaattcttcctacaggcttcttgcatttaagatttttcttttgtattctatttctatctttctttccttttctttttctttttctcttttttaatgcactttgtttttactggcccctttctgcttgtgaaactttctcttatttttttcttcttgattttactttcttattaactagttctttttaaacatttctttatttcttactctttcctcccttcattctttccttcattccttcccttattccctttgtttttcttgctcccttttatttatttctatttctcctccgttcctgtctgcatgcatgcccacctttcttccttccctcctcccttccttctgccttctttcctcccttttgcctttattccttcctcccttcctaccctctcctacattccctctttctttcactccagttactgagtcctttaaaaatgtttttcatttcctctctttctcttcttatctctttattttttaagtaccaatttttttttaagacagcgtctccctctgttgcccaggctggtgtgcagtggcacgatcttgctcactgcaacctccacctcctgggtttaagcgactctcctgcctcagcctcccgagtagctgggactacaggtgcgtgccaccatgcccagctaatttttttttttttttttttgtatttttagtagagactgcgttttaccatgttagccaggatggtctggatctcctcacctcgtgatccgcctgcctcggcctcccaaagtgctgggattacaggcatgagccactgtgcccggcctaagtaccgactttttaatggagttctttttaaaatcagtttgttcgtattctccctctctgcccgtcttacaactttttccctcccttcctatctagctgtcatccatctgtctatcttattttattgtcacattttaactgacttcttccttatagattggtctttccctgctgtccacagttgtacttttcttactagcttctctttttcaaacctctccgtgtctctcacttcttctcttttttaaaattttatgtagtctttcctacagattcattaatgtaaacttatttttctttccactccttcctccctttttatcttgccccttccttctttcttttcttccttcttttattacatttttctgccttttctcattccatttaagtccctctccatttctctattcttactctgcctacattccttcatttcagctttcctccctctttccctccctcccctgcttccttccttccttccattcgtttactggttcctgtttttaaacatttttcttttcatctatatcttgttctaatcctctctcttcgtatctttttttttttttttttttttgaaacggagttttgctcttgttgcccaggctggagtgcagtggcgtgatctctatctcggcacactgcaacctctgcttcccaggttcaagtggttctcctgcctcagcttcccaagtagctgggattacaggcacgtgccaccatgcctggctaatttttgtattttcagtagaaacagggtttcaccatgttggccaggctggtctcgaacttctgacctcaggtgatccacccacctcagcctcccaaagtgctgggattacggtcatgaatctttgtatctttttatacagtcttttatattgacttacacctttaaagttctatctgtctatctacctatctgcttacctaggtactcacctagttagctatcaatcattattttactattttttaaaaagtgacttctaccttttacatctactccccttcaacacaattgtacttgatttcttattggcttctccctcttactctcatattccttctcttaactcttttccctattgactcatcatttacactcttctttctttcttactttccatcctccttccttctttctttttgttccacttttacacttttactactacctcctcttttatatatttattttgagacagggtctttctctgtcacccaggctggagtgcagtggcgtgatcacagctcactgcagcctcgacctcttgggctcaagcgatcctccacctcagcctcccgagtagctgggactacagacatgtgccacttcgcccagataactttttttttatgttttgtaaagacagggtctcactatgctgcccaggctggtcttgaactcctgggctcaagtgatcctcctgcctcggcctcccaaagtaggattacaggcgtgagccactgcatctggcctgtacctcctctttttaaacatatttcttttcttccctctctcttttgggctactctctcattttgtcagtttaatatggtcttttcttttactggcttttgccttttaagatctgatctgtctatctgtttatctatctatttatctattcccctaatctgtctatcttcctgccttatgcctgctatccttcctgtctacctgtcgcccattaatctatctttattttatgctttcaactgacttctttttagatctctctcctgtcatccaattcctccctttcttctttcctcctttcttccttcctatacttttaaactttctgtcttttcttgttccatttctttcacgaattcatctctgtatttcgttctctgcctgcatgcctacatgatatcccttccttccttctttccatttctctatccaaactcccactctcctgtcttccttcattcattttcccttcatccttcgttctttttcctcccttcttccatctgtcttctccctctcattccttcttctcattcctcttttattctcaactggttcctcttttaaaacttttttactttctccctcctcgctttctttctaattctatctttttcatacattcttttttactggctgctgctttttaagttctgtctatctatctatctatcatctgtctatctattcaaccatgtatttacttatgtatcatcctacctacatatctatctatttagctattatatttctgtctttatgttgattttcctatctccacctttaaaatctgttccttaccacacaattgtatatgatttccttattggcttctccctttcactcccatattttctttattcctttaactcttttccctgctgactcatcatttataaacttccttccttccttccttccctccctccctccttccttcggtcctccttttgtttctccatccatactccctgacatttctccctcctatcttcactcatttctccctcctccttctcacttttttcttccttccctcccttttactttctttcttctatcattccttccttcctcccactgttcttttatgctctttcgattggctcctctttttaaacagtctcccctttctttcactctcattctatcctttttatacattctttttactcgcttctgctttttatgtttcatctctctctctctctctcatccatctacctacctgccagcccatcaacctacatattatagctatcaatcatctactttctttctttacatttgtgttttattttcctgtctccaaatttaaaatttgcttcccccaaagaattgtacttggttttcttattggctcctctgtctcattcttacattctttcttcctttaactgtgtttgctgctaactcatcttctataaatgtcctatttttccatttattttttaggatcagggtctttctctgtcacccaagctggactgcagtggcactatcatagctcaccgcagccccaaacttctgggttcaagtgatcctctcgcctcagcatcccaaaacaccgggataatgtttttttttttttttttttaatatatattttttagagacagggtcttgctatgttgcccagactggtcttgaactcctggcctcaagcgatcctcctgcttccacccttcataaacttttttccttgttcttaagcttgttcttttcttccttcctctctccctccccctccctctttctctcttttgctctctattttattcttagtatatcttttttatcttttatttcttaattcctttttattttgtgacaatatggttctctacctagatctactttattctttatatattttttgtattatgttttctttcttgtctcctttaataaattatttcattctttttctctcttgctttcattatttactgttgtggcatttcttactgatccttgtttgttaaatgtctttcttccctcctttctctctctatcatttttgtagtcttttcttacttgctcttcttttttacatctcttaaatttattttattattggcctttccttttaaaacttttctttttctgtttcttttttgtgtaaagtcttcttacaggttacttgtttttaaacttttcttgttctctgtctttatttctgtctctctttcttttcctttctcttttcatttttatttatttatttatttatttatttatttattttgagacggagtctcgcactgtggcccacgctggagtgcagtggcgtgatctcggctcactgcaagctccgcctcccaggttcatgccattctcctgcctcagcctcccgagtagctgggactacaggcgcccgccaccacgccccgctaatgtttttttgtattttcagtagagacggagtttcatcgtgttggccaggatggtctcgatctcctgacctcgtgatccgcctgcctcggcctcccaaagtgctgggattacaggcgtgagccaccgcgcccggccgctttctctttttatcttttttttttttttgtatagtttattcttattggctgcttcctacttgtgtaatgctctccctttctttctgtttctccctccttccttccttccttcttttttctttcttctttttctttcattctcatattctttattttaaaaaattctttaaaaacatctctttgcttcttcatttttacccctttctacattcatttttcccttctttatttcttatttcctttctctgtgtttttgtcttgctccctttctttatttctttttgtttctcctctgcttgcctttgttcttttgccttcttcccttctttatgccattattccttcctctcttcctgtcctctcctatattccctctttctttcactctctatttactggctcctttcaaaaacatttttcatttcctcttttcctttctaactttctatcttttatgcactgacttttttttattactgggttctcctttagaaaatctcccgctgtcccgtccctccctccctcccttccttccttccttccttcccttccttccttcccttccttccttcccttcttccctcccttccttccttcacttccttccttcccttcttccctcccttccttccttccttcccttccttccttccctttcttcccttcttccctcccttccttccttcccttccttccttcccttcttccctcccttccttccttccttcccttccttccttcccttccttctcttcttccctcccttccttccttccttcccttccttccttaccttcttccctccctccttcccttcctgccttccttccttctttcccttcttccttcccttccttcccttccttccttaccttcttccctccctccttcccttcctgccttccttccttctttcccttcttccttcccttccttcccttccttccttaccttcttccctccctccttcccttcctgccttccttccttccttcccttcttccttcctttccttccttctttacttccttccatcttcctttgtctttatacctcccccttcctatctagttgtcatccatctatctatcttattttactgtaatattttaactgacttctttcttaaagatttgtctttccttgctatccacaattctatgtaatcttatagctccttcttttcaagcccctctgcctctcattctttttttttaagttttgctctttcctacagactcatgacttacaacttctctttctttccatcccctccttcttttctgtcttgccccctcccttccttcttttcttcctttcttgatcaccttttcctatgtcttttctcactgtatttcacgctttctctgtctttgtctattcttaccctacctgcatgtcttcctttctttttttctttttcttttttgatatagagtctcactctgtcgcccaggctggagtgaactggtgcgatctcagctcattgcaaccctccgcctcccaggttcaagtgattttcttgtcacgacctctcgagtagctgggattataggcatgcaccaccacgcctggctaatttttgtatatttggtagagacggggttttgccatgttgaccaggctggtctcgaactcctgaccttaagtgctgggatgacaggtgtgagccactgggcccaacacatgtctttctttcttccttcctccctattgcccttcatccttcttttctaacctacctacttcctttctttcttctttgctttctccctttctcactgcctccctccctccctgtttcctccttccactatttcttttttaactattcctgtttttaaacatttttctttccatctctcttttgttctaaccctctctctttatatctattccatacagattttttgttttgttttgttttttgtttttttttttcaagaccgagtcttgttctgtcactcaggctggagtgcagtggtgcgatcttggctcactgcaaactccgcctcctgggttcaagtgattctcctgcctcagcctcccaagtagctgggattacatgcgcccaccaccacgcccagataatttttgtatttttagtagagacggggtttcaccatgttggccaggctggtctcgaactcctgacctcaagtgatctgcccgcctcggcctcccaaagtgctgggattacaggcgtgagccaccatgcctggcctcatacagtctcttatattggcacatgccttttaaagtcaaagtgaaagtttggaacagagacagttaaagaaattgagtgagaaaagacagaaaatttatagaggcaggcacgaaagaaggaggaaaaaagggaaaaactggagggagcaagcaggagatgttaaaagaagaagctagaccaggcacgctggctcacgcctgtaatcctagcactgtctaggattgtgtctatctgtctttctgtttatctacttactaaagtccttacctagctatctatccatctttattttactgttttttaaaaagtgacttctactttttaaatctcctccctttcacacagttgtacttgattttcttattggctcctccctttcactccatatttggtttctcctctttaactcctttccctattgactcaccatttgtaaatttcttttcttctttcttatttttattctatcttcctttcttcctcccttctttcctccctcccttcaagtctcaatttacactttttctagtgcctcctcttttaaaacctatttatttccttccctctccttttttttgtgggggggggtgctactgtctctttttattaatttcatatgttttttttttgttttgctggcttccaccattaagaccaaatctatctatctatctatctatctatctatctatctatctatctatctatgtatctatctatcatctctctatctatctatctggtccatctgcctacctgttttcctgccttatgtctgccatcctttgtatctgtctttctttatttcagtctactttcaactagctgctgctgctttttttttttttagacagggtctcactgtgttgcccaggctggagtgcggtggtgcaaacaaagtgctaagattacaggcgtgagccagtgtgcctggcctagcctcttcttttaacatctcttgcttgctgcctccagttcttcccttctttttcctccttctttcatgcctgcctctataacttttctgacttttctcactcaatttctttaactttctcttttccaaactttctctttttgttttctgcccccatgcctaactgccttctttcctttctccatacttctctccctttctccctttctcctgccccattcatccttacttcctgctcacttgcctgcccgccttccttccttccttccatccttcttttgttgccccatccatactgttttctctcccctcactctttctttctcattttttcataccttcttttttaaactagtttctgccttctctctgtctctcactcacacatctatctacttacttgccaacctacgtactgtctagctatctattcagctatcaatcttctatttttctgtctctatttttctgtgttttttttttggactccacctttcatcatctgtttgccattgcaaaattgtacttggttaatttcttatgggctcccctctctcactctaatattccctttcttttaaaaaaaatctgttttccctactgactcatcggttataaatgtcttccctccttcctaagttcctctcttcccctttctccctttctctctcactttacttcactctttccatctttttgcactaatttttgtattggctcatttcagaacttatttcattctctttctgtcttgcatttattattttttgcagtggcatttcttattgactcttccttgttaaacatctaagtttttctctcttcatcgctttctttccttctctttttcatattctttcttaattgctccccccactgttttttacatatttatctctatagctctcttgaatatcttttattgttggcaccttcttttacatttttcctttttctccttctcttctttgtaaagtcttcttataggtttctcattttaaaactcttctctcttttttgttctgtcaatatctgtctctctttccttttctacttctttatatctttttttcttatattttttggtatactttattcttctggctccttttgtaacaatagagggaggcttagcatgactgactccatttttgcatctgactccctgtggtaatttcctttaggttaaaagcttctgctcagctctgcatgtatgcctgctaattgtaggaggaatttagcttatagttctatgtcacggcatgttagaagatagtacaacaggccaggtgcagtggctcacgcctgtaatcccagcactttgggaggccaaggagggcctgtgccaggcctcactctctctttactttgcttgcctgcatgcctgcctgccttacttccttcctcccttcctccaataggtcttttttttatttgtttttataggcttcttttaaaactgttttctctacttctccatctctttctctctccttccttttttttgtcctgtcttttttactggattttcttttttaatgtcatcttacttgcctactctctctttgtctctttatctctgtctctctctcttcccaaccttctttacttattccatggtttctttctatattttcttgtactgcctttttttttattggctcttccttttaaaagtctgttcatattttctatctatacatctatcatttaacattactgtcttctttttaagtctctctttttccttactgagctattcttattgatttacccctttaatcttccattttctttgtgctttctctccttttctatttcccctctttttatttcactttttcttattcattttttttgttttagttctatatattttcttgtactggctttcttactgcttccttcttattttatttttctccgattttcttcttcctcccatatccttttcttttattcagtctgtcttcatcatactgcctcttcttactgctttctccttttgaaagtgtattctggccggacgcagtggcccatgcctgtaatcccagcactttgggaggccgaggtgggcagatcacctgagctcaggagtttgagaccaccctggccaacatggtgaaaccccttctctactaaaaacacacaacaaattagctgggcgtggttgcatgtgcctgtagtcccagctacttgggaggctgaggcaggagaatcgcttgaacccaggaagtggaggttgcagtgagctgagattgcaccactgcactccagcctgggtaacagagtgagactccatctaaaaaaaaccaaaaaagtgtattctacctacctatctttgttttcttttactgacttctaatttttaaaaatgacttttcatttttaatctgtcaccccctgccaaatgtacttgattttctaactggcttttcttcaaatttttctctcactttcacgttctatcgttttcattttattttttcctactgacttatcttttaaaacttctttctgttctatctcctgctctcccccattcctctctacctcacctccccctttcttgttcctgtgcctttttttctgtatgtctttttcttgctccctttctttcattttcttcctcctcccccaccctctttcagtctctcatttgtttctttctctttgttctccctccattccttcatccagagtgtgtgcttgtgttttcctactggctgcttctgttccattttctttctttttctctctattctctttctctccctctctccatttcattctttgtttctgcactgtcttctcttaccacttcctccttttcaacctttttgttcttactttttctctgtttcttgctttgtgtatttttaaatgtcttttcctttatattcctttacaacctttttctctttgtctcactaactctctctctctctctctctctctcgagagagagagagagagagaggagaaaaagagagaggagaaaaataagacaaaaaagagaggagaaaaggaagacaaaaaccctcttgccagcatccttttcaatccttgccagaaaaacatccttgccagaaaaactcatgtacagagggtttctctctctatctctctgcatacagacacgtgtgtgtgtatgtgtgtgtgtgtgtgtgcatgtacactctacacctggagatgtaactaagaagtgccttacatagtacctggctctaggaacatgaactcttaggacttacctttgcaagggccttgtgacctcactgtataagcagagggggtttttataaagacaacaatatttaatatacagggatgcatcttctatgtagccactttttaattgtctctctctctcaccttctgtttcatcttgtcgtttgttttcaaatgcactttcctctggtcttcatcttacaggtcatttttaaaacattgtttgtaaaaataggtaattgtttttctctagaagtgcttgtttctaaaatatttttaaaaataggctgaatgtggcggctcatgcctattattccacgactttgggaggcctaggcaggaggatcactcaagcccaggagttcaagactagcctgggcaacataatgagaaaccatctctaccaaaaacaacaacaaaaaaatatctaggtatggtggtgtgcacttgtagtcccagctacttgggaagccgaggtgggaggatcacttgagcccaggaggttgaggctacagtgagctatgattgtgccactgtactccagtttgggtgacagagtgagagcccgtctctagaaaaaaatacaataaaataagtaatacataaatatatatttaatatattttaaaagtttagtatcaacttgccactggcaaagcaaaatagagatttcaaatgtgatggtatatttgaagtgaaccctcaattcctatcttgacatttctaaagtcacaatgagtacaaagctagaaagataggggtaaatatccttttgtggtctagcatgaagaagaatatattttaataactaaatccaatttcacttactggccactttctggagacaagtctcatttcaggccagcccttgaagtataggttcaggccagaatgggtctatcagtagccttcttcatgagtttaggccatttcagacaattcacatttaaaaatagcaaaaatggccaaagcatttcctcaaacagcccaagtcattggtaaaagcccactctactaccttccagccagtttgtcctcaggttttctggtgtcattcttcagctcttgcttctctatttacgacttaatttttgtcagacacaacaggacttttttgccttccattcataaggaacacaatgttacagtagtcagcatggattctctttcataataattatttttagtatctactaccaataaggaaatttgagcaaatcaatggcctaatagaaatcaggtcaatcataatgaaaatcttgcattggctttaaatgggcttattttactgtgttttattgggaaagtgttggtagatgcaatggaatggcagtaggaaaacttattttgttattagacacttaattcaaacctaagctggctccaaaagtggattggaaaggatgctggcaaaaggattttgtcttctggactcggggtgtatggtgtgtgatctcatgttcttacatgtattttgacagggaaaccagacagatagtagccttgtgtgaatttggggcagtgagaatacaggcatgatttttttcactagagctaaattctaaaactttaaagagcagatgagatgtaactatactgtaagggatacataatttgtggtatcagtctcattattttaagtaaaagcttgggccaggcgcagtggctcttgcctgtaatcccagtactttgggaggctgaggtgggtggattacctgaggtcgggagtttgagaccagactgaccaacatggagaaaccccatctctactaaaaatacaaaattagccgggcatggtagcacatgcctgtaatcccagctactagggaggctgaggcaggagaattgcttgaacctgggaggtggaggttgcggtgagccgagatcatgccattgcactccagcccaggcaacaagagcaaaactctgtctcaaaaaaaaaagcttgtatattatcacagtgataaaatattaagaggacttattttttagacctgaaataacttcaggtaatatgataagactgctaaaaatgtttataaataaaacaggcagacagtttttcccttaatatttaaaatccagtgttactcacctcttcaatttgtctacagagatcaagatttcttcttatgtggtcctgtattgggggaacctgcccccaatatttcaacataggttctttctattttccataagtgttggccggctgagaaataaagagaaagagtacaaagagaggaattttacagctgggctgccaggggtgacatcacatattggtaggactgtgatgcccacctgagcctcaaaccagcaagtcttttattaagggcttcaaaaggggagcgggtataagaatagggggtagatcacatgcttcaaagggcaaaaaggagaactactgataagggtccaacaaagataacaaggcaaaaggcaaaaggcaaaagcggaactactgataagggtctatgttcaccggtgcacatattgtcttgataaacatcttaaacaacagaaaacagggatggagagcagagaacttgtctgaccacaaatttaccagggcagagtttttccccaccctaataagcctgagggtactgcaggagaccagggtgtatctcagtccttatctcaactgcataagacagaccctcccagagcagccgtttatagacctccccccaggaatgcattcctttcccagggtattaatattaatattccttgctaggaaaagaatttagcgatatctctcctacttgcatgtctgtttataggctctctgcaagaagaaaaatatggctctttttgcccaaccccacaggcagtcagaccttatggttgtcttccctttttccctaattctgttctttttcaaggtgcactgatttcatattgttcaaacacagattttacaatcaatttgtacagttaacacaattatcacagtggtcctgaggtgatgtacattctcaatttatgaagagaacaggattaaagattaaagtaaagacaggcataagaaattataaaagtattatttgggaactgataaatgtccatgaaatgttcacaattcatgttcctctgccacggctccagctggtccctctgttcggggtccctgacttcccgcaacagtcttcatatcgtctttttttttctttcatcttgagtacactctgctttcctgctgtgtccaatttcatataatcatatatcaatatctacataaaagtgcaaatattggctgggcactgtgtcccatgcctgtaatcctagcatttttggaggctgaggttgggggatcacttgagccgaggagtttgggaccagcctgggcaacatggtgagacctgtctctactaaaaataccaaaaattagccaggtatggtggcatgtgactatagtcccagctactgggaagttgaggctggaggatcacctgagctcgggaagttgatgctgcagtgaactgagagcatcccactgcactccagcctgggtgattggagtgaaaccctgtcccaaaaaaaggaaaagaaaaaataagtgcacaataagtgaaggtaaactgggtgttacccttacaatggcattgcctgctttgatattcccaaattacctgcttcattgtttttttatttcttgagctacagaaaatttaaagttattcaagcctgatccactaactcatcatgctgcactcatttttacctttgttgtagaattttacctttgttgtctttgttgtagaattgtctattattatggctaggacaatggcaaatgtgatacagagtgattgaaaacattttacatagaaattattcataactcagtagtttggggaacatgagtttctaaagatgattggaattaactgaaggactgactttaaaaaaacccagcagatttgaatttccttgaaaaaataagtggaggtcttatatatgaggtctatagactatcagcctgggattctggtggatcagtttgtattctggcatattgtgatgaatctatggaatataagaaccaggggatggagaactggcccttaccccgataaaggagaaagagaaagaattataactcatcctttcatttcccgaggcatgggcttgacttctgagtggtatcattgaatatgtgtgggtagtagctgaatgaacatacatagttggttggggaatgacacctgtttacattagcatcaaataaagttatagcaactttcctgttttgaccttgcagtaatttccttaaacttaagtttgaaacatatgctaaaggcaccttctctctccctctgctattgtagactgggtttcacaagatcagggatttgtattttggatttcttcttcaaacatcagttttgcttatctcttgggtttctagtggctccaacttcttaggtagaaactctcctccctattcttggtaccaaggttcccaatttctgtacttcttggtctggcttcctttctctgcatgttgaaaactacagggagccaggcatggtggccaacgcctgtaatcccagcactttgggaggccaaggtgggcgggtcagttgaggtcaggagttcaggatcagcttggctaacatggcaaaaccctgtctctactaaaaatacaaaaattaggtgggtgtggtggcatgtgactgtaatcccagctactcaggaggctgaggcaggagaatcgcgtgaaactgggaggcagaggttgcagtgagctgagatcaaaccactgcactccaacctgggtgacagagtgagactctgtctaaaaaacaaacaaacaaacaaaacaaacaaacaaaacacacacaaaaaaaaactgtagggaggttagggaggttaaacagtgtctagtacttttgttcgtcctatttttaattatttctagtattgatacaactttttgggatccacaatgtccacaagaattaggcattagctttcattatacctatgttttatgaaaaactattggtccagacctgtttgtgtaccttcctgtaatagccattcttgaaattgggcagtagcctaactgtcacaggctctctttgttttacataatttatttaccttttcaatcattttctgaaacataaaaaggagtaaagcctttatatttgccagacataaacctgtcctttgatctgtcttatgtttcaggcttagtaaacatcctatgctttgcaaatggctaattctgttagcctacatttaagtctagtgtggctccatttcagacaggtgaattttttttctctagaaatgaaagacaaatgtctcattttatcttttacagatcttttatagaggtcttagccttttgatttgttaccttaataaatacttctaggtcaaaatattataagaacatattctgcgtaggaccaaaccttacataaaacttttcttacaggccccaaataaacaaatttaagtatttaacttacttgttctcttatacagtttctttcaaagtctaattttaaactagtcacatactgcctgtatttactcaactccttcaagggacatataacctacaaaaacaaaaaccaacaatataaatacaaggttgtaacaatgataacactttacagaggagagggtgaaaagaatattcattttaataaaaatttgggataaggtctaataacaacatattttggtgacaattttgaagtcagcatctttatacaattgctgtctcaccaagaaatttctatccaaacattgttttattagtatggttcatatcataatcaggaatttactattcccaatcaaattgttattaaaacacgtatataataatgatgcttaactccccaaagaatttattctatcaatctgtattttgctagtttctcattttatctccagttttctcaaagtgtatgagaaatattctttgacaggtagacggtgatattaccacttttggagccagaggaaaagcactacaatacaactgggtgaaaataaataaataaataaataaataaataaataaataaataagtgtgtgtgtatctttgcatactcaaatcattggtaatatctgttgctattaaaatggaaataaaggtcaagtaggaatgagttttatttagacaaaacagctacctgatttcccttggccccagtactgagttattcattgagtcttttattgggagtcctctactgctcaattgaaagttgacacaggctcccagtgaggtaaagggaagcacctaggtcttggctggttaacaggaggtatgcttcaatgcactttattattgctagtgatgtagccacccttctttaatggcctcagaatatcttttcactgatagtttgtttttaaatgtgcatcatgtagacttttataaacctggtttcctaaatttggcagtaaggatcagtcaggttaaaatcctaagaaggttaaaaaagccacaaacaagtagattcaaaagcattacaaatgtaaaaataaacgaagccacacttttaaacatcaatttatttaaatgattaggctgttcactgaaaataaaacttgcaagcagaatgggaagtgagagaatacagacaatgggctgatttgggtaaacctaactgctttctctctctctcctctcccaggcctgtctttaggctggaagtgtcctgtggaatccctatctgtgaaccctatattcagtcttcctgtagcctcaacctcagtccaattcctgaacacagaggttgggattgactgttgtgaaggagaggaggagagtgcatgtcaagtttcagtagctggatggacgaaggcacggaagtaggaatcagcagggtatgtgtgggtaggcagaaaagaccccaacctgtcagtgaagactcttgggttggagataaggttggatggggcggctgaggcatatcatggggctttctgtcattaaaatgaggtttaagaatttaaacacttcaactcatttaacttggtatgtaaaactgaagttaacacaaagcaaaatcatagcaaaatgtttcccatttaacagcaaactgaaaagggtaaagaaaatcacttaagggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccatgcgcgagccgaagcagggcgaggcattgcctcagctgggaagcgcaaggggtcagggagttcactttccaagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaacctcgctgattgctagcacagcagtctgagatcaaactgcaaggcggcaaggaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgatgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcctatccagccaaactaagcttcataagtgaaggagaaataaaatactttatagacaagcaaatgctgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaatgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacacattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaactacatgattatctcaatagatgcagaaaaagcctttgacaaaattcaacaacccttcatgctaaaaactctcaataaataaggtattgatgggacgtatttcaaaataataagagctatctatgacaaacccacagccaatatcatactgaatgggaaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcatctcagcccaaaatctccttaagctgataagcaacttcagcaaagtctcaggatacaaaatcaatgtacaaaaatcacaagcattctcatacaccaacaacagacaaacagagagccaaatcatgagtgaactcccattcacaattgcttcaaagagaataaaatacctaggaatccaacttacaagggatgtgaaggacctcttcaaggagaactataaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagccctcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttctttacaccttatacaaaaatcaattcaagatggattcaagatttaaacgttagacctaaaaccataaaaaccctagaagaaaacctaggcattaccatccaggacaaaggcgtgggcaaggacttcatgtccaaaacaccaaaagcaatggcaacaaaagccaaaattgacaaatgggatctaattaaactaaagagcttctgcacagcaaaagaaactaccagcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgctgccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacgagttagtgggtgcagcgcaccagcatggcacatgtatacatatgtaactaacctgcacaatgtgcacatgtaccctaaaacttagagtataattaaaaaaaaaaaaaaaaaaaagaaaatcacttaagcactattaaaacttcgtttaccttctcacttagaactgtagtatagaatacattatcgcttcctgggataacaggcagcttgaccccaagacacagatccaaaagatgatatgctctgacctctggaatggggttttcctgcgagctctgtcagatgcaattggaagtttgtattttcttctgtatattggtgcaaaagtaattgaaagtaatggcaaaaccgcaattacttttgcaccaacctaatagaaattattcatttagtttagaccaaacgtattattacttcctattaaataggctaatacctccaaataaaccaaagaaccatgcattcggggttgaaggaacccgccaggccggctgacaacttggatgtcctcgtttttctgggttaccagttctacctctcgacccctgccagtggtggccagtggccgccaaagccaccggctgcccagagctaaggggctgaaagctgagcagtcaagaacccgcctcgttccctcccactcgcggagatctccctactcggtctgtccgccttccggagaccctcatttggggccacgagtaggaagacggaccggcctccactcacggtgcggcactgcttcttgcctgcattcaggctgctggcggccgccttagtggcggcggcttcggcagccttatagcagttgccgaggtacagctccagagccagccttcagtccccagggggccagacgctggggtagcaggcggtcctcgtttctcctcattcacacccttcacgctttaggtcctgatcaggtgtgggctgccaagatcgtggtggccagagtagaacgtcctctaggccacgcccctcacaatgctgccttctaggctggagagctgacgtcctcaaggggcgtcaccctcggaggtggggtgggcagcgggtgagtggggagtggtgaccgctaagcctcaccagacgcacaggcacacgagacttcagccccttagagtcgaaatttaatatctctttgaaaccaatacccctcatttaaactaaaccaaaatatatcaagctttgtccatggtagctgtgatcgtactgatttctgttcaacaaacttcgatgagtaattgtgtagtttttattagggccataggactgacttttacatctatctcctttatagacactgtgaccctccttcccctaggcataccacccccagtcccatgtagaacacttggtttcttcaagggctcaatacatttctccttgtctttctcttctctgtcttgggctcattatctctctcgccctcctcttcctctttctctctttcttctacttatttgtttctaccttctcattcagtcagccaacatttattgagtgcccactctatgccagactctgctggttcctgacagtgagtacactgataaaacagtgagtaaaacatagtgtctgctgccaagaagctcagtagaatgaaaatatatgaaggactgagactgtacctagttcatgctctgtctccacgttatctatcatctatctatctatctatctatctatctatctatctatctatctatctatgtatctatctatctatcatctatctatctatgacacattatagttaaacttctgaaaactaatgacaaagacaaaaattcttgaaagcagtcagagataaaagaaacattatttacaggagaacaccaatttgaatgtgaatttgaaacgatggaggcccgaaggaagaggtgcagcattttttaagtgctttagcattttcttttaagaaacaaattgtcaactgtgaattctatacctaatgaaaatatctttcatcaatgaagaagaaatagagacattctgagatgaaggaaaactaaaaatgtgttgctaacaaacctatcttaaggaatggctaaaagaagttatctacgcagaaaggaaatgataacagaagtaggcttagaacttcagaagggaaaaaaaacccataagaatggataaaaatagggataaatataatagactattctatttttcttgagtttcttaaatcatatttgatggttgaagcaaaaagtataagagcatctgatgtggtggtgaatacatgtaaaggaaatatttaagacaattatattttatttttccctttcaaattgtattttaggtttgggggcatatgtgtaggtttgttacatgtgcaaattgtgcattgatggggtttggtgtgcaaataattttgttacccaggtagagagcatagtacatgataggtagttttttgaccctaaccttcctctcattctccaccctcaagtaggcctcagtatctattttttccctcttctaaaacaattacattttagaagtgggaagtgcaaagggacataaatggaaataaggcttctacactttattcaaagtggtaaaatattaataccagtaggttgtggtaaactatatatatattttgtaattcctagagcaactattaagaaaactatacgaagtgatatattcaaaacattataaataaatcaagataaacttctaacaatgttcaagtagcccacaggaaggcaagaaaagggaaatagaggaatgagaaacaggggaaataacagaaaacaaataaaatggcagatttaagctctaacataccagtaattacttctctaagcgtaaatggtctaaactcagtaatgaaaacagattggcagaaccaattaaaaaatacatgatccaactacatgctatctacaaatactatacactgcaaatacaatgatacatgtaagtaggctgaaaataaaaggatgggaaaagatactcaaagcacatttgcatttgcaaaagtaggagtggccataataatatcagataaagtagactttaattgctagagacaaagagaaacattacttaatgaaacaaagatcggctgggtgcggtggctcatgcctgtaatcccagcactttgggaggctgaggcgggcgaatcacaaggtcaggagatcgatatcatcctggctaacatggtgaaactccgtctctactaaaaaatacaaaaaattagccgggcctggtggtgggcacctgtagtcccagctactcaggaggctgaggcaggagaatggcgtgaacctgggaggcggagcttgcagtgagccgagatcgcgccactgcactccagcctgggtgacccagcaagactccgtctcaaaaaaaaaaaaaaaaaagaaagaaagaaagaaagaaagaaagatcaaaccaccaatccaccaggaaatcaatggacatgcaccaaataatagagactcaaaatacatgaagcaaaaaaacaatagagataacaaaagaaatagacaaagtcacaattataatgtgggacttcctaaatgcctatcaacaggagactggacaaataaagtttatgcttcgctcatgcccatatagcagtttaagttgaaagacttggagctacgtatattaacaacatgtatttcaaatcataatcttgagcaaaacctaccaagagttgatataactgtggaatgacctaacttatttgaatcatgttaatggataattatttatgtagtagtagcataaaatcctgcatgaaaaagaggaaaataaatacagtatagtagtatctctagggagaaagggaggcaaatgaaattatgaagggatatgaaggacgctttcacttcatctttcatattgtatttcttaaaaccaagtctggctcttcttttatctcttcctgtttcctgttcttttctttcccttctcattacttctagaacaattcaagaggtgggttggagcaagataggtgtccaaatagaggtgtagctctagatgttggtgcttaactggggtaaggaggggaaccacagatgaaggcagcctgaagtggaggcagagcctgaagaaagtgaaaaagttgttccttgtgggggttggtttggtgtaaagaatcagaagccaggaggagaaaggaagccatccatgtttaaggggagctaagtgagggatgtcagagcccaagcagatcaatgaaggtgtttacatcaaagatggtctggcatgggattcagagcatgagtagagtgagggggctatcaatgtatgggacagcataggatgtcagagtctgtgctagttacccagggctgccatgacaaagtaccgcaaactgggtagcttaaaacaacagaaatgtactgtctcactgtcttggaggctagatgtcttaaacaagagtgggcagaaccttgctttttctctgaaacctgtaggggagtccttctttgcctcttcgtagtttctggtggtttgccagcaatctttggtattccttggcttgcaattgcataaccccaatctctgccttcattgtcagatggaattcttctggtgtgtcttggtcttctcctggctgccggcttaaaaagacacaagttatattgaatcagggacccatcttggtccagtatgacctcattttaacttaactaattacatttgcaatgaccttatttttaaatgagatgacattctgagatactgggggtgcgaacttcaacatttccttttctggagggcacagctcaacacatcacaatctgttctttgccccgcctccccaaattaatgttcttcccacctgcaaaatacattcaccccattttaatactcacaaaagtcttaacgcattccagcatcaacgttatgttcaaaatctcatctaattcagggatgggtaaagtttgggccatggtccatcctgaggtaaaattcccctccagctgtaaatctgtaaaacccagaaaacaagttatctgctttcaaaatacaatggtgggacaggcataggataaacatttccattccaaaatggagactgggctaggcatggtggctcatgcctgtaaacccagcactttgggaggctgaggcaggtggatcaagtggaactcctgaggtctggtgttcgagaccagcctggccaacatggtgaaaccccgtcactactaaaaatacaaaaattaggcacgcatggtggcgggcgcttgtagtcccagctactcaggaggctgagacaggagaatcacttgaacctgggaggcagaggttgcagtgagctaagatcacgtcactgcactccatcctgggcaacagagtgagactcgatctcggaaaaaaaaaaagagactggacggtaaaaaggtctaaggcagtttgcaacacagcaggtaaaattccattaggttttaaggcttcagaataattttctgtggctttgtccaatggactcacctcttcatccttaggtggctgccccaatgtctgtaaagaagaggctaccttgcccctggttcctcatccttatatggcaatcctgtcccctgaaccctgggtagaggtcccgcccactcaggccttggcagtcacctggttctctggaacccaggagatgtctctgccctctggaaatgaggaggcaaactgacgctctcatcccagagcagtggtcccaccctttgaagaaagagggggatgctaccctatggaactcaggggcccaccttaccatctataaccaaagattccgcttatcccattggtcctggctggtgaccctgacccctcaaacctgggcaggagccccatcttctgcaaacatagaagatagccttatcctctggaaatgagaaggcagcctggtccacagggtcctggttggtggccctgtcccctcattcctgagtggtggtgactcaggcccctgggtctgaggcagtggctccacactctggaaccctggaggtggctctgcccctcagaattggatagcagccccgccctctcagccctgggcagtggccctgctgggcaggaaccctggaggtagctccacttcctggatcctgggcagtggacctgccatctgtaaacccagagatggctctgtaccttcagccttggaaggcagccctgccgtctcagccctgggcagtagccccgcactcaggaaccttgcaggtggctccaccccctcagccttggatggcagccccaccctctggagtcttaaaggtggctctgccctttcagcccttggcagtggcctaattctcaggatccttggaggtggttctgcccatcagccctgggaaatagctccgctccatcagtcttggatggaaacccggctctctcagctatgggcagcagcccgaccagctggaatcctggggatgacctcactccctcagccttggatggcagccccaccccttcagcccagggcaatagccctgcccccaagaattctggaggtggttctgccccctcaggcataggaagtggctctgtcccctggagccttggaggtggctctgccctctctgccttggatggaaacccgccctctcaggcctggcagtggcctcaccccctcagccctggatggcagcaccaccgtctcagccctgggcagtggcctcgcctattggaatcatagaggtggctcctacccctcaggactgtgccgcggctctatcctctggtactctggtagtgacctcaccccctcaggcttggatggcagccccatcctctcagttttcagcaggggccatggactctagaatcctggtggtgactccactccctcagctttggatggcagcaccaatccctcagccctgggcagtgggcccaccgtctggaaccctgatgacaatatcagttccgcagccatgggtggcagccccaccctctcagaactaggcagtggtcccgccatctggaaccatggtgatgaccccaccccctcagccgtgggtggcaacacagccccctcagccctgggaagtggtcccaccttctggaatcttggtgatgacccaaccccctcagccttgggtgggagcaccgccctctcagccctgggcagtgtcccacagtctggaaccctggtgatgaccccaccccctcagccttgggtggcagcaccacccccacagccttgggaagtggtcccaccatctggaaacctggtgatgaccacaccccctcagccttgggtggcagcaccacccccacagcctgggaagtggtcccaccatctggaaacgtggtgatgaccacacccactcagccttgggtggcagcagtgccccctcagcagtgggcagtggtcccgctatctggaaccctgttgatgaccccactccctcagccttgggtggcagaaccgccccctcagccctggccagtgggaccaccctctggaatcctgttgatgaccccaccccctcagccttgggtggcagcacagccccctcagccctggacagtggtcccaccatctggaatcctggtgataaacccacctcctcagccatggggggcaaaaccgccccctcagccctggccaatgttcccactatctggaacccttttgatgaccctatcccctcagccttgggtggcagcaccaccccctcagccctgggcagtggtcccaccctctggaaccctggtgatgaccacaccccctcagccttgggtgacagcaccacccctttagccctaggcagtggacccgtgctctggaaccctactggtgacctcccctcagccttgggtggcagttctgcctttgcagccttgggcagtggccctgtgctctagaactctagtgatgacctcaccccctcaaccttggatggcaacactgccctgggcagtgggcctaccatctggaaccctgctggtgacctcaccccttcagccttggatggcagcactgccctttcagccctgggcagtgggcccaccatctggagccctggtggtgatctcattgcagcagctgtgggtggccacatcaccctctcagccttgggcagtggccctgtgctctaaaatcctggtgatgaccttgccccctcagccttggatggcagccctgcactctcagccctggttagtgcctccacccttggcaaccctggaggtgaccctattcccttacccttggatggcagtcccaccctctcagccctgccagcaaacttactctctagaaccctactggtgattctctctttcagccttggatggcaacaccccccacccccgcttctcagccctgggcagcagcaccacctctggaatcttggtagtgtctccacccactggaaccctgccattatcccgacaccctcaggactaggcagtggtcctgggatccctggtggtagacctgtcccctttggccctggggagaggtcccaccccctcaggcctgggcagtggccctgttctctagaatatagcaggtccaaatggctcagttatctgcatgtatcgctttcccagtcattcttccttcattttgtccttttcagtttcttttagtccaggctggttgtgtttctgaggtataaaattctaaaaaaattttgttggcttcccctgcaattcatggaggtccaagccaacagaaaagagggtactttatagatctttactgtataactgcatctcaattcctggcttctgctagatggttgattggatccataagtcacaattatggatatctgtaagtcataatatctttatcaatggttgttctgccatacttttagtcttctctccagaacacagcttgtttctttctttctttatttagagatggtgtcttgctctgtcacccaggctggagtgtggtggcattatcatggcttcctgcagccttgacctccctggacttagataatcctcctacctcagcctcctgagtagctgggactacaggcacacaccaccatacctggctagtttttgtattttcttgtagagatagggttttgccatgttactcaggctggtcttaaactcctgcactcaagtgatctgcccactttggcctcccaaagtactaggattacaggtgtgagccaccatgcccagccagaacacaggttatttacttttttgcaatatggttaggttgagaatattacaaatcttcaagttctggttcctttatgcttaacaatttgctccttaatttatctatttcctttctcatcttactctaagaatcaaggcagaaacaggatgcatgttacacactttccttggaaatttccttctttaaataaacaagctcatctcttacaagttctacttccttcccaacagtagaagacaattcagccgaatcctttgacattttataatgaagatcacctttcttccaatgcccaataccaggaagctcaccaaaagtacctttaacatttacatttcaagcaatgttcactttaaggcaatctaggctgcttctgtaatgagcctcaaaatgtttccagcctctgcccattacccaattacaaagctagtttcataattgtaggtatttgttacagcaaggatcccatttcccaataccaaaatctctattagttttctagggctgccaaaataaactaccacaaactgggtgcttaaaacaatagaaatttattgtctcacagttctggagggtagaaatctaaaatcaaggtgttgatagtgtggagtcctaactagggaaaaaatagttgggatggtgggactgagagaaaaaaaaagaaaagttatgtctgccttttttttctttttgtttcttttttcttttttttttttttgagatggagtcttgttctcttgtccaggctggcatgatctcgactcactgcaacctctgccttccgggttcaagcaattctcctgtctcaacctcccaagtagctgtgactacaggtgcatgtcaccacgcccagctgatttttgtattttagtagagatgggatttcaccatattgatcaggctggtctcgaactcctcacctcaggttatccacttgcctcggcctcccaaagtactgggattacagacatgagccaccgcacccaggctatgtccgcctttcttcatagtccaggacacacagcccgcttgcacaaataactcacaatcttcctgtgtccagctattaccagacccccaggtaacagaaaaatgcaagttagtttccagtactgataaccttggcattatcagtactgcacaaagccctcatcaggacacagcacaagtatcatactataaaatccccagcaagcctttgtctatggcagtcagctcctctcttgctaacttgcccattgcagtcttgcattgtgtttttgtactttagtaagtcatcttttctttacttacaactatcttggttaattcttatctgcatgccaccggccccagatagtcgctgctcacctgcaacattttggtggcctgtacaggaactcctctctctgtgcaggagctttctctctccttacagggaaccctctcccctctcaatttttctttcccaactcgggacccttggtggacagcatctaagcgtggagacaactgtaggtctctggctggggctacactccagcgggactgaaaggtgtctgtgtgggaagcatctgagcgccatgctcatttgggtgagtgagggacctgagttagttttctctgttcagtgtcgcagcagccagcttctagtatccctctggcaattgatggtaactggctagggccactctccagtgttgcctgaaggccagagagtgaacagggctggctgccttgcctggaaggaagactgtctctcttaccttttttagtctaaagtccctaattcctgtgtgtgacttagctgacagcagaagttcattcagagtgaattcacacatgttttgggtgactcagaccatgtttcttactctgaattctctggtggagtcagccagccatcctgttctgaacgttgctcaaccaggtgatctccgcctcagagaggcgagtctcccttacctgcccctctcctgggccagcaccaaatggagttcttcctttaccctttttcctcgtacctgggctgctcacccagcgtaagtgagtacctggactggccatccagtgtaagacccccgagtggctgagaggtcttttgtaatagctgggacgcccctttagaaagtgcacctgagtccctcagcagacatgagtgggaccttttttttatcttggcgggatgccccaagagaaagcgtggttcaattagccccaaatggctcattttccagtcccactatgggacaaactccgtcaattccttcagactcacctctaggctgcattctaaaacattgggataaatttcaccctcaaactctcaaaaagaaacatctaattttttcgtgtgatacagcatggcccctatgcaagaaattctcaaattagcctcctcagtattttataaccaagaacagcagaaggacaggtctaaggagagagaaaaatgcagggacaaaaaggctgctttacaagccccagccccctccaggttgtcctaaggacactcctccagataactgccatcagtgcagaaggccaggccactaaaaggcaaagtgccccaatgggataaatgggaaaacccctgcatggcttgtcccctctgccacaaactcggccagtagaaacaggactgccctgagaaccaaagcctcccctgccccccaggacagtatcccaacccctgatggctttaagctgaaggggctctctgctccagctgaaaatagctcaacttaactggtgacttgcagaggtgggaggaatttgtcctacactgtgtaaatctggggtgctaaggctctccttgatgggaaataaacaagggtgggaggggtgctggcctcacaccatacagtggctggaaggctcacaagtccttctgtaaagattaacctttctctttccattcctttcattttttctctttttctgttcaatccaaatgtccagcctcaaaaggaaaaggcagtttctaacatcctaacccttgattttgttattctcttaaaaaccccagctgattacatattatggcccatttttgtgcacattttaaattgatgggcaaattacaagaaaaattcagagctcaaatggttaacctgtactaagagttaagtcaagtcttctaaagctatctgtcttcctctctttttttctgcctgctttaaatctgccattactaagctgctggtgctaagactcattatttatggtctaactggaatgtaaacactggaaactcatttaaagttaaaagaaaaagggtaaaacaagttttattaaaccaaacaacctagaatttttaacctcccttaaagttgatagaaataagtccagcacctctcttacaccttattcttaaagctgactctttattctattctactgcaagctctcagtagtgatccaactgcctctcttgagcagcttcgccctcttgatattaatacttttataaggaaggtagcatatgattgctatttggagggggatctccaagactactgcccagatgaaatttctttatatttgtcctggtaatgttatttacccacacaccataacatcaatatcctaaggtagtaggtattttttttaacattttgttttcttatactctttacagcccttcttctttcctgtctccctgagtttcccacatattgttattttccttaaatgtggctctgtttttattctgtcatggctaactattgtctcaatggcttcacccaggcacccactctagccagtaatatatcaagttgccaacataacacagtactgactactgaatatgcccacgcaggcaggcacttgagaatggtattacactcctagcagtcccactatctatagataacacacaagcccaatgatctggatttgaccacactatttacatgcacatcaaaaacacaggtttaggagggggacctaggccaaccaatccctcgtgacaatcatccactgcaactgaacggattgggaaggcaccagagaatggcctgtaaggctcgcctctgcgttaaaaactccaagtagtctggccctttcctaggggctttaacacaagcccagtgaaattccaccctcaactatagtcaaacacaccaggaatgggagccatacgatgcctgtgatgagttcactgtgtgcccccacagattttctctatggtggggaaaagacaaagttaaggccagcaacctttatagtgattcctttatgcctataaagagttcagctaacaggatggaatatataggaataggggtcaaaactggacaacttcttaacctcaccaacatatctacatcttttcatcgattttcccttatcccatttatatttacaaatcttatctctcaggctccacatccacataacacaacaggtcaaacatttccccccttatgcatgaatgactactttttgggtcattgtccatccacgtttgatccctggggaccatgggatccctggatttatgcaaattatactggaatccaaactaaccacacctgtgcctggttacgagctccctcctcaggagtttaacagaaactgggttcttcttttcatgtggacccaacctgtttctagccttgcttattcagtggaaaggcacgtgcactatagttgcagccatacctggattgcatataaatatatatgtaatttatataaatatatttgtgtgtatgtgtatatatatatacatatatatataactcctcagacttcataacctctagccaagttccaaatttaggatccttccgaaatcaggccctacaaaggccattcgaaaaaaacagaaacgtgacttaatcaacctcccatcatctggcatcctcaccactgagaatccgtggcaggcaggaatggtctaggacattctgtagcctgtgcaatcttttggtttgcaggtatacccatgcttaagtgtagcattcataatctcaccatcctagtccgacaatcttgagaagctacagtaacagccattgagggccaacaacgggccctagattcattggcaggggttgtcttgcaggatcaaggtgctttggatgtgcttaccactgaggcaggaggcacttgcacactgttaaatgaaacttgttgctttacatcaatacctcaggtaaagtagaagaaagtttggaaaagataaaagaaaacatcaggacaacagagggccttcaaaaaggagttcctcaagattcctcttttgcacaactgttttagagatcctacggttgggttgggccacgggttaccccacttcccctgcctataataatgctcatattagtttgtttatttacagcatgtatcgttaatgttatatatctcattttgtgtcttctagaatataaaaatttcaaaccaaaatgttactgcatcaaggatgtcagccactaagagaactctacaacactcctttggacacagcaggacaaaattttaggctgcaaatgctgttcagccgtggtcccacagccaccctgcccaatttaattcccaactcagggactcaggtcctcataacctcctgacagactaacaatcctaggtagggccaactctatgcccctggtcagcaataagcagttggaagatgagaccttcacccacacaccaaagatttgtcattgttgctctgtcacagggggaatgtggaatcctgtttagggaaaaaaagtcaggatggcagcaccaagaggaagcaaaaagaaaaagcagataagctatatgtctgcctttcttcatactccaagagacacggccctcctgagcaaataactcacaatcttcctgtgtccagctatcaccagaccctcagctaatagaaaagtgcagattggctcactgcaaccttggggttttcagtactgcacaaagccctcttcagcacacagcacaagcaccatgctataaaatccccagcaagccttcatctcctggtagtcagctcctctcttgctaacttgcccattcattgcactcttgctatgtgtcttcatcctttaataaatctgcttttctttacctacaaccgtctaggtaaattcttcttacctgcgtaccactggccccaaatagtcactgctcaccatggcaagtagggccatgcttcttctgaaacctatgagggagtccttccttgcccgtttctagcttctgggggtttgtcagcaatccttggtattctttggctttcaactgcgtaacttcaatctctgccttagtcattgtgtggaattatttttacatggccctgtgtgtctctgttttcatgtggccatcttcttataaggacaccatttgaaactgtgatatcttctgaggtacttggggttaggatttcaacatatgtttttagaagacccagaacaaagcctaaacaaagtgaggagggtctccttgtacgtgggcagcccaggatgagaaatcagagctgcagcggggttgggagagggcatccacacatgtgggtggcgtggtgcaggtgtgttatatcctgggcaatgtgagcaaggcatctatgtaggggaaagcctgggtaggggggtctgagcccaagcaggatgaggagagcatctgtgaaaagtgctctgggtttttgagcctgaacagggtgagcaaggttgtggtctacatggggatgggaagtggggagcccctatggcttatcagagccttagtgggggtgaggaaggcatccacgcaggaaggacaacctagcttggggtgctggagtccacctaatgggaggagggtgactatgtgtgcggatagcctggtatgggttattagagctatcataggacgttgttgaaacaactggtagaacttaagtgaaatctgaaaactctgatggatgaattgtggttatgtaggaaaatgtcctagcgcccgttaaatactaaagtatttgaggactatgggacatcaaattggcaactagaaaaaaaactctttgaattgtacctgtaacttttctgtaagttttaaaatacaaaattattaaaaactctgaagcaaatatggcaaaatggtataattccagaggcctgggttgtatgtccacaggtgcttattatgctatcacttccagttttctatctgattgcaacattacaaaataaaaatacttcaaaattaaaggttacgcatgtttattattaaaaaaaaaaggtaaatcactcatgagtttattgcccaaagacactattaacgctggatatattttctttatgtcgaaaaaagataattctcaaggtaaacagattttgatggtataagattttgaaggggggataattttcttaaagctaaaattagatagatcattttccttttttcacttttagaggaaatgttaaaaatgctcacgttagtcttctcgccgcaggcgcctgttcacgtgtaaggcattgctgaaatcactagagggcgcgctcctgtcaaagcccatacaaagttctgagaatgctgtaacatgttttgaaaccttaaaataaattcagctgggtgcggcggctcacgcctgtactcaatcccagcattttgggaggctgaggcaggaggatcgcttgagcccaggagttcgagatcagccaaggcaacatagcgagaccctgtctctataaaaaataaaagaaatgagccaggcttggtggtacatgcctgtggtcccagctgagaggctgcagtgaactgttatcatgccactgcactccagtctaggtgacagagcgagaccttgtctcaaaaaaaacttcaaaaaagctttcatccatcttttaaaatatcagcattttatccaggtctttttttttttaaatctatcttacatcggcttacttttaaaatcagaagatgtggactctattgtctacatcatgactgttaaaatattggatttttcatttatacctaattttaaatttttgccctatgtagtagcatgaatcctcttgatgttccgtaggttcttcctacaattttctcacacttctgcgaggcagaattgtcacaattaccctgccagtggtcctgtcctagatatatcaccctttctttggagttgtgagacctgtttttatttttataaattagaaataatctgcttctttctaagtttgatggttttcttttcttcttcttcttctttttttgacagagtctccctcagtcacccaggctagagtgtagtggcatggtctcggctcactgcctcctcctcccgagttcaagcgattctcccgcctcagcctcctgagtagctggcattacaggcacccaccaccacgcccagctaatttttgtatttttagtagacacagggtttcaccatgttggccaggctggtcttgaactcctgacctcagtgatccgcccacctcgaccttccaaattgctgggattgtaggcataagccactgtgcccagccaagtttgatggttttctaaaaaaaaaaaaaaaaaggtaatggatagtttccttgcttgaaagcaaaatcagtcctcatattggggtgtagcggggggagtgtcaggagctgggtttgtgtgagaaggtgtttggtggtggtagtacttgttggggaactttggccatgaagcaagcccattgccagacccaagattgtgccactgccctgttgttatgatgactacatcgttgggatacagagagtgtcagaggtgaaagacacctgaaagaaaaatgtcatgttctatctgtgtttggtgaaatcctagggttccacaaatgtttcatctgaatttccctaagaagttcttgagcccaaacttgtactacaggaaaatgtgtccattcaaatgccaggctagtttatttttttagtaggcctcaaaatacttttggtgttttggtactcagttttaaacttcttttaaattttatcgattaataataataatagctgatacctattgagtgctaactatgtggcaagcaccttgcatgctccatctgatttaatagtgtggttcacaacgttattttcccattttatagatgagggaactgaggcccagaaatcgtaagtgatttgatcacttaatttagacctattggactccaagtcttgtttgcttagccattaaacactttggccttctcatatagatagttcacaacactgtgcttcccccaacccctcaattcggacctgtgggcttctttgtatgtgaagttgcataatcaagtaagctggtcaccctcaaagctaggcaagcctcagagactttgcacttgtcacaacagagaacacagtgcaaagacctgatggaagcatgtctggaggagcagaaaagtaggccaatgtcactgaagtagagtgagtgagggggagagtaatagaagaatggactggattaggaacagaggaccagcttttatagggacttacaggtctttgtaaggcttttactcggaatgaaatgtggagccattgcagggttttgaacagatgagagacatgagctgacttagaggtttaacaggatcattccagctgctgtgttgaaactagacagtgggtggtcaagggtagaaacaaggaaacaagttgggaggtatattattttcccttaggaaaccctaacaaagtaccacaaactaggtggcttaaaataacagaagctgattgtctcaaaaatctggaagctagaaatctgaaaccaaggtgtcattggggccatggtttctctgcgactgcgtggaatccctctttgcctcttcctagcttctgtcagtggccattgatccttgccattccttggctttcggctgcagcactccaatctctgcttctgtcattgtatggctttttccatgtgtgtctctgccttcacatggccatctcccttctgtgtctccctcctcttcttataaggacaccagtcatattggattaagggcccaccctactccagtatggcctcatcttaacttatctaattacatctgcaatgacactatttccaaataagattacattctaaggtactggaggttagcatcacgacatatatttttggcggggacagactgtaacccatagcaggaagctatttcagtaatctgggcaagagataaggggagcttgaaccaggatggcagcaatagtggtagtgagaagtgatctggtaatgaatatatgtggaaggtagacccaaaagcctttgctgatgaaatgggagttggcccaagagaaagagaagcaaagatgactccaaggtgtttcagcttgaggaactgaaaggatgaagttagcaacaagtgtgatggtaaatgcagaaagacagcagatttaggagaaaatcatggtttggttttggacaaattaaatttgagatgcctgttagtcattcaagaggcaatgttcagtaggaagttagttatatgagcctggaattcaagaaggagttcagagctagagactcaaatttgggagtggtttctaaggagaatgagagcccacttgtgattttaggcataaagcttaacacgaagcttactccagccaggatcagttactgggatgcagatgtagacaagacgaaaagttggacttaacctttgttccagtttttctaggtaggtgtgatgatgggagagggaattggggagctgaggatggatgccaaggagtgatgataataacggaccgtagaatctaagtgaaataaacatgtaagtgaagatatgagggggtgatagagggtaaaaagatgattaacagtgggagggttgttagagtggagatattagagggaattaggaagagagagaaaagagtggggtgattaaaattgagatttttttcagcagaacattgactaaaaagaaattttttaaaaataaaattgagatgttgaaggtcctgcagtagtttatgacgagatctaggaaataagcctggatgtgggtgaccaaggatggaaagagagaacaagatctttggagtggaggaggtcaagcagctgagagaccagagtgctatatggattattcacaatgtagacaatgaatgtaggtctgcacagacacatgcatgtatgtatgcagactccacatagatattgaaatcaccaagaaagatgacaggggcagttgtgaaaagacagtgaaccacaagctcaaatcatcaatgaataagggagagtgaacaggaagaggggagatgataacaacaaggaggtgtagcaggtaacacactctgaaacttagtcttacagcaaagtgattgaaagaagctggggcaggcagtttggggaaggtctacacacaggaagtggtaagggggagcaaagaggacacctgttccacctctgggtccagtggtacataaagtatgagaaaaaaaatagtcaccacttgagagcgctgtacaggaagcaatgtcttcagaggggagccgagtttttgataaacccaaaagttcaaggaaaattttggagaagctgagaatgtagggaattttgcagagagaaaggtcaaagggtttgggagggttgggaaggggtggtcgattgagtgagatgaggaggtgcaggaattcatttccatgtgagtgatcatggatgatctagatggtttgaacttttgtgatgactgaagtaaataggcatttagagcacgatgaaacctgatgatctcttggctggggaacagatggttagttttaaatgtagcctctccttgggactggtgtgtcctgtagtgcagtgtggtctataatgggaatgatggggtgaggtggagttgtggtctcactctcactaggagcaggtggaacactgggctccctttttttttttttttttactttttgtggagaatggggtctcgctatattgcccaggcaggtctcaaactcctggactcaagctatcttcccacctctgcctctctaagagctgggattataggtgtgagccaccgcgcctggccctttgatgttcttaagagaggcgtcaagtccagaggaggcttgatcttaccaggagagattgtaactctcagggtctctcttttaatcctattgggtcactgtaatacttctcttatttcttttattttcatagtctgctcattactttaacatagtacaatgatgtttgtttttgtaaaactgatacatgatcactatgaaatattcaagtaatggagaaaactataatgaaacttaaaaaatcctccccaaataccctcattaacacttggttaacatcatctcagacttctctatggatttttacacttgtaactattttacatggtcttgtgtttcctttaaataatatgagttattgttgtaaacagtttgagtactatagatttattctaatcctctcactttacaaatgaggacattgagttctagagaaaggaaagtacctgtccaaagacactcatcccgtcagttaggcccaggtctcttttttgtttttttttttctttttcttgagttggagtctcgctctgtcgcccaggctggagtgcagtggcataatctttggctcactgcaacctccacctcccgggttcaagcaattctcctgcctcagccttttgagtagctgggattacaggcacccggcaccacacccggcttatttttgtatttttggtagagacggggtttcaccatgttggccaggctggccttttggccaggctggtctcaaactcctgatctcgtgatctgcctgctcaggctcccaaagtgctgggattacaggcgagagccatgctcccagccaggcccaggtctctttactttccagttcagtgggtctctttaagccgtgctcctctcttcttctcttaccttctacatagcatggtccctgatatttcaactcatagatttctgcattcagagatctcactttgcctttggttttgaacacttattcatctagtcattcaacaaacctttattggacatctgctatatgccaggcaaaaatgttaggcactagaggtgtggtgatgagcaaaacagacatgatctctcacctcatgaagcttacattctacagaatgcacagaaagtttgtgctttacttcctaactttatccattcaggccaaggcgcatataactatgcacttgtttataaccccaagtcattcgatggtgatgggaaaagaaaagaaaaatcgttagacttaaagtcatatcactagcacatgggagtaccaaatgaatacttgatagtcatagatactaacaaaatccatgaggtctagaatacttttctgtaactatagtttcaagcattaatttaaaagtttaatttaaaaatgccatagtgttacgtataacaaaaatgcccaaaacacaacatttaaaattttaaaatatatatgatctataaggatgcaaaagtccttctctctaattgtaccttccagaggtagcacttctaaaccctctgatgtgtgtcctcatcaacttttctctatgcttacatagattttattttttaataataacaggattgcgtaattgttgccaaattcaaacaatgcagacagacttacactgtattaaaagtgaaaatttctcatatactcacccccaatctcagtcctcatgggtgactattaacatattgatgcatatttgatgtgaatattttcaaatctttttctatgtatttacatagaaacacatgcatgaacacacacacatacacacacacacacacacacacaagcaaacagggctgtttacattttttgttttaaggcagcagtagtcagaaatttaaagttcagaagtcgagggcacattcctgtgtttttcattttcgacaagtagaacaatgcagccatatgccggtccctctctggagttagtacccaatgcttggaatgtgagcagatgctgaaggctattaatgaagtccttgaagggaggcccattcatgtatgttgtagacacaaggccaaagttgaatgtggtggccaactgagcagctggtaagggactaggaaagcgaggaatgcaccaatgctggttgcgagttgatggaccatgggaaccacatcatctggaggagtgtcctgccattgctgtcatttaggaaatggaagcaacacttggagtcctgaaggcttttaacctcagttgttacattagtgtgttgcaaatgtgatagagaaaaaaaatctgggaaaaatgatctgatatggtctaaatgaaactagtttttatcatgcctaaaattggaaaactccaagactttctttttttctttttgatttcttggatacaaagaacaagacacagtaatgtgtgtttgattaatgccaactccctgaactccttaatgtcaactagctactcttcattaccaaacaccacatgtgctcttctttcagtttaggcataccagcgcagctgcagaagacacagtggtgatctctatcacaccaacaatcagatatttgtcataatagcctcctaatcatatcgcatatgaagcctcaatgaagtctttataaccagacatgaaataattaaccttttctaatttaaaagacctaatagggaatggtctctgtgacaggtgtaaaattccattccttctagaaaattactcacctagcagatgctccttctgactgaaagagaaatttcattgcaaaaagaatgttcaccttttattatgaatattgcacaatgcattaagacaatggctttccatgtagcagtgcataaccttgatcttctgaccactaatgttcattgtataatacagataacaaatattcacctgtctccattcttcatcagtgaattgcaaggacacttggattctaatgctgagggtccctggaagtctgagaatgcatcatagtcttaggctttttcaaaagtgtaaataggttagtgtgctaaagacttgcattgaaaatagagattgctcagaaaaaaaagaattgtatttccactgccaaagagaagaatcaagatcaagaggaagaaactatttttataccacagtgcaaagataagaaaccttcaacctattatttggatgtggccctgggcttaacttggtacaacttgaagcaattttctgaagtatgtacccttctccccctacactgagccagatacatatacagacaattttgttgagtccaacatgaatgtggtgcgaactcaacagagatctctgggtgttaaaaggcaggccccatgccccgagatggcctttgagagggagagatgctttgcacagagtcctaattttcccagggagaagttgggtgggtgatatcaacgacagcagtgatagagactgcatcacccttgggctgagtgtggttaagtttgggaagaagtcagagaaagtgtggggttgctgaccttgggtgtgcccagctttctgagtgctaactgggaggtggcatgaagatggcaaagctggaagtggagaaggagcaaaggcttctgccaacagtgtctgatgtatggtgaggcggaccatgctggttgtgctttgtatttcttttctctttcttctgtgtttctctcctccttcctctggcttgattttattctctctccttctttttcctggggtatgagtgacaaggatggacttttgagaggctctgaacttgaaatttcagcaaagagaaggacctgtggtttgtgtaagcatctctctgttgtccagatacagaacccccaaaacatcgagagtggcttctcttcctcttttctctgcctcccatccaatccaagatctctcaatatgcactatttgtgttatcttctttgaaaggtccctctttctctgagtcttctctttcccttagttcctttctccattatttagacaaaaatgagagtaaactattctttattcactttcgtttgttgaacagagttttgccttttattttaaaagcagttgagcaggatttttatatttcttgcccataaaacctaaaccttgttaacatttttcaagttagttttagtccacttagggatagttgctctcaagagataaaagattacccatacctatcccttttgtgggctttgtatttcacagatctattgaaaaataccatttataataaaagctagcaattattgagcttactctgtggtaggaacttaatctgcatgatcttatgtaatagtggtagccgccccacggggctgtgtgatgactgagtgagcccatgtatataaagtgcttagtgcagtgcctgacagatagcaagctgtcaataagtgtgctattaatactgttattagtactactacgatgaagttactggaataagccacagccagtggccttggaaaaacaaagttaagggtctaatcaaccaagactcactagacagagcaaagtagctggtaataggatagtaaatgttcctgggatatggcagaggaacaatggtctggaagcaacagaaggagtaaggaataggctgataactgtccccactgccatctccggggataaggtgaagctactttaggagatggtctcccttttttttttccattatgagaggttatttttaattctattaaattccaatgtttattcagaaaacctggtagagattgaattgctatatgtactttcttagttttcttcttcatatcatattttgaccatttatcttctacacctggctgacctgcatgttccttgtagtgtaacttctacttggtgtttgtgctttgctttgttttcaaatttaaattgtgagatacattttctaagaaatagccctgatattgaaatggcttctgtggaataggtttgacagatgtaagtctttgattctttggctttggtttttgtgcctgttacagttttacacacattcattcagaggaagacattaccatcaatgtgttgtttcttttttcaaattccagtatgttttcaaagacccgtatttcactaagcagtgtacttgttgaaactgatgtgagtgactttatgtttccacacgtgatagagcatcagatactggagtttgccaggggtagaatggttggattcaggaatgtttagctgactcattgcaggaagttaccctgtaatcccagctactcgggaggctgagatgagagaatcacttgagcacaggaggttacagtgagctatgatcacgccactccactccagcctggatgacagagcgagacctgctaatgaaagaattatgttccaaaagccagctaagcattttctttaaatgagaagagtctgtgtttcatggcagcttgaaagagggggaaacatgaagaggaaataaatgaagactatctcggtttattaaggacactgcaaaggattctgatgaacaccaggtggagaggatgcacagggcaacgctgtggggaggggcgtgggatggtctctagcaagattggctatagtagcgaattaagagcacatctagatttggatttcagtgctagctgtgccattcataagctgtatgaccttggataaatcgcttaactattcagagttctagtttcctcacctgtaaaacgggagtgctaatattaatggaacctagctcagatggttgtgtggtagcatatgtgagataataatatgcatgaagtaagcttagcatgccttctacctaataaatgaatgctgctgctattgtcattatcattccaatcaccctgcagagagggtatgtttgtcttcattttacagttgagaaaactggggctacaggaatcaataacttttccaaggtatagttaataggcacaaggctagaatttgaccagagatgtctctgccccaaagcctgtgatctttctactgctctgtgatgcctctggaaacagtgttcttattccagaaatgagaagcacaaggtcagctctcacttaaaatagtaacaaaaacaaatcctaatatgttccttagcctgtgaggtacactggctgctcatttcacttgctttcaactacagggaaaaagagctgtttgtcacctgtggtttgatggagctattttttttttctcctctaaagctagcttccccttttcactaaattagtgtcatttccatgaaacaaaggtgtttccgatgtttcagccttttcatttctctctaagcatccacttcttgaaggtttttattttcaggtagatttactgctgccccaaacacaaggacctcaagtctaagcattttctggagccttgatatctttgggagaattgttactgctgagctccgattgtacaggaaattttggacatcaaattttcaggagacctgtatgcttctctcatcccctacatgataccacactcacaaccttggcttcaattttttggcatgtggctttgctggttctggcatctgatactctctgtagcttcagtgttgcttctttttttgaaatagcatgctcttttaggtgttgctctcgcataccttgtttagtactggtggcatatggtgttcctacagtcttaccattcttacccaacagaggagtcaaaaggggaacatttatctggctgagcttggggagagcaaggactcagtaggtttaatgtctcaggaaaatgactggaatcatgagtagaaatcattataaattgcacagtctgaatttatttgacagaaaattattgaatgttcatgatgaagaaagcattgtgctaaatactccaggaatacaaagacatggcatctgtccttccagagcatatgagttaataaagggcaaaaacagtattcaaagtatttgtggagtttgaagttccatgaggagattataccctcctcccaaaaccaaaaattctgtagggatccactgtctataggaccagggaaagcttcacaaaggaagtaatatctgatctgtctctggcatgaaataggtgcccaagaaatattcattgaattgggtttagacctgtgaaatatgagaaagggccttgtaagtggagggaatggtgtgagcaatactgcagaagcgagaattgtcagaatgtatactgggaacagaaagtattttaggccagattaaaaagtatatatcagggagggattggggagggtggtggcagtgaggcccagatggaggatcatgacctggaaagccaggataaggagtttgtccttagtttagccgacattagggagccactgaagatttttgatggtaagaatgataaatttatttcctaagatagctctgatggcagaacaggtggccaatgcttttttaaacaaacaaacaaacaaacaaacagtagttgaggagaggtcaggagagggaacatgaagaaaaaagtcacactagttggtgatcaggatgcattgaagaccaccctaaagaatccatttggtagaagggtggagttagaggccagatttcaaagatttaaaggaatgagtgtggtagtggagggaaggaaagcaagcttcagcaacttgagaacccagaggcctgaaggaaaagcttgtggagtctagagcatcactgaagtcagagaggaaggggcctgcagagggaggcactagaaatgagggagggactggccaattcatataaagagatgacagaggaggaggctgagaggggaattagtggaagggtttttcttagaaaggaggattttttttttttcagagataggactgaaggaagagagactaaaggaaatgtattaaggaagagaatgagccacgagaaaaggaaagagtagcaaaatcttatttgggtctacatatagagccttgctgtcttggcagaatgctcaatgctcagaacacccttctgaaagcttgcccgccatccgggcttcctccacaagattcaaggtctcattgattctcttcagcttcagtcagagacaatctgacagctgcagttggctcagcccttcttgcagcaagctgacaccatttctggtgggcttcaaaggcagtataaatggttctcccttaagagcaggttacactcggcacctaggcagcctcattacacaactaattaaacctctatcacttgaaaggaatcaatggcagttcaagatctgcttgagtagactttgcatttccgtgttcacacatagcagtcctacagtcaaggagttcccaaccactgcaaggggaagatgtaaacaagaccttagaaatagattgtttcatttcctataagggggtgtcccagaagatcttactcattagacagtaggcaagacccctttaaccttttgaaatagaagggagtttcgggcagctctttaaacggtgggaagctcaagctttctgctctggtgcatccatctggacaaaggcatgtcaacttctcagagtctgtccttcctggcagttccaaagggaggtccccgggtgttgagtgcagtaagctagagcctgggttttcccctacagaaaggctccagccctgttgtaaatacaactttcagaaactaatttaactggttccacttaaatgaactgggaaatgacccaatagaaggggacagagggacttgtgccagttctaccatcgcaacaggagcagccacaccagaccttttactttcagcaggagaatgttgactttctgaatgcaacacacttttccatctacttactgtgttatttaaataaattgctttgctcttgagggaccttatactctttggctcagtgagaagctggtagattggagtcagaaggggctgtcaatgtggaatctaatagagtttcagtgtgggaatattaggggtcagaagcaaccttacattagttatcacatcttgtcattagatgacatggatattattataaagaggaaatctacagggagcgtggagatgaaagccataaattggctagaagaagtaggagatttcaatgtgaaagcaagtgcttcaagatgtggactgcctgtggactgccaaactgccctatggactgcccaggctccctgctctactctcatctcatatcactttttactccttgaaatactgtcaagtttggattattcactgtcctcagatgacaagggttcagcgccaacagactaattttcacgccggcctaaacagacttaattagggaagctgttctgtggccaaaaatcacccagtgcattccaaagccagatctaacaggcttgtggattttcaattgtttgtcatcatctgtactactgctttccttctttcatgtaggacaaggcacacaggaacttactgttatcctggctttgccactgaccagctgtgtgaccttggctaactaacttaacttctctgaacctcagtgcctcttatgtaagccggagataataatggtactgaccgggcatggtggctcacgcctgtgatcccagcactttgggaggctgaggcgggtagatcacctgaggtcaggagctcgagacaagcctggctaacatggagaaaccccatctctactaaaaatacaaaaattggccaggcatggtggattagaagtcccagctttcgggaggctgtggcagaagaatcgcttgaacccaggaggtagaggttgcagtgagccgagatcgtgccattgcactccaggctgggtgacaaaaacgagactccgtctcaaaaaaaaaaaaaaaaaaaaagtacttaccactgaggactgttgtgcatgttcaatgaagtaatgcctttgggagtggttagcacaatgcctagcacacagaaagcactaagtgattatagttgtctaacgataacaataacagctgctgaaggcaaacatgtgcccggtgtggtggcttgcacctgtattcccatctacttgagagcctgaggcagaggatcccttgaggccagtggttcaagaccaacctggcaccatagtgataccagtgtgggcaatatagcggtacctcatctctacaaaatttttaaaaaataataaaaaataataaagcaaatatgtaatgaattggatgtgtgtgtttttgaggggtgattcgtttcatttgccctgattaagggtgctttgaaaagaaaagaataaatgtgaggacagaggagtaagtaaagacatatatatcccacatgtctattttctttgcacctgagggtttcataattgagattttaaactaagttagagtgagaagtgtaaaataatctaccctcgctgaagtcctcaaaacttaagactgtaaagaacttctgtgtttagtcactcataacttacaacatcactattactattggtaaaaatatatatttttcaatatagaaagtgctggtacccaggggcctctactgggtgttagctaaggtatgcagcatctcacttctctttgatccattacttttttaatgggcacattagaaaaattggcacctgggtaacctgaaaaatgcagtctttggggcccctatcctcaggagattcaagctcaggaggattagaatgcagtccaggaatcatgggcaccatggatgattgagacaccaagggtccaagagtcagacttggaaaactgtgggttagtgggagccagcctcgccctacccccatgcacccctggccatcccatgctgcccaaatcattctgtggtctgagatcccctcatatcctttagttggcatggctttagagcatcagtacacctcgactcatctcctgcagaatagcaaggagtccttaagcaaggttttccctctcctcctgacatgagcccccttagcaccctgcatcattaccgtaattgcttcccaacttctgattagataaaaacatgatggcagcaatcatgtttcatctttaacttgtaattggatgcaatatgatgattatggatcctgatcaaagggcatttccatgggataataagtcctcacaacagcaatctccttgggatgtttttgcttttgccttatggctgcatgtcctgtccccatttcccttcccccaaaaggagagcatgacttcagcatctgctgatgattttgcctcaatttttctcatcacacacacacacacgcaatctcatttggtgcatctgttgttaattagctgtctctcatggctagtccttgggctcgctccttcctccaacaatccctctaaacctcaagatcacgtaaaatgaaatggaaaaaaaaaagatctgtgaatcatttctgtagaagactaatttttatcttcctccaccagtatgtagcatctcttttccttccttttgtccttccaatggtctcttttctgcattaacagaatcaggtctataggtctctccctccttctcccccctctccctttttctttccttctctccctctccttcccttaacatctctaaatgtaaacttgttagcaaggtagagtgtaaagagcccaggctcagaagtcgggtagtaccagctgccatttactggctgtgtgaacctgggcaaattatcttaactctctgagcctaaggctttttgtctgtgagatgggaatcactgtgcatatggtatttttgtactttgcagtacgttgtttggaggaataaattatacatatcgaagtgttaggctcagagtgagcacttgataaatgctggttattgttttaatacatacctactatataggttgtttgttttgttttgttttagtgtgttttaacgagataatgtctgtaaatagcttagaacagagcctaggtagttgcacaacaattaactgctcccttaccatttgctttttttgttttttttttttgaaaaaatgggatccagaatgggaagaagaacaaacaccattggattcaaaacccaatatttaaggactcctcataagcaggccattatgcattaatgtagtcacattgtcaaatgtctccatgtctccagtgcacctgaccttatcagtgcaatgacaacactgtgtgtaccactctagagcttggtgattgttgacacaaaagttacttttggaaatcattatctaccctacacttctttcttttcttatccttgcctctatttaccttgtataaccctcctggtggcattcaagactggagaagatgctaagccaagtggtatatccctatgccatccaccatgtactttattgaatttgatttttggcttaattttctgtaattgaaaaaatcatggaatatcagagtttagaggacatttagagaccgtaagttcaagccactcattttacagtttagggaactgagactcaagatgtcaactaatttgtttagcaccaggtaggggattgatgacatagctagggctagaggccaagtccctgacatctactcaagtgcttatccctctgcagcacactatttagtagattcttttatttattgagctgtaagttacaaacagttctgttccttttatctattgcaaaagctcccattttatttatttttattttttctgactctgccactgttacaggttgaactgtgtccctcaaaaatggtatgttgaagtcctaacccccagtacctcaaatgtgaccttatttggaaatagggtcattacagaggtaatcaggttaaaatgagatcattatagtgaagcttcatccagtatgactgatgacttataaaaaggggaaatttggatctagagacagacacagaaggaagatgatgcaaagacacacagggagaagacagtcatgtgactggagtgatttatctataagccaaggaatgcaaagtaatgccaaggattgccatcaaataccagaagctagaagagacaagaaagattccccccaaaccttcccccaagaaccactggccccgcagacaccttgatcttggacttccagcttccagaactgtgagacaatacatttcttttgttttaagccacctggtttgtggcactttgttacagtaaccctaggaaactaatataccaccatggatagttttgttatccccaagaggtacatattaaggccagagagagaaatttgtcaagagaacatgtatccagcacacaagaattgtttgccttaaattatattatgtttgtacttgggaaccaagtcaaatgtcggtggtatcagtgttaattgttgtctatgccatctgtactggtcagggttctccagagtaatagaaccaacaggaatatatatatatatatatatatatatatatatatatatatatatacacacacacatatatacatatatatatacacatatatacatatatatacatatatatacacacacatatatatgtacatatatatacatatatacatatatatacatatatatacatatatatatacatatatataatatcatatattatattcgtattaggccatatgaaatatgacctaaactcactgagcctcatatatatatatatatatatatatatatatgattttttttttgccaagcatcaaagccaagaaattcatactaacgactaccttcttctccatcctggcactggtacagtcactaagaactgtcaatacacatgcagtgttaatctacgctggtaatactcagaccagatttcatgatagatgcttgacagatttcatgatagatttctctctctctctctctctgtgtgtatatatatatatatatatatatatatatatatatatatgcacatattcctatatatattcctatatatatatattcctatatatatgtacatatcatggaggctgataagtctcacagtttgctgtctgcaagatggaggcccagtaaagctggtagtgtaattcagtccaaatctgaaagcctgagaaccaggggagctgatggctgagggcaggagaagatgaatgtcccagctcaaggacatgaagagtgagttcaccgttcctttacttttttggttctatttgggccctcagcgaattggatgatgccctcttgcattggtgagggtggtctttatgaagatcaaatgctcatctcttccaaaaacatcatcacagacacacccagaaatactgttttatcagccatcttggtatcccttagcccagtcaagttgacacataaaattaaccatacaccttctactgaaactgtaagatcattttattgtcgtttcgttgcttgtgcttattctgagacttggaaaatttttgaggaacatgctttggtttatggctgcatagggtagatgtgctggccagtggtgttcttctaggcatagttatagtttttgaggactgttataagtcccctacttgtgtggcgctctccaggtatgcctttgttccctcatatttctttcaagcttatgcatctgggcctggctaacataaggtcctttatattaatattgttgccttgctgatacagctgtcactgtaatctcacaggacagtgataggatccagggctgattttttttttttttttgccagcatcagagccaagaaatcatactaacaacaaccctcttctccaccctggcactggtacggttactaagaattgtcattacacatgcagtgtaatctacactggtaatactaagagcagatttcatgatagatgcttgggaagtttcataaacagggatcattgtttttaatcctcttgatggtgttttcccagagctgtgtttggaatgctactgaaagttagatggctaacagcatgctatgaagactgcattgagatcaaggagaagaaacaagggttagttatctggctatgactgaagcaatcaacggtgaatattggtggaactttacgaacggacattgctaatgggcaccgtggtgctgaatgaatacaacatgagctttggcaacacccagatgtaggtttgaatgtgtgactttagaaatgtgacctaaattcactgagcctcagattttaaacctatgaaaaattccaaacattttaaagttaaaaaagaataagatagcaagcataaatgcactcactatgaagtttcaaggtatattgcaagatgtattacaaatacagccgtagcctcatgtgtatccttctccaagcacattgctctctctgcccctaccctgccactctccccagtcccaccacatatactcaaacaattaatgatgaaaactcaaaaagacccagacacatagaaactaaattacttctgaaatggcaagggttggtagagactctccttgcaaggttaattaatatatctgacaaagaaacagcaaaagggcttgtttagggaagtcatggatggtatttctacttttaaaatataaattagaattttctaggaaaatattagatttctagtaggctacatagttttctgaacaagaccaggttagttcatcactgtaatgagggctcagtacagattggctgtatgtgggtgtgatggttaattttacatatcagcttggctgagtcatggtgctcagatatttggttaaatatcattctgaatatttctgtgaaggtgttttttgttttttgtttgtttttttgagaaggaatcttgctctgtagtgcccaggctggagtgcagtggtgcaatcttggctcactgtaacctctgcctcctgggttcaagtgattctcccacctcagtctcccgagtagctgggattacaggtgcccaccaccacggccggctaattttttgaatttttagtagagacagggtttcaccatactggccaggctggtctcgaactccggacctcaaccgcctcggcctccccaggtgctgggattataggcatgagccaccacgcccagccctgtgaaggtgtttttgggtgacactaagatttaaatcagtagactttgagtaaagcagattatcctcctttatgtgggtgcgcctcatccaattagttgaaggccttaaaggaacaaagactgatcatccctgaacaacaaagaattctatctccagactgcctttggacttgaaatgcaacatcaactcttccttgggtctctagcctgctggcctgccttgaagattctgaacttaccaatcctccataatcacatgtgagccaattccttgcaatctctctctctctctctctccccccgccccccccgtctctcgctctctctctctctctccccgccccccacccctctctccctttctttctctgtgtgtatatttgtatacacatcctgttggttctgttttggaatgctgactaatacagtggttaatcttttgctttccaaagggggaaatggtgaatactctctgctcattttattggtgcctatgcttccaatatatttgtacagctgtacatgctttacaccttatgttactccgcagtgcaaaagctctccatggctgcctctgtccaccaggctaagtaaaaatgccttggtctggcattccaagctgtccacagtttttctgtcctctctgtccttatactcttatgctctgaataaattgtatgaaacacctctgcatgtgacttttcttaaactggaacagtattccctctgctttctacatttcctaagcccaactgcacacaaatcctactgtgttttgggtcattttctagaagctgaaaatttgtggggaacaagacagatatggtcccttttctcatagattttacacactggtgagaaagacaaagaacaaacaaataaataagcaaatataataattccagacaatgattaggattatgaagaaactgaaatacagtaatacatagagtggcagagagtgctaccctagattagtgtccagaggtgccttcactgtgggggtggtattggagcagctgtggcctctgccctcatagatctcacaacctaattgaggacacagaaacatatacagaagctgtaatgtgggagcttgagtgttatcatatgtgattacagagaagagctacttaacatgggctggggtgggacagagaaggcatcctggaggaagtgacatttaggctgggatctaaagcataattaggagttaggtaaaaaaatagtgggggaggggaagacatttcaggcagaaggagtagtttgtataatgaataaccagagatgaggaagagcctggcctttgggaaaactacaaagagttctgcaggttgaaacttagacatgagcataggaaggtgaatgatgaagctggagaattaggcggggccagattatcaaaggctttgtaggtcctgctactacagtttcaggtgctgagacaggttttattattattattattattgttttctttctgtgtgtaagcaagctgaggcctgtggagggtaaataatctgcacatggtttcatagctagtaagcagcagagctgggattcaaacccaggtttgtttgattctactataccacgtcaccttgtaagaattcaatttgattataattattcaattcttcatacagaaccttgagtagtctggtttggctggaacatatggcatatacatatatattttctaggaaaatattagatttctagtaggctacgtagctttctgaacaagaccaggttagttcatcattataatgagtgctcagtacacattggctgtatgtgggtgtgatggttaattttacatatcagcttggctgagtcatggtgctcagatatttggttaaatatcatttaacaggaatgggacaggaaactgaaaatgttcagtgaggccagattattggggggaggggtagttaaatgcatgtctgagaaatctacacttaagtatcttgattttacagataagaaaactaatgctcaaagaaactaagaaagttgcccatggttgcaaatttagtaagtggtggaactggaattcaactgaggtttaactggtgccagagtccaagactgtgccaaatcctcaaaactgtctttctaccttaccttcgaccgcttcctctccactgactctatctactcaggcatccaaaaaaactccacatatattgagcacgtactgcatgccacaaactgtacaaattgttctgcattcaatagctcattataaaatgcatttgctctcattttatacatgaagaaactatgtctcaggtaaattaacttgtctaaggttgcactgcaaatacatcatgtgaatgtttatataatggtaatagttgaagctccagtagtagatgtggtcactgaggaagataatgaggggtagggtaagaaagaggagaggagagcaaaaggaaaatgagacggaagttgtcttggtcagccagggctgccataaccaaataccatagactatggggcttaaacaacatgaatttgtttttcacagttctggaggctgggaagtccaagatcaaggtgctagtcaattgctccctagtgagggtgctctgtctggattgcagacagccaccttcttgctgtgtcctcatatgaaagagagaaagcgaactctgatctctcttcttcttcttagaaggacgttaattccatcatgagggctccatcctcatgatcttatcgaaagctaattacctcccaaaggtctcacctcctagtaccatcacattgggagttagggcttcaacatatgaatttgggagatggtggtggaggacacagttcagtctatagcagaaaggaagggaagggaagggaaggaaagggaagcgggtggggggaggggactaactgagaacagaacttgggagaatgcccacgtaaggagagagaacgaggcaaaggggccagtggagacagaaagaatgatcagaggagtgcaatgccctggaggatgtgacagggaagaagcttccagggtgaaggggcagcaccaagtgtgttcattgccactgagtcactgctgtagacagggtcacatggaagtgcctagatgttggatttggttacctgggacgttttagagtagttgcaactggcagaatggtgagggctgaggacagacagtagaggactaaagctgagagaacagagcacaggtggatgcaacggtttcgtagagactggacagagaggacaggggagatctctgtttggttgaagaaaactaatttgggatgggggatactaagtaattctgaatgattgacaggaagggggtagtacagaagagactgagggctccaggaagccagtgagtagaagtggtgaataattaatggagtgagcagctggggagctgagaggaggcagggctgaaagcagagtcagagagtctggctttgggcagaaggatgtgtgtagtgcaatggacacaatgcaggattcagtgaattacagacttggttcttggttctactacttactatgaccttgttcaagccacttaatctctgtcagcttcattctccatacctggcaaatgggggtaatgagaggagctatatcttagggtagttatgagaatccactgagctagtggacaggaacgcacccagcacagggcatggcatctagtgggtgcttgataaagggacaataaataaaaatgcagagatattgggaggcgtgagactgagttaacacatatgaactgggctcatagttcaacaggcagcctagattgcctggattgggtcccatagtgctctggtctttcttcttttttaaataaggactcaaatcccatcatggtggtaccatccttctcacctcatctaaacctaattacctccaaaaggctgcacctcctagtaccatcacattaaaggttaggtcttcaacatatgaattttggttgggggcacaattcagtctacagtggaagatgtgttagtgctgctcaccacttttttttttttttgacagagtcttgctctgtcgcccaggctgaagtgcagtggtacaaacacggcttactgctgtttcaatctcctgggctgaagtgaatcctcccaccttagcctgctgagtagccgggattatagacatgtgccaccattctcagttaattttttaaaaagttttttagagacagggtctttctatgttgcccaggctggtctcaaactcctgggctcaagcaatcttcccacctcgacctcctaaggtgctaggattacaggtgtgagccactgtgcccagtctcaccaatattgatgatccctttcctcctgggctcagaataggactaaacttttctcctttcttgaagttagatgtggccacgtgactttccttggcaaataaagtatgaaaaatgcttctaggtggaaacgttattggttgtgaactctccagtgctcttttcctctgacttatcaaatagggagaacttactgataatggaggtgcaatgcagagccaccaagtggagaaggacagttgcccttgacagtcaactagacctgcagtggactgtgtgggaaagagacaagctccttctcttttaacccactgagatcttgaaattgtttgttattgcaacataacctggcctatcttgatttatatgcccccaaaagtgaaagcaaagtgtcccctaattcaatacttggtaatgtctttgaggatacgtatgaaaagtgaacataaagttaatgtgactggtttttaacaacttgccagaatttataatctctcaaattaatgttcttgtcttcaaagtagtcactgtgggattatataataatttaaatgatgtacaaaacagttatgaaattccttttacaacccaacctcaaaattgattaacttagtcatttgctatatgcctggcactggggatacagagatgaaaagctgtgttctctccccttcaagagctcacagtgttgtagcaggaaatatgtaagtgatctaaagtgtcttaatgtatggtagggccataggtgaggaaagaggtcagttctaccacagagattcacaaaaggctctatagagaaggagtgactaagcgttcactagtcagatagattggggtggaggggacagatagattggggtagagggaccaacaggagcaaaagcgtggagggttgaagtagtctggcccatttggataggtgcaaatgcttctgtgtgtctccagcctagtataagaaggggccgctggaagacatgaagatagagaagcagggaggggtagatcatggagggcctgctatgccacactgaggagtttgtagtttaatctataagagagggagaacaaatgatgggttttaagcaagggagccacatgacttttttttcttttggatgggaatagaaaaatacatttactattgcaacaggaaaatattgctatgtacagtctcactaccttctaagaacggtgaattccaatcactagttagtccattattgatgggttgagtgtgattgatgcaaatttggagctgcctgaatagaatcaactgctctgcataaaagagggagggggagataaattagttcatggctggggaaaggaaagcagaaaaggaaagggagagagagtgacagagaaactcaagacaaaggtgtctaatggagattttgtatcaatgcggttgctgtttggttttctatataaaccctcatttctctacagaattgccagctaaatctgccctgcttacctgtgctttgtggagaggatttgctatttagggatccagctaagtgctgattgttacttcaaggttagcgtggggcaaaataaacagaagtcacacctggagacaatcaacatctaggctatatagtctagactctggcttgcccttgtgacttgttttggccaatgagacaacagcaaacttgatgccggcagaggcctggaaaagcactttcttgcttgcttgcacctgtctactttcccccttgctcctctgccttcaccataagagcatgcatggactagacttttgaataatgagaaacatgtggcccagtgaccccagttgcttcagctgacagccaactgccaggtgtgtgaagtgagctcagctgagaccagaactatccagccaggcccaaccaagatcagaagaactgctcagctgatctggaggctcatgataacaaatgagtggttattgattttttgccactgagtttcggggtgatttgtcacacaggattgttgtaacactgggtagttgatacacatgtcataaaagtaacccacacatgcctctgccatagtcagaatagtgaggaatcaggaagctgccacttcaaccgttggctccaaattccagtttctagattcataggagttgaaagcagaacacaggccgtccattgtgctagcaaagattgtagcataggcagtgtggtcctggggccagcggttcaaaaccttcttctgcagaagaaaaaaaagagagagagagaggcaccggtgtttgtttagctggaaatcagtgatggctttcaaatacctcaacgtgtcttactcttctgaaaatgttaccttgactcctgtggtttttaagtacgagtctctttgcttccttaatggtctctatactgctttcatgttttgtcctatttttgcattatgtttaagcttaacacaccttccatgttatgtggaggtagatctgaatcccaaatcagagtatcatgaaaatactgaattgtaaagctgaaagagacctttgcacatcactaggagtaaggacatcagtacagcccactcgtagaggtgggactttgtccttaggtcctcccaaacattctctcatgcttaactttccaatgttttttgtgtgtgggggtgtgaggtgaggaaaggtttgggaagctacctaaagcaccatgctctagtgtcagattcagattctagggatccagttctcaaacaccacatctaggtgtgatatggtttggatttgtgtccctgctcaaatctcatgtcgaattttaagctccaatattggaaaaggggcctggtgggaggtgattggctcatgcagtaggtttcccccttggtgttctcatgatagtaactgagttctcatgagatcttgttgtttaaaagtgtgtagcacctcccactttgctctcttcctcctgccccagccacataagatatgcctgcttccctttcgccttctgccatgattgaaagtttcttgagaaatccccggtcatgctacctctacagctgtggaacagtgagcaaattaaaactctttttttttttatcatatataacccagtctcaggtatttcttttttttttaattattattatactttaagttttagggtacatgtgcacaatgtgcaggttagttacatatgtctacatgtgccatgctggtgtgctgcacccactaactcatcatctagcattaggtatatcgcctaatgctatccctcccccctccccccaccccacagcagtccccagagtgtgatgttccccttcctgtgtccatgtgttctcattgttcaattcccacctatgagtgagaatatgcggtgtttggttttttgttcttgcaatagtttactgagaatgatggtttccaatttcatccatgtccctacaaaggacatgaactcatcattttttatggctgcatagtattctatggtgtatatgtgccacattttcttaatccagtctatcgttgttggacatttgggttggttccaagtctttgctattgtgaatagtgccacaataaacatacatgtgcatgtgtctttatagcagcatgatttatagtcctttgggtatatacccagtaatgggatggctgggtcaaatggtatttctagttctagatccctgaggaatcgccacactgacttccacaagggtttaactagtttacagtcccaccaacagtgtaaaagtgttcctatttttccacatcctctccagcacctgttgtttcctgactttttaatgattgccattctaactggtgtgagatggtatctcattgtggttttgatttgcatttctctgatggtcagtgatgatgagctttttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattttgtaggttgcctgctcactctgatggtggtttcttttgctgtgcagaagctctttagttaaattagatcccatttgtcaattttggcttttgttgccattgcttttggtgttttagacatgaagtccttgcccatgcctatgtcctcaatggtaatgcctaggttttcttctagggtttttatggttttaggtctaacgtttaagtctttaatccatcttgaattaatttttgtataaggtgtaaggaagggatccagtttcagctttctacatatggctagtcagttttcccagcaccatttcttaaatagggaatcctttccctattgcttgtttttctcaggtttgtcaaagatcagatagttgtagatatgcggcgttatttctgagggctctgttctgttccattgatctatatctctgttttggtaccagtaccatgctgttttggttactgcagccttgtagtatagtttgaagtcaggtagtgtgatgcctctggctttgttcttttggcctaggattgacttggtgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtatcctcttttatttccttgagcagtggtttgtagttctccttgaagaggtccttcacatcccttgtaagttggattcctaggtattttattctctttgaagcaattgtgaatgggaattcactcatgatttggctctctgtttgtctgttattggtgtataagaatgcttgtggtttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtagtgagagagggcatccctgtcttgtgccagtttgcaaagggaatgcttccagtttttgcccattcagtatgatattggctgtgggtttgtcaaagatagctcttattattttggaatatgtcccatcaatacctaatttattgagagtttttagcatgaagcgttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctctttttctattgattggaatagtttcagaaggaatggtgccagttcctccttgtacctctggtagaattcggctgtgaatccatctggtcttggactctttttggttggtaagctattgattattgccacaatttcagatcctgttattggtctattcagagattcaacttcttcctggtttagtcttgggagagtgtaagtgtcgaggaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagcagtctatcaattttgttgatcctttcaaaaaaccagttcctggattcattgatttttttgaagggttttctgtgtctctatttccttcagttctgctctgattttagttatttcttgccttctgctagcttttgaatgtgtttgctcttgcttttctagttcttttaattgtgatgttagggtgtccattttggatctttcctgctttctcttgtgggtatttagtgctataaaattccctctacacactgctttgaatgcgtcccagagattctggtatgttgtgtctttgttctcattggtttcaaagaacatctttatttctgccttcgtttcattatgtacccagtagtcattcaggagcaggttgttcagtttccatatagttgaggggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtccgctaggtgcagagctgagttcaattcctggatatccttgttaactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaatttatccctttaccattatgtaatggccttctttgtctcttttgatctttgttggtttaaagtctgttttatctgagactaggattgcaacccctgcctttttttgttttccattggcttggtagatcttcctccatccttttattttgagcctatgtgtgtctctgcacgtgagatgggtttcctgaatacagcacactgaagggtcttgactctttatccaatttgccagtctgtgtcttttaattggagcttttagtccatttacatttaaagttaatattgttatgtgtgaatttgatcctgtcattgtgttagctggttattttgcacgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatccgctgttagtctgatgggcttccctttgagggtgatccaacctttctctctggctgcccttaacattttttccttcatttcaactttggtgaatctgacaattatgtgtcttggagttgctcttctcaaggaggatctttgtggcgttctctgtatttcctgaatctgaatgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcgtttctttttattcttttttctctaaacttcccttctcgcttcatttcattcatttcatcttccatcgctgataccctttcttccagttgatcgcattggctcctgaggcttctgcattcttcacgtagttctcgaggcttggttttcagctccatcagctcctttaagcacttctctgtcttggttaatctagttatacattcttctaaatgtttttcaaagttttcaacttctttgcctttggtttgagtgtcctcccatagcttggagtaatttgatcgtctgaagccttcttctctcagctcgttaaagtcattctccgtccagctttgttccgttgctggtgaggaactgcattcctttggaggaggagaggtgccctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtacccggccatgtgaggtgtcagtctgcccctgctggagggtgcctcccagttaggctgctcagggatcaggggtcagggacccacttgaggaggcaatctgcctgttctcagatctccagctgtgttctgggagaacctctgctctcttcaaagctgtcagacagggacatttaagtctgcagaggttactgctgtctttttgtttgtctgtgccctgcccccagaggtggagcctacagaggcagggaggcctccttgagctgtggtgggctccacccagttcgaacttcctggctactttgtttacctaagcgagcctgggcaatggcgggcgcccctcccccagcctcgctgccgccttgcagtttgatctcagactgctgtgctagcaatcagtgagactccgtgggcgtaggaccctccgagccaggtgcgggacataatctcctggtgtgccgttttttaagcccctcggaaaagcgcaatattcgggtgggagtgacccgattttccaggtgccgtctgtcacccctttctttgactaggaaagggaactccctgaccccttgcgtttccggagtgaggcaatgcctcgccctgcttcggctcgtgcatggtgcgcgcacccactgacctgcgcccactgtctggcactccctagtgagatgaacccggtacctcagatggaaatgcagaaatcacccatcttctgcgtcgctcacactgggagctgtagaccggagctgttcctattcagccatcttggctcctccctcccaggtatttctttatagcagtgtgagaacggactaatacaaggtgaatgcttggagcaaccaatcccaaatgtccaaattcaatatcagttcagttcctctagttatgactagtgtatctccttaaacttcacaaaagatatttgttttcttaccttttgtattttacagaatttattcagggttcctttcttgtactctacttaagtatggacaaaacgttcttgaaatttcaggcagaatggtaatttacataagaatgtcctgatttgtaggaaatgcatgctaaagtatttagaggtaaactcatgattcctgcaatttacttttaaaaagttcagcaaaaataaaatatatacatctattatttatctatgtaaggcaaatatggaaaaatgttaacaattgttgatctaagtagagggtatgtgggtttgcattgtataattcttcgaactttcttgcttaaaaaattaaaaaaaatatcctataaagaaacttctggcctagatggccccaccagagttttaccacgcagtcaaataacctaattatatatgcagagtaactaatgtttcaagtaatttttgaacacaacactctgactatagatatttagtgagataaattctaaggacaaggaaccagaaagacatcttaactttcctcattgtttattgttaatagtattttattttgaaatcattttatgcatatcataggataaagcaaataactatattaatgtttttaggaaccgatattttcactataagagaaaatagttagaaatatgttatgttgatgggagatacctagaggttcttgagattctgtttgtttccaggtgagcatgtaagaatcactggccttgatactgcaggctgagaactctggcagcaacttccatgacttttgctcaccaagctcttccaacagatatgtaggtctctgtttccttgtattaaaacctttcatacttggaatacatagagtggctcctgttttcctgaccaaactctgattaatagagaaggcctattttagttgtggttcatccctaccctaacttagagccctttagaggctcgacttcatgtggattgggtttgctgtaggactccttaccttgagtgggacctgggccttgacttctctgcaccttgccccttgaggccgtagaactgatgcttaaagtattcagtaccagcaaatattcacagagtaaaagtagttcctcagtccatttgggctgctataacaaagtgccatagactgggtggattaaacaacagaaatttctttctcacagtcctggagcttggaagtctgcgatcagggtgccagcacgatcatttctggtgagtgccctctgccaagttgaatactattgacttctccttgtatcctcatatggcagagagcagagagagctctctaggatcccttttatagggcaccactcccattcatgagggctctaccctcatgacctaattgcctcctaaatgccccacctcctaatgccatcacattcagggttaggatttcaacatatgaattttggggtgagggacatacacattcacttcataacaagtggctttggtgtactgatattcagcttacttctctgggaaatttgacctggcagttcccacattatcttttttttttttttttttgaggcagagtctccctctgtcaaccaggctggagtgcagtggcacgatctcggctcacagcaacctctgcctcccaggttcaagagattctcccgtctcttttaatcatgtaaatattttaaagggagggaatgtttctgtgttttatggagcattttttgttatttttggcaggagggttcatccgaataacctagcctgtcactaaaggaaatggaagccctcagaagctcttgaagcttaatccaaggaggttctacagggctatgctaatgaaaagaattttgtgcaccctggcaaatcagtggaagggatctattacatttaaggcaacaggcgttttcagagcctctccatttaaagcatttatgcagctctctcattcatgatattatccttcctcataataatggctttaaaaattcagtacaataaggtttcaattctttgcacttacaaatttaactcattcatagaccccccgaaacccatcagtgggtcctaggttaagaagttgtcacttagaaaaatatctaggccactcaactctggaaaccagtaagcccacagaaacggagctgaaagaaatgggcagatgtgttttatacacctgttggccactaggaacgctgcagcccagcaagccgaaatgctcctgttcatacagtttcagattgagctaagttgccttcttcccgctgcatctacacttgagaaacacaaagtatattgatgtggcactagcctaaaataactgtttcctgttgaatttactttcttggatcttaaagatgagaagaacagagtgtgaaattgagcttgttcacatgaacagttcctggagttccaagctgattggaagttaattcttcagccagagaactctctcttcgcatctttcctatcccttttgacaagaaagcaagtggaaattcacaaatcttattgtcagaatgaagactccccctttaagttttttctcctgcatcttgaatctccatggattataatcttaagaaaacaggggctccaaatacaacttgggtattcttccctctaatattgtaacagaaggagttcaggagagaatgcaaggaagttttattgatgtgatctcacatgagtattttcaaaggatgatttgggcgagggtccaaaaactgagatgagatgatccttctaggttgaagggatactatttttcaagtcactttttaatgtaaattccatcgcttactctttttgcatgacacgttcattgtagaagagttagaaaatactgccaagtaaaaagaaataagacgtggttaatagcaaccagcatttattgagcacttaccatgggccagacactgtattacatctcatttaattctcaaaccagtctgatgactttagtactcattatgtccatttcacaggtgtagagaatggggtccaaggtcccacagttaagaggtggtggagttgagatgtgaatataggcagtctgagtctggagcccagtcgcttaccactgtgcttttatatttttattccaagtgctgttacttagagaagcaactgattacagaggaatcagagtcaaggatctgaatttcaggtttggcttagacattaattagctgttagaacctaggcaccttgtttaatctcttcctgtgacactttcaaaggctctcagttgccattagcataaaatcaaagtttcttagtctggcattcaaaatccctattcagttctggtttgtctactgttcctgaatatcaaatccacttgaactttgcttgcttttactctactaatgctttagggttgatttgttatatcctgagttacccctaagcaagccatcccctccacccatgtcttagccctgattaagcttattcattattcatgaaaaaaacattgagtgcctaccacattccaggtagtgtgctagacactaggaccataacaataaataaggtggtcaacatcccaggtctcaagcatgttacaggttagagaaaggaaggaaggctaaatgaaataaacaaaacaaaacaattaggactgcaagttatgattaagtgccatgaaggaaaaaataagacaggaacctactttagatgggatgatctggaaaggtctttcagaagaggtgacatttaaacagagctataaagaatgagaaagagccagcattgttacaattgggagaagagcatgtgaaagaagaaacagcaaatgcaaagccctgagggaaacacaagcttggttttttattacggaccaaacagaaggccagtgtggctatagagcagagtgagcaagcaccagagtgaaaaaaaagtgaggctaaagagttaggcaggactagttcatgcaaggcatcataggccaaggcaagcagttcttggttttgtttattaataaaattaaaagccatcgaaagctttcaaacagaggaatagtataatctgctttgctttttgaaacaacaattccttcagttcacatgtagaaggtggttttgggagagttggagtggtggcgtaagaagacatcttaccaaaactgacttaagaaggaacaaaaaaccctgcattttcttacaagcattaaatatactgaatttgctattaaaaaccttcctgcaaagaaaaactccaagtccagatggcttcaccagtgcgttctaccaaatattcaagagtgatagccaggtatggtggtgcacacctgtaatcccagctactctggcagttgaggcacgagaatagcttgaacccaggaggcagaggtggcagtgagccgagatcatgccactgcactttagcccgggtgacagagcaatactctgtctcaaaaaaaaaaaaaaaaaaaaaagaaaagaaaaaaaagaaagaaaaaaagaatgaaataattccaaacttatacaaatttatccagagaataagaaaaggggacatttctagctaattttatgaagctaaccttgataaaatctgaaaaagaaactatgaaaaaaattataggccaatttcattcatgaacattaatgcaaaaatcctaaacaaaatattagcaaattgaaactagcaatgtttaaaaatataataaccaaattgggttcatattaagaatgcaaagttgctttaacacacacacacaaaataaatggatgtaattctgccaccttaacaaattcaaggagaaaaatctgatgtaatctcaatagatggaagatgataattgtcccttaagtcaatctataattttaatataattaagacttattataaaactgtagtaattaagacagggtagtattttcataggaagagacaaataatccaatgtaatagaatacagcacagagagatacatactgtacatgctttgacacttcatatacaactgaaatggcatgagaagcatgcatttttgattaataatgcagtaaaaactgagtataggacaaaaatgaaaattgacccctacaacacaccatatataaaaatcaactttaggaagataaaggaccaaaatgtgaaaaagcaaaacttttagaacatgggaggctacctttgtatcctcaggataaagaagagtttataaaagaaggaaaaagtagcagaaccaaaggaaaacattgatacattcaactgcattaaaattaagtacttctgtttatcaagatacatcacaaaagagtgaaaggactggccacaaggggagagaaaattttgcagcatctatgagccaataaatgactcatatccagaatatacaaataacttctgaaaatcaacaagaaaaagacagacaacctaacagaaaaattagcaaaagacttaaatagacagttgataaaaggggaaattcaaacagccagtaaacatgaaaaggtactcaacttgattggaaaatgcaaatgaaaaccgtaatgagaaaccattacacacccatttgataggcaaaaattgaagcctttcaggagtggaagttcagggtgtggctgattaaggagttaggcaaatccactccctaaaaagcaaatataaagctaggctaaatcatacaagcgaccattttggcactttagaaactaacctaaggtgtacatgaatctgagaagaacttatgcttgaaaaactgcttgactttgggtaagaacattgaaaatctgtggcctagggatgctcctatctcatatcagttccagtgtggaggaggttctgtcagatcttgagttggcagcttttctgccaaggtcaaggggcaggacccattctattttgagaaaagggcagtgcccatgcttagcatcactgtcaatggaactgatttctaggaggctggccagtgggagaaggccagtggattggtcctattagtctgaggtcgtggttgtagttggggtaaatgtatttcttgttttaaaatttaaattgtaatcttagattcagggggcacatgtgcaggtttgttacatgagtatattgcatgtaatgatccaatcgcccaagtagtgaacatagtacctaataggtagttttccaaccattacctcattccctacctccccacttttggaatccccagtatttactgttcccatctttgtgtctgtgtgtgtgtggccaatgtttagctcccacttataagtgagaacatgtggtatttggttttctgtttctatgttaattcgcttaggatagtggcctccagctgcatccatgttgctgcaaaggatatgatttttttctttttgttgctgtgtagtattccatggtgtatatataccacattatctttatccaatccaccattgatgggcacctgggttgagtccatatctttgctattgagaatagggggcaaacatatttatagctgagcccgctcacttgcacagcagagatctcaggaggccccaagctagtcacccactattgaccaaccttgaggcttataggcaaaagtgcctggcataaagtaaaaccagagacagatctgaaaacagtctgactttgaatgccatcttctatcaaggcaccgatccacaggtgatactggcatgaggtgtttgagcacctctgattaccaagctaaacaaatatagagacaaccactaggaagccaggcttaaaaataaaacaaaaaataaaaacaagagtatcgaaacataactgagcagaggcatcagtggccacatacttgcaccatgcaagggtaaaagatttagcctaagcaaattaccaaccaaagaaataaataaataagcaaaacaacaatagaaacctttaggaaaaaactatcagaatacagagtggctacaacattgatcaaaaatggccaattgtcaagaagaaaacattacaagacatgaaaataaataggaaaatgtgacccatacccaggaaaatatacatcagtggaaactatatctgagtgtccctaatggttggatttaggagacaaagaattcaaagcatctgttataaatatgtataacgaactaaaagaagacatgttgaaataattaaatgcaagtatgacatcaatgaatcaacaaacagtctcaatatggagttagaaatgattttttaaaggtaattctgaagctgaaatgtataataacagaagtgaaaagttcactacaggcgcttgagcagattctggatggcagaagaaacaatcagtggagttgaagataaataatttttttttgttttttttgagatggagttttgctcttgtcccccaggctggaatgcaatggtgcaatcttggctcaccgcaaactctgcctcctgggttcaagcaattctcctgcctcagcctcctgagtagctgggattacaggcgtgcaccaccatgcccggctaattgtgtatttttagtagagacggggtttctccatgttagtcagactagtctcaaactcccgatctcaggtgatccacccgccttggcctcccaaattgctgggattacaggcatgagccaccatgccggccgaagataagtaatttcaatagaaattatgcaatacaaacaagagagaaataaagacagaagaaaaaaaaaacagagcctcagagacctatggtataacattaagcctataaataatatacattatgatgggtgtagagagagacaggggcaggaaaacagaagaaagggaaagaggcaaaaaaaaaagccttgaagaaataatgtccaaaaacttcccagagagttgatggaaaatatcagtctataaatctaagaacctcaacaaaccccaagtgggataaatacaaagaaatccatacctagtcacatcacagtcaaactgttcaaaaatgaagaaaaaaccgtgaaggcaacaagagaaaaaaaaaatcttgttatgtacaggggagcataaatacaattatcaactttctcatcagaagtaatagaggccaggagtcaaggggatgatatgttcaaagtgttgaagggaaaaagctgtccaataagaattttatttcttataaaagtatcctttgaaaatgaaggtgaaataaagacatttccagataaacaaagactaagataatttgttgttagcagacctggcttataagcaatccttaaggacttaaggaagttcttcaggttgaaaggaagtgacaatagcagacaatttgactccatagggagaaataaagtatggcacaaatggtaaatatgtagggtattatgaaagattctataaatatatatcttttttcatttctcctctttttttaagcaacataaaattgtatgaagtaacaattataatattgcattggcgggcttcaaatatacagagatgtaatatatattacaaagaaataaataaataaagcaagaaagaataaatgagactatttattttcatgtcttgtaattttttcttcctgactactggccattttcgatcaattttgtagccactctgtattctgatagttttctcctaaaggtttctgttgttgttttgcttatttatttatttctttggttggtaatttgcttaggctaaatcttttacccttgcatggtgcaagtatgtggacactgatgcctctgctcagttatgtttcaatactcttgtttttatttttaagcctggcttcctagtggttgtctctatatttgtatagcttggtggttggaggtgctcaaatacctcattgccggtatcatctgtggatccgtgccttgatagaagatggcattcaaagtcagactgttttcagatctacctctggttttacttcatgcttttgcctatagacctcagggttggccaatagtgggtgactagcttggggcctcctgagatctctgctgtgcaagtgaggaggctcagctataaatacatttgccccctattgtcaatagcaaagatatggaatcaacccaggtgcctatcaatggtggactggataaagaaaatgtggtacatagatatcatgtgaatagtctaaataacctaaacaaaaaatagagattgtcagattggattaaaaaaataaataagatccagctgcttacaagagacacactttagattcaaagacacaacaggtcaaaagcaaaataatggtaaaagatataccatgaaaacagtaactataagagagccggagtgggtatattaaaattagacaatctagagtttaagagaagaaataatattctaggaaaaagataaacatttcataaggataaaagagtcaatacgtaaggaagatttaatagttataaatgtatatgcacctaaaaacagaaactcaggataaatagacaatttgacaattgtagttggagattttaatactctcaatcattgatataacagttaaacagaaaattaacaatgacatagaagacttgaacaatggcatatcaaccaacgaatatttatataatattacacccaacagttacagaataaatattcttttcaagtacacatggaacattgtccatgataaaacatatgttaggccataaaacaagtcttagtacattactgaaatcatacaaagtatcttctgtgattacaacataattaaatgagaaatcaacaaaagaaagaaatcttggaaatctccgaatatttgaaaattgaacaacatacttctaagtcacccactggtaaaagaagaaatcacaataaaaattggaaaatattttgagtggaacggaaatgaagacataatataccaaaacttatgggatgcagctaaagcagtgctttgtaggaaaattatgactttaaattactatactagaaaatgttataaaagagtcaaatcaataatctgaatttatacaatgagaatctagaaaaagagtagcaaactaaatccaaggcaagcagaaggaaataatgattagagtggaaatcaaggaaagggaaaacagaaaaataatagagaaaaatcaataaaaccaaaagttgatctttgaaaagaccaacaaaatcgacaaatctttagctaaactaacaaaataaaagagaaaagacagaacttaccaaagtcaggaacgaaagagagcaccactattgactctacagaaattgaaaggactataagagggtatgttagtttcctaagactactataacgtattattaaagactgcgtggcttcaaacaacagaaatgtattctctcacagttctggaggctaggaagtcaaaaatcaaagtgttggcaaagccacactctttccaaaaactctaggagagaatctttccttgccttttccagctcctgggggttgctagcaagcctgggcattccttggcttatggcagcataactgcaacctctgtcttcacgtggccttctccactgtgtgtgtctcctctgtgtcatcacgtggacttcttaggacaacagtcactggatttagaatgacctcatcttaactaattatatctgcaaacatgctatttccaaataagatcacattctgagattatgggtagacacagatatttgggggacagtattcagtctagtacagggaatattataaacaacatgatgtcaacaagttagacaacttagatgaactgaacaaatttctagaaagacaaattaatgaaacagattcaggaagaaataaaaaatgtgaatagacctgtaagaagtaggctgggagcagtggttcatgcctgtaatcccagcactttgggaggccaaggtgggcggatcacttgaggttaggagttcgagaccagcctggccaacatggcgaaaccccatctctactaaaaatacaaaaattagccgggtgtggtggtgggcacctgtaatcccagctactctgaagactgaggcaggagaatctcttgaacccgggaggtggaggttgctgtgagccgagatcataccactgcactcagcctgggcaagagtgagactctgtctcaaaacaaaacaaacctataacaagaaaatgaaatgttaggtaggtgcaaaagaaattgcagtttttgccatcactttaaatggcaaaaccacaattacttttgcaccaacctaatagtaatttaaaaattccaaagggaaaaattcatgtctaaatggctccactggtgagttttatctaatatttaaagaggaaataataccacttattcacaaacactttcagaaataaaggaaaaggggtcacttcccaccttattctatgaggccagtatcacctgataccaatgtctgaaaaaggtatctcaatgaaagaaaactacaaaccaatatccctcatgaaaacagatgcaaatatccttaacaaaatattagtgtggaaggcagaactctaacatgatcctccaagattcctggcccttggtgtacatacatattttatcagttatttaataaagcactaatctaggcattgttgtgaagggattttgcagatgtaatgaaggttctaaatcagttgactgaaaaggaatttattcaggttggcctggctaaataacacgagcccttcaaaagcaaagagattcctctggctggtctcagaagggcaagtcagagattcgaagcatgacaaggatttgacatgctgttgctgcttaaaaaagcagagagcagggaataccagcagtctctaggagctgagagcaacccccaaaagttagccagcaaggaaattagtacctcggtcctacaataatagggcactcaattcttccaataaaaacttggaagcagatattttcccagagcctgcaggtgagactcagtctggctggcactttgatttcagccttgtgatatccttagcagagatcccagtcatgacatgcttgacttctgacttacagaactgtgagctaataaatgggtgttgttttaggctgctgactttgtggtaatttgttactcagcactagaaaactaatacaattagcaaaccaaattcagcaacatataaaaatgattgtgcaccatgacacaaatgagatttattctagtgatgttagattggtttaacatctgaaaatcaattagtgtaatatactatattaatagaataaaagacaaaaaaccccacaatcatctcaagataggcagaaaaagaatttgatgaaagctagtgcccattcatgatgcaacaaaccaggaatagaagggaactttcttaacctgatgaagagtgtttaccaaaaatatccacagttaatggtgaaaacaatgctttcccctaagttcagaagtgaactgcaatggcaaatctcatacattgccaatgagaatgtaaattggtacagatacataagaaatagttcatcactatctgatagaagatagaagattcttatgacccagcagttcaactactaggtgtgtctcctagaatatcttttatatatgttcatagctacattgtcatagccccaaactggaaaaatgcaaatgtccatcaagagtagaatgaataaatcaattatgatatctttgtacaataaaatccaatatagcaatggaagtgaacactaaatttacacctaccaacatagatgaatctcacaaatacattgtgtaaaataagtaagtaaccaaagaatatataattccatttctggaactttaggcctaactaaactatattgcttaaggatgtctacatagatagtaaagttacaaggaaaagcaagggatttattctacaaaatttagggtagtgattacttctaggaagagagaaataatgtgatgaaggggtaacataacatgaaggtgcttttaaaggactggtagtgcttatctgggttaatggatgttcactttgtaatcattctttaaattgtgcatatgttttatataattttctacatgtatgatatatatccctattaaaagtttaaaaaataatagaaaaaagatgtaattaggtggtagaatgaaaggaactagtaatgattgttgtagggtgttaggaaaagagaagaatctgggatagtttccaggctcttggagtaaggttgtgacagtggagatggagagaagtggctggactgaattatatttagtagacaaaaatggcaggatttgatgatggatttgatgtgaaaagttaatccatggggaggaatcaaggataatatctaggtttctgatctggatagtaaaattggtggaggttattcagtgaagtaaggaacagtgtaagaagaagagattaggtggggaagcctgtgagacatccaaaaagcaatgcaacataggcttttgcttacataagcctacagaactcagtggagaggtcaaaattactttttaccaacattggcaaatatagctaacatttattgaatgcctatcatgtaccaggcatttcacacacagcatctctttaagctttttgacaactctgtgaggccagtactattattatctctcctttatcaaggagccttagagaggttaagtaatttttctgaagtcacatgattggaaagagtagagctgggattagaacctcaagaatctgactcttgagcccatggtcttttgaaaccctgggccaaagaaattcagtcacagaatgctgattaaagcatataggactaatgacacatggcttttgtggcacccagtgcatgggtctgcgttagtatggaaatgttcctctgtagttagttcagggctttgataccagccaatcccattaggtttctcatcttttatcttctttggcatctccccaaatgctaacctctctggtcattctatcttaagcctcatctctggtcattcttagaccaccgtgcgctcccttcacaccaactcaaccctgaattcgctcacctactttcttctctaccaactatttccatggtgccttctgaggcccttagactggatcctggctctctcccaagttaaggacttgctgtgatcctctgagtacttgctgcccattcttctatgaccctgaactacaggatgagagtaaggtcagaattatacttgatttcaagtgccatttccaaatgacctttcctctttaaggcacatgccgtttaaatacactaccttctattctttcttactgctatcattttgtaacctcacttttatttggtgaagaatttgtcaccgagatcgtgatcttcatatccatccaagtgccatcattttggatgatccatccaacttcctggtctttcccttctctactcatctttaactccacctccactccacctcagtcattccccacaagaccacacttcagaatttgtcatattccatccctgatatctaatcctctgagactcctctatccacagttttttactttctaaagcctctcactcttatgtccatacatatccatttcctgatctaatagaaaccacttagtttttctcctaatttactttgttttcctctgtagtacagacctcatggttcatcacatcagcccttgaatcttgcttttattcttacacctgcctgctcaccatgtgaaatccaactccaaaccaattcagacatccaactcttttgttcctcttcctgggctgctgagcactgctggaaaaaaaatcacacaattgttcagatttgggtcagtgcaaattcatagtttctaaccttagtgggacccttggtacttcgtgctaagtggctgcccagctgtcctactcttcatcgtttgtcagcatttttccccttctcttcaggggctattttcaaaccttccagtcttctcgagccctttactccaccactttcctccttaatttcagaatataaccttgattcttactacacatgataaatagaagccaccaaatgggaacttcctcaattccttgctactaaacctagtaatctatttacatctacacatattgaacttgtttccctcctattgtcagagacgagtccctccgactttgctttggatcccatcagagccattgctttaccctccccaccagtattttagggaacttacccaatatattatcatttctaactcctatgcattaaatcatctcccctccattgaacgcttgtttaacaagttcagagatatcccatcttaaacaacaaacaaccaaaaccaaaatgaaataaaacttacttaaccctgaatatctctctttacttttcatcccagcttctccagaggaagacctacattcaccatattcactttctcacctcccactttctctttaattcatcatcactagccttctgctctccccacccccactcctcatcacttttctgagttcaagtcaagggttccaatgagtacctttttgtcaagctcagtggactctctgcattcccacctgactcaatctcttttggcaattaatgactaccattccttttttgaaattatctttacatttcatttcaatggtggcattctttcttgtttttcttcctatctctctgattattcctcagtatcctttgcaagttttttttcagcccactccttaaacactattctccctaggatttctcttattttttatactctcaactttaagttcatttaaaccattgacttcaattaccaccctgtagctgaaggtacccaaatccacgtctgcagccccagcctttctgatgagctctagacctgcatattcaactaactagtagacatctctccccaaacataacatgtccaaaaccatagtcgtaatttcaagccaccaccccaacattctccttctgtttttcctgtctccatggatgacattttattatatcttcaagttgctcaacccagaaatcaaagtctcattctattgttttctctttcattcactacccacatttaaatgtttaaccaaattcagtagattctgcctgcttgtcacatctcatattcatctgacctttcccttcctactgtcactgccttagttcagttcttgttctctctcccctgaaatagcctctgccctggcctccctacttccatttgcatccctcaaatccatcacacctatagtagacagataacctgattgtatccgttccctgctcacaaccatttaggataaagtctgaacaatttagtatgatctgaaagaacttccacaatctggtgcctaattcatttattcatttcttgcttctctagaaccttatcctctagcaatgtgaagttactggaagtttcttgaacacaccatgctctctcaatcctccatacctttgtgcacacattccttctgcctgaatttcctgccttctgcccacacagagtccactcagatgtcaccttccctttgttgccttcctagagtcccccaagctgtcacaggcacaccttcccttttgcatccattgcttgttttatggacctccattacagcagttagcatattttcccccaattgttttttgtttttgtttttgttttcacatcagaggtcaacaaacttgtggctttcaggccacgtcctgccttcaggagttttgtttggcttggatagtggagtttattatgtgaaggatataaggactaagctcatgtttccttctggtaacagtcatttagagctaagtagcagtcgcctccttttgactgcacttgcactccccaggtcatcttagccctgcctctcatttcaacttatttgcctcacaagtttggatccttcgagtactttggtttcttgctccttgtttacaggtacatcttaaacctgctgttttgggatcactgactactgtgatctgcatgaaagtggggaacatgatttgtttcctgttgtatttatcctggttctcagaatcacctgctacgcagtagacagtgtttgtttgatgaatgaatgttctctctatctggaacactgtgttagtttggattattgattctaatactccactcatccctgtgtctttccctttgccatgagactctgcagttttttgttttgttttgtttttggagacagagtctcactctgtcccccaggctggagtgcagtggtgcaatcttggctcactacaacctccacctactgggttcaagcaactctcatgcctcagcctcctgagttgcttgctcccgagaagcaagaaatgaaggcacacaccacctcacccggctagttttttgtattgtttaagtagagatgaggttacaacatgtgggccaggctggtctcaaactcctggcctcaagtgatctgcttgcctcagcctcccaaagtgctaggattacaggcatgagccaccgcacctggccagactctgcagtttttttctaccctttgacttcagacttcaccatttgacttgctttggccaataggacattcatagatatgacgtaagcaatgacttatgtgatcaggctagtgcttctgccattgcatgaaaagaacctactctgggtagcccatgggtccaaggaggatgagagaaatgtggaaaagacctgtctccatagccaccatttggagccaaacccagatgaggtcagctgatctctgggtgacactcagacatatgagaagtaagtgtttgttgttttaagccacaaattataggatggtttgttaagcagcaataactaactgacacatatgcccaatcttcacttcccaagctttcaaaatacggcccatcctcagttcatttcaataactgccgcctaatattcagttatgtcattgtcctccaaatttttatagcacattattattattgttatttttaattttactttaagttctgggatacatgtttagaatgtgcaggtttgttacataggcatacatgtgccatggtggtttgctgcaactatcaacctgtcatctaggttttaagccccacatgcattacgtatttgtcctaatgctttccctccccttgcccccaccccgacaggccctagtgtgtgatgttcccctccctgtgtccctgttttctcattgttcaactcccacttatgaatgagaacatgcagtgtttgattttctgttcctgtatagcacattatttttaaaaagcagagttcttatgatataattcacacaccacacaattcacccatttaaagtatacaattcagtggcttttagtatattctcagagatgtgcatccatcaccgtgattgattattgaccattttcacaccttcctccactcattaaaaacctcacatctcttagccatcactcccaaaccccactccatccctagcaatagacatccacaaatttgtcattgtgggtttgcctattgtggacattccatatgaatggaatcatgcagtatgtggccttttgcatctggcttctttcacaagatctgttcatgttgtccatgtatcagtacttcacttctttttattgccaaataatattctgttatggatatgccacattttatttatctattcatcagtttatggacatctgggttgttttcacttctttgttattatgaataatgctgatataagcatttatgtacaagttgtttgcatgaataatacttcagttctattgggtatatatcaaggggtggaattgctaagtcatatgataactctgtttcgctttgtgaggaactgctatactctttcccacagtggttgcaccattttacattctcaccaacagtgtatgggggttccagtgtctccacattcttgctaacacttgttattatctagccatcctactgagtgtaaatggtgtctccttgttttgatttgcatttccctaatgactaatgttgctgagtatcttttcattggcttataggccattattcatttcttctttgtagaaatgtctattcaaatcctttgcacatttttaaattgtgttattcgtttttatttttgtggttttttttttttagactgagtaacattttcttcatcactcatgtggcatttaatagttactgtctggtgttgatagtatttttttttcatgtgtggacaacttattttcccatctagacagggaactctttgagcacagggactgtctcatatctattgttttccttactgcagctggtgataaaaatatcaccactccccagagctaccacttattgaacccttgatatattctaggtacagtgccaaacaccttacatatattatcttctcatttgataatcatagcaattctgtgaggttgttataatctccattctacagattaggcaattgagtcaggcagaggttgagacatctgctcaaggtcacatagcaagtggcatagaggggactcaaaagcaggtaagtccgactcctaacttgctttttttgttttatttatttttgtttttgtttttgttttttttgagacagagtctcgctctgttgcccaggccggagtgcagtggcgccatctcggctcactgcaagctccgcctcctgggttcacgccattctgttgcctcagcttccccagtagctgggactacaggcgcccgccaccacacctggccaatttttttgtatttttagtagagacagggtttcactgtgttactcaggatggtcttgatctcctgacctcgtgatccgcccttctcggcctcccaaagtgctgggattacaggtgtgagccaccacgcccggccctaaacttgatcttttaaccactaaagccattgcttcattatgtactgtatgctagtatgatgtgtgtctcctatgcatatagtgggctcacaataagtacttttgattaattagcctgtaaaatgcagataataaattctacctttatctcataaagtaagtcccacaaaagtgcttggaaaatacccaatgttcaataaatatgacacattttttggaatatttgtttatggattgtgcaaatgactgaaaatgtatggtggtaatgctgacattcacaagttgactgtcgcataatgctatcatcaagtgtcataatggaaaagttccagcctttcctaaggactacattttctctgagacactaaaatctggagttgaagaattctccagaggctaacctccatgtagacctttcatgccaccttgctgaaaagatattcgtctacaattctcagcggctttcttccccactcctgaagcttctatcgacaacatccctctcatctctttctctccctttctgtggatgcagctcggcctacccgacatctaaccatgctaatagcctctcagttgctatgggggttctttggaataagtcaagctgttggaagctttgtctgggcaaagtgtgtagctgacatctaaaggaactattccctgaggtcgggcactcatcccaacagaaaaggaagagctgccaaacctggaggcagtgcgcagtgtcgtgttttcaaagcttgctgaatttcgaatagcaaatctgaccatgcatacaaagaaaggtgatttaatattctgactacttcttccctcccctaataccatctgcagcagagacacagtagccctcctcctttttattaaaaccaagactattgtctcactaaagtaaaagatcctcatgtctggtcccagaattctgtgtgttccctacccaaggcaagaatggacccaaggtgcagaccacttagcaagcacgtttatattcagggaagtgtgcagagacagaagaaggctgcaagtgaatctgctaggggtagataagagctgcaggtcaccagcaccacatgtgacctgcttgtgatataagccacgtgctttatgctgtaattcttgttttacaaggcaataaagcaggggatgcggggcgggggtggggggacaaaaagtgcttttcagtgagagtgtattttggtcacgtcgtccgcccttttcttttctcttcataaatccggcatgactggtttagtcaattggaagttttgtgtattgtttggcttatgtatgcacagtgcctaggctctgtctcattatgctgatgttagcacaaattactgcatgtgaggctccgtcacctagagagggacacaggaaaggcaacatgtcacagaaaaaagaaaattaagttaggtgtttacccttgctctccacctcactaaaatagtataaactttgatgactgattgtcttaacatcacatttagtgtttttaaaagatgttttctgtgtttaacagcacagtctcttgagtcagaaaattttaagttcatatcccagctttgccacttgctagctgtttggccttgggtgattatttagcctctctaggctctgctttccttatctgtaaaatggtagtttgattcctaaaacgatgctattaactgctaaccatattgcttcattatgccctatgcaagaggatactggagtttttggttaagattaaatcagatactgcatgaaaaacatttgatacagtgcttggcacatagtattttgtaaatgctttcattgctttttctggggttaccaatacctggagaaagtatatggactgtgccgaataagagtaggcgaaggcattctgaatggagggagaaatttggggagaggtggggagcagtgtagtctcatggtaaataccatgaacattgacagcttcacctattaccagctctgtgaccttgggctagtcacaacctcagtattgagcctcagtttcctcataagtaaaatggagctaataataacacggttgtcatgaggattaaatgacatataaaacactgagcacgggctgggcacagtggctcgcgcctgtaatcctagcactctggaaggccaaggtgagtagatcacctgaggtcaggagtttgagaacaggctggccaacatggtgaaaccccgtctctactaaaaatacaaaaaattagctgggtgtggtgacgggtgcttgtaatcccagctactcgggaggctgaggcaggagaatcacttgaacctgggaggcagaggttgcagtgagctgagatcatgccattgcactccagcctgggcaacaagagtgaaactctgtcttgaaaaaataataaataaataaattaattaattaattaataaaacactgagcacagtgtttgacagaggaaatgcttaataaatatgaactgctgttatttaaaattatttttccctttgtagtttgacaccccaagttaggagcacaacagctaggtggatgccaagatattgagttgtagagcatgcataaggccgctgccgagttcaaagagcctggagaggaagaggccaaactgtaagattcatctgccccaagctcatcagggcccacattcagcatgttgtctaggacatcaaaataacttttgatgggtcctggacccatgacccatgcatgccattttggacagcatttcgcaggtctgagcctatttataaacactgtttattcatgaattttagccacttggaaagcctcctgaatcacatgggaccaaacccaaggcctttgtagcaaggggcagaaacttagccatttttcttgatctaccaagccagactttttgcaaagagttttgaatattttggagaatccgatgaaggccagggcctctttcccaaaagaatgcacataagccctaaccccctacttccctacacaatttagtacacagttttggagttttggagagttcaaagtcttcataaagtctgctatggatcccataggggttcatggacctcaggataagaatccctggattagtggaggaggacctttttaaaaattataattatgggattttggccatacagcccatcactcctggcttcagggcagatgaacagtaaattcatagactgaaatatttcaatttaagtatggtttgcttttttcttttccagaaagaaatacatgaggattcaccaaagaagtttggtttcaagagtcaaaataaaaaggctagtttacacaaagtgggttgtgggatgcttgtctaaattctttgatttggtcttatctgtggcatcctggcatgaaactgcccaagggagacttaatcaaatcctgggagattggcttatagaaatatatgtttttaatacttacctgatatacagggatgaaaattctagttaacaatccctctctaaacatacacaccttcttcttcactaaagaaaataaaagtcctaatatgaagtgttgcagatgttctgacagctctagtattttggcacataaatggatctgtgaaaagcatatttcttttttgttattaaatcagaatttcaatgtgtcctacttgctactgctgaatggtgcatttgccatacagatgttgatgcataatcaatgaacttttttaaaatgccagtgttccccatagcagaatcatcattcattgagtagggagggaggcagagctgagccaagagaaactgattctttcttgaagaatcatgctgattctctggggtccactgtacactggtcttcagagtttgagaaaacttgtgtcaggggtcccctatataaaagatcaacagaacatggaccataactaaaagatgttttactggtctcatgttttgctagcctctgtgtgtttcgtcacatgatcagcttgtaaagtccttaaaatgaactaataaaacatttaagtgtaggtagttatgtagagcccccaaaaggagggaagctgaggaggttatggccccttccataaccacaattatgggagaggagaggagatagcaactatggagaggagatgagacaaagctgaggttttgtagcctacagcaaagaaaggagcatggagaatggcctggaattgagaagggacccttatagtctttcattcagcctggagataaacatcatacatgaaattgtccaagagagaaggaacccaccagaattctgtgtggattttcttctcagatcccaaatactcccaaaggctgcaaatagaaacaaaggtgatttgatagatgagacagcttaaaaattttctgactacaaaacacccattgctggatagaatatttcattttcaaatgcatagttgagtatacaattaagaaagagaaattcccaaaagtcagagtccccccaaaagactgagagctgagtggaaagcacatgggttaaatgtgaggcttttctggcatgggagaatgttagtttcagtaatccaagggcctgagttttatagaagtttatgtaagtataggagattaatccattgacttacatgagatgatgtagatgctggcatggatgcagtgaacagagaacacttctacactgctggtgggaatgtaagctagtacagccgttatagaaaacagtgtggagattccttaaagaactaaaagtagaactaccatttgatccagtggtcctactactgggtatctacccagaggaaaagaagtcattattcaaaaaagatacttgcatatgcatgtttatagcagcacaattcacaattgcaaaatcgtgcaaccaacccaaatgcccaccaaaatgggtgcatcaaaatctcacaaatcaccactagagaacttactcatgtaaccaaataccacccgcaccccaataatttatgggaaaaaataacaaactaaaacaaaaacagaattgaggcccccgcattaaactagagccctcaaaaggatatacccttgtagctccttggagaaatggccgagtacaggtctggggcaagggaataaatattgtgttaatatttattccctctttggaatattttattgtgttaagaagagattatgtgcacaaagactaggggaatatagcaaaagaacataagaactgactcaaatgggctcccattggtcaatctgaggccaagtttagcattatttacaaagaggaaaagatattgttacaatgcagaggtctggaggactaccttaaccaagtggtcaaattatcatcatcgacaatggaacaaacatatatgtgtctttagatgtgaaataatgggaaaaacacaaagacttcaaacccgctaatataaatatgttcaaagaacaaaagtaaatcatgtttaaagaagtaaggtacaacggcaatttctcatcaaagagatctggggctgttgggagtgcgatcccaggagtgctcttcttagctgtctgtttcctggattctctctgtcaatcttgtgactgatctgccttcttgctcactgctacatttgacccctgaacaacacaagtttgaattgcacaagtctacttatacacagaattttttcaacaagtatattggaaagtttttggagattggtgacaatttggaaaacttgtagatgaactgcatagcctagaaatattgagaaaattaagacaaagttaggtatgtaatgaatatacaaaagatatgtaaatatggtttatgtgtcaatcgactatttttgttttcaggaagacttccagtcaacaataggctactagtagttaaggttttggggagtcaaaagttgtagatgtatttttgactgtgcaggagttggtgcctataatccctgcatggttcaagggtcagctgtattagtctcatgaagctaccagcattttttttttttttttgagacggagtctcgctctgtcacccaggctggagtgcagtggtgtgatttcagctcaccgcaacctccgcctcctgggttcaagcaattctcctgtctcagcctcccgggtagctgggactataggtgcgcaccaccacactaggataatttttgtatttttagtagaggtttcactatgttggccaggctggtctcgaaaacctgacctcaggtgatttgcccgcctcagcctcccaaagtgcttctgccagcctttcttaattgcttgccaccaagatctcctttttttttcctttggcactatttctggtttctttttttcctttttagttgacacataatacttgtacatatttataagatacagagtgatattttgatacatgtatataacgtataactgtaaccacccaatgggttcactttgccagctgcctagacagagccaatttatcaagacaggggaattgtaatggagggagagtaattcacgcagagctggctgtgcagaagatgggagttttattattactcaaattagtctccctgagcatttggggatcagagtttttaaacataatttggcgggtagaggcttgggaagtggggagtgctgattggtcaggttggagatggaatcataggggggtaaagtgagtttttcttgctgttttctgttcctgggtgggatggcagacctggttgagccagaatacgggtctaggtggtgttagctgttccatccagtgcaaggtctgcaaaatatctcaagcactgatcctaggttttacaatagtgatattatcctcaggagcaatttggggaggttcagactcttggagccagaggctgcatgatccctaaactgtaatttctaatcttgtagctaatttgttagtcctgtaaaggcagactgttccccaggaaagaagggggtcttttcaggaaagagctgttatcaattttgtttcagagtgaaattatgtactgaattccttcccaaagttggttcggaatgaacaaggacaacttaaaggctagaagcaagatgcagtcagttaggtctgatttccttcactgtcataatttcctcagttataattttgcaaagccagttttatgatgatcaaatcagggtaattttcacatctgtcacctcaaacatttatcttttctttgctgtgaacattgaaaatccattgtttttggcaaggccttaggcatgatcttcccatgttctcttttaaataaagtccatcatttcaggcagagctgtggagctctccatccttatggcctgactctcctcctgggcagtacttctgcaccactgtattggagctgaggtcaggggcagtggattgcttcttctggagtggcactcctgctttaccagtgggcactggggatggtggtagaccctggttttctcagcttgcctatcccatattagaacctctatcctctgaatgagctggggtggagccaattgggtaccactcctctaggcctatcatccctcagggagagcccttgcactaccagtgggagctgaatggggaaagggaagttcctgtcctctcagacttgcttaccagggatagaacttttgtaatatagggctggggaagatgagggacaccagcagcctgctcctctcaggttaaaactgtagccctggactagttgtggggaaggggaacacctgtcttcacatctacatgtgccagagttgagatttcatcgcacagatcttgttgggtggagcgtgggagcaggtagtagctcaaataccacaaactctcactgtactggttaagatttagtagattttcttggataaatgtttcttcatttgctgtatgttcttggggcaatttccagaaattctacatggtttataaaaataattttcagcacttaaattgttgttttactgcagaaacacttcgttgaactcctcacaccaccattccagaagtcctgcctgtccatgggccatttcttatatataaggaagaatgattcagtggatacaaccaagaactcagagggtggagccaagagctaagaagaatcattcccagagatcaggactgggccgtgatgaaagaactagtgatggatttcagaattgctatggaatgctatgtgtttccttgttcccctcctttgtgaactgaagtgtctactgtgattattaagtttctaactcaccattgtatgttgggtatgtgggggcatataatttgtttctttatttcataggtcctgagatctagaggctctgtactcaaggagcttcacttgaggagcctcatctccacctagacctgatttagctgatgaaatcctggtcctcagatctaatcctgatgttaaaataggctgagacttctgggggccttgggggaaggtgaatgtcttttgcatgtgtgagaaatgtaaataatttatggctagagaggagagtgtggtagacttaaaatggctgcaaattccttgtggctcctcccattgaatctggactggctttagtcactgcttgactaacagaatacagtatatgtgatgttgtagaattttagtcacaagatcacaaaaaaccttgatcttctgccagggactttttgaatgcacctgccatgctgtgaggaagtccaggtaaccacatggagaaccacacagagacagaatttgagatccccagctggcagccctagtggagctcctagctgacacccaacaccaatttgccagtaatgaagataattcattctggaagtggatactcagttccagtggaggcatcgggtgacgctgtgtagcgcagaaatgagccatccccacccaaattgcagacttatgagtaaaaataaattactgttttgagctactgttttagagtggtttgttatgcagcataaataaccataacgttccttaacctagcaactccacatctatatgtctaccttaaataaactcttgtgaataaaaaatatgaatgaggatgtttatgtggcactttatataaaagtaacgaagttgtaacaatgtgctatccctcagttggggaatggataaatagactgtggcttattcatacagtagttaaaataaatgagctagctccatctgtatcaatatatataatctaaaaatattgttaaatgatagcaatttgtaaggtacatgcagtagattccatttacatacattcaaaaatatacaaaatgatgtatgcattatttatggccatacatttttatggtaaatgtataaaaccaaagagctgattaataaacatcaaattcaggaacatggttctctctggggaggagagaaggagggagaaaggataaaagtggggctttggctgtagtagtaatgtttcacctcttttgttctttctttttatagagctctgtaagacaaagtgtttacatctgttttatcttagtggtaggcacaaaggtgtctgctatattattttctgtaatttgtatgcttagattagtcatattttaaattttttaaaattcttaaaatattttaaaaatttttaaatattttaaaatattttaaaaatttttaaatattttaaaatttttaattttaatttttgcactcattaatcactacaatatacagcgtgtcgtcaaataacatcccttctttataacactgatgaaaaaatctaattctggctggggccactgtgtgtgtggagtttgcatgttctcccagagtctgtgtgggttttctccatgtcctcctgtctcctcccacagcccaaagctgtgcacgttaggttcattggtgtgtctgtatgatcccagtgtgaatgagtgtggctgtgtgtgtgtatgccctgtgatgggttggcatcctgtccagggctggttcctacctggcgtcctgagctgctgggagaggctccagtcaccacaaccctgaactggaataaaccggtaaataattctcttacttattaatatttcttaaatgtatgtatagctcacatttatttccatgtttactattagatgtgttttgggtctttatttagaagtttggtgatttttttgaccacaaatatgccataactcttgtttatatcaattaacttgtaggaaaccattgaggactttgagttcttactgtactacctcaatttttttggtcataatcaacagtaaatattttattttattttattttattttattttattattttatttttgagatggagtctcactctgtcacccaggctggagtgcagtggcatgatctcagctcactgcaacctctgcctcccaggttcaagagattctcctgcctcagcttcccaagtagctgggattacaggcacacaccactatgcctggctaatttttgtatttttagtagagatgaggtttcaccctgttggccagctggtctcgaactcctgatctcaggtgatccatccacctcagcctcccaaagtgctgggattacaggtgtgagccaccacacctggccaacagtaaagattttaaaatcaacgttactaaaatattattttagtaacgttatttttttgtctaggttagctttttgtctggcttcttttgttcagcattaagcttttggaattcatatatgctaataagtatatcagtagtatgtccctttgtattgctgaatagtatttcatcgtatggatacaactcgatttttaaatttacctcctgttggacatacaggttgtttcctgttttggccattataaataaagctactatgaacattcatgtacaagtctttttgtggacataggtttccatttcttttgagtaaatagccaggagtggaatttctgagacatatggtaagtgtatgtttaactttgccagatgctaccaaactgttttccaaagtgcttatactattttacatttcagcagcaatgtatgagagtttgagttgatctgcatgctcaccaacacatggtattatcactctttttaatggtagccattcgagtgagtgagtagtggtatctcactgtggtataatttgcattttgctagtgactcataatattgagaatcttttcacatgtctattggtcattcctatgtgttattttatgaaatgtttgtttaaattattatccatttaaaaatattaagtagtttgccttcttattattgagttgcaagagttctttatgtgttctggatagaagtcctgtgtcaggtatttgggttgtgaatatcattttgaattaatttttgcgtatggagtgaggtaagggtggaggttcattttatgtgacatggatagtcaattgttccagcacttagctggactgtgcctggaatctgctctattttgggcttcctattatgtgaaataaatgttattaatttatgccaagaatatctgcatatattaattcctatgaccacctcccagtttttcatctaacatttctgctcagagcaacaggagaaggcataggggaattacctaagtgtgtaaggctctgcaactacacacacacacacacacacacacacacacacacatacacacacacacggggagtgagggagagagaaagacacacacaccccgcacagagattgattttctcattcttgtttagccaagtgcaatgacatacgtcatcatcatagttcacagcaaccagtgacaaaattagtttaaatcaaaaattaaatcccaaacacatctttctcacttcctttagctctggctcattttaccctgctgactctagttccttttctaattctgtaatgtaagcctttattgtctcctgctgggtgcaccataaccaccttcctggcctttcctctcctaaatcaatcctgccagactacttttttttttccagtgctgttttccctaaattgttcctaagctcagacctccacaatgtcttgttctgtaacctcatcaggttcagactattctgcctggctctcaagaccccactgcttctatcttcccaataggctggcatcctcacttttccatagacagcctgtattcattcctgcccctgtgcttttcgttcatgccattctcctctacaaagccttctgtgaactctgtagcctcatcacctttttaaattgtgaattcctgctgcataatccagtcagcctctgtcttttcttatattcactcttattgaatgtgtacatcttgtctccccaaccgggatagtggctatgtgagtgtaaggattctacctcatattcttctctcccctgcaatgctgagcacataaatgcttttctggattattttagtgttgttttttttttttttcactcgctgattagagtgaatgtcaatttgaagtaaaaagaaataacactttttacttttagagttccctttccatctctgcggttggctttggtagctttgtgctcctggaaggaggaaagatttctatgggaggaacactatggcaactccacccccaacttcttgattatctccacaggtttggaggcggatgggaggccaatattctctaattccaggccagaagtgaatgaggaagcaagagacagatggctggagaggagtattctctttcttagacatcaggaaaagccaagcaactgacccctgatttaaccgttgtttgccccagcaaagacgagggccactctctccaaaggagatgcaggcactgctgtttcctagctttaaccaagggaagggagaaacttaattgggaaaatatttttagaaatgagtattttaaaattgcacataggaaatacgcaaggagaaaagtatgcaagaaaatgcactcttactttccattttctatcccattgccaataaaagaggccctccctgcactctcaccttgcacttgagccatgaaggacaagattctgcaggtggcccccagtacctccctatagagctggggagagagtggtgttaattcctcacacgtggccccatgcacatacatacacacacaatcagtctccttggctttgtctttccttatcctttttcaaaaaaaattccagtctgatatcatcagtgatttgatgtgttctgtccatgtctcagaaggactgacccttgggtttcatccttgctggcgaggaattttagctgttcaatagcgtaacagctgtgcctggggaccatgaatcactcatgattttcagtaatctttataacaaacttccaatggcgttaaattcagtttttacatgtatgaagtctcactctgtgaagaaaaaaaaggctgtaaatacaatgctttcaaatgaaagtagtgattagtaattgactgtcatcaactttgttttgctctatggattacttcagctagaatttctggtgctgcagaaaactagttgagaaaataacaaccctttatgagcgatttcaggttttcttaccattttgcaatcttctgctttaatttgttttccattagtacatgctcaagtgtagcttaaagaaagagcactaagctggaagtgggagactgaaagtgttccagctctgccatcgtctcactctgtgactatgggcaggtcattttccttctctgcctcagtttcctgatctgtaaaaggaggggattaaacaggatagccttgaagggtccctccagctttgacgttttgccattgcaatcaaatatgccattttgatggattttttttaaaacaaaagatggaatttgtaacactggcattagctgttttttgttcttcttctttcttttctctcaataataagccttagaggtgggatttcaaaattagaatttcctacaagctgcagccataatgatagaaccatcacaggagtactattagagttaatattcttatctgtatatatctagagaagcaaataacgtttgaaaatcttttcgctgtttctctctgggttctttattcaaaggtgtttatgtaactaatgtgtcttagtggtaagaaaagtggaaatgccatgagtgaaagaaaataaagccccctcattttatctttgtcccagtctgtctttgtgattgtttctcggctaaccacctgtgttttactgctcagggagctcagcatatatcgctggcactcattcactgctaatagcagctgctaatagccttccatctcctgtcagggctgtcacagttgatttttttttttttaacatatctatgagttccatcaggtttaacagctgaaaatccagctcattaagaagcgccctaagtatttcagagtgagctagttttccagcgccaggcttgagtacagaatctggtgaaagggagtctagatatggatcaaataagaacccggagctttatgcccagaaatttgggaggagaaagggagttaaacagtaaataggataccttaagggatgggatgtgtgtttagtttgtcaaaaatacctgatgacctcatgtactccttcaaagtccacgcaggtactttaatatactgccatgtgtataaaagcagctccagaacggtgagaggtttgttaacattcatctcttcattcatttttgcaggtaacactctgggctctgttgctctttatgcagatcggacaaagaaaactcttaaaatggtttcctgctatatttgcctgctctgtttcagtctcttctgcaattccctactcacctctccaagtttgttaatattgtggtgccccaaggcttagtccttgaacttcatttcttctctagctacacctatgccttttgtgatttcatctagtattatgtattcaaatatcatcgatatgctaacaactctcaaacctatgtctccagcatggacctctcctctaaactccaggattatatatttaactgcctacttgccatttgcacttgaattggtagtcgatgtctcaaacttaacatgttaagaaactgaagtatttctcaaatctgttcatcttatagtgttccccatctcaggtagtggatccccctccttccaattgctcaggctgagaactttgaagttgttcttaactactctgtctctcttacacctcacaaccaatccatcaggaaattctgttggctccatgttaaaaatatatcctgcatttgacaactattgtcctctactgctatcgccccaaagccacgatcatctctcccttggattattgcaatatcctcctcactggtgttcttgtttcctcctctgccccctgtaacactgtattctctttttttctttattttatttttttattattatttttgagacggagtctcactctgtcgcccaggctggagtgcaatggcatgatctcagctcactgcaacttctgcctcctgcattcaagcgattctcctgccttagcctcccaagtatctgggactacaggggcctgccaccatgcctggctaattttttgtatatttagtagagatggggtttcgccatgttggacaagctggtctcaaactcctggcctcaaaccatccatctgcctcggcctcccaaagtgctgggattacaggcatgagccaccatgcccagccaacactgtattctcaatgcagctttcacagtaatggaattattttaatgggtaggcatgttacttctctgctcagagccccaccccctgccccacaagtctcatttaactttgagtataagccaaaggtcttcagggtccataaggcctgatataatctgcttcctcccttcagttaactctctgattttagtttttaataatgtccccctcactctgctccagcaaccctggcctcctttatgttcctcagacacaccaggcacattcttgtctcagagcctctgtgtttgctcttcccagtgcaggaatgcccttcccctgttaccacggctcattctctcatcttctttaggtctagtccctgccttagagtttacatagcaattatcacaatctacatatatattaattctatgttagtatatataattataattggtatatataattacatattagtatatatactacataaaatatataattatatatactaattataattataatatataaatatataattcatattactatataattataattagtatatataattatatattttatgtagtatatatactaatatgtaattatatataattataatatatactaatatataattcatattattatgtaatatgaattatatattagtatatattacatatcctatgtataatatataactatatattagtatattatatatactatatgtaatgtataattatatattagtattatatatactatatatactatataatatatattagtattatatattactaatatatataatatattactaatatacataattgtatgttagtattatatgtactatatactatataattatatataatttatataattaatatatgttatatatgatatattttaatgtatactatatatgacttaatatgttatatataatatataattaatagatgttatctatatattgctgtagtttgaatgtatgcatctttccaaaatgtgtatgttggaaactaagacccagtgtgatattattaagaggtgggaactttcagaggtgattacgtcatgaaggttccacattcatgaatggaactagctaggctaggcacttttgcccttctgccttctgctttgtgaggacacagcatttgtcttctctagaggatgcagcaacgacgtgccatcttggaagtggagaccagacccttaccagataacaaaactgccagagccttgatcttggacttctagcttccaggactgtgagaagtaaatttcggttttttgtagattactggtgtcaggtattttgttatagcagcaagaatggactaagatatatatacatatacacatatatatacttgtacatataagcatgtgtgtgtgtgtttatttattgtcttccttcactagaatgcttagtccatatgacaagtagtagaaaagttatttgtgtgtgttttgttcactgctgtattcccagcggccagagccaaggtaggcacatagtaggtgctcaatttgttgagtgagtaaatgaatgaaggcattatccaagactgggtgaccattgtttgagacccaggcctcaatgagacaatatgaagaggaaaggtcattgggacttgtcgtaatgtagaattattacttgtagaaatgtatggtctctaggtggcccaccccacctaaagaccatacatttccaagtatctgcttggatcgaataatggaattacaacactcatgtttttggtagtcaacttataataaatataaaaaatatataaaacttgtaataatggaggagcttgaagtataagcactcagtatgaacctggttgggtgggtttatactaagcaggtttggagagatgagttactgtgacagttaattttatgtatcaacttgactgggtcacgtggtgcctagacatttggttaaacattatttctgagtgtgtctgtgagggtgtttctggatgagattagcatttaaattaaattagtagactgagtaaagcagatggccctccccagtgtgagcgagcatcattcaatccattgagggcctgaatggaacaaaaaggtggaggagaatgcattatattagctctctgtctctgcctgactgcttgagatgggatactggtcttcttttgccctcagaccagaacttacaccactggttctcttggttctcagaccttcagacttggactggaactataccacaggctttcctaggtctccatctaatcaactgcagatcatgagacttctcaacctccataatcatgtgaacaaattccttatttttaaaacatgtgtatcatctcctattgattctgcttctctggagaactctaatacactttatatttattcttataatggatgtgtagtcccccatactccccaccttcatcaatactctttcataaccaatggaagaagttatggaagaaattaccaagtgtgggaggctaggcctgcaattcttggtagttttaaaaaaaattatacattttcactcctgtttacctgagaataatgacacagcaaacagtggcaaacagcttaaatttatattatctaatatttcttctttctttcagctctgctgcactgtctattggtaatcacattcttatctttgaaatgttctcttacccttttctttttggacactaagttgtactggataaatataactatgttatacttctgagaccccttttccatttactttttttttttttttgtagactgtctctcaaatctctcttttcctccttagtcctatttccattactctggtccaagccctgatcatcttatgcctggcaaactttaatagccttctgtttgactccctggcttccagctgtttttctccatgctgcttcttggcattctaattatccggcattttggcagatgtcttagtctgttcgggctgctataatgaaataccactgaccgggcatcttataaacaacagaaatttatttctcacaggtctggaggctgggaagtccaaaatcaaggtgctggcagatttggtgtctggcggggctcaatttctggttcatagatggtgtcttctagctgttgtcctcacatcaagagggagcaagtcagctctcttgggccattcctcctagatagcaccttttagctgtgtccttacatggtaaatgaggctaactagctctttgtgttcttttttataaggcactaatcccaatcgtgagggctttgatctcatgatttaatctcccaaaggcctcaccttataataccatcaccttgggggttagagtttcaacatatgcattttcaaggggacacaaggattcagaccatagcagcaagactgtggttttagaatttgggggcttaagcaagcatcagatactgcatacgatgggagattgggaaaggaggaaagaatgctcatcagccttcagactcaactagtctagagatcactaccagccctcaggtgtgcagtcttgttgaaatattctgggcagaggaaggggtgggtgtcttatacccagattgtgacttacctagggctgggaccagaaaaaacaagtacaccagcatgcaggcctcatggagactccctataattagaagggtcattgtttctaatgcctgggctacaatttttatcaaggttctggacaagagagaagcctctgcttattagcagaatcttcatggagaatccttatactttccctgtgcttgcctttctttgttggtggcatgaggagggatatagagagaggagggtgtggcaattattgttctagttgactggcactttccttctcaattttctacctctcctcccctacccctgcccagccactttggtttctcttgggcactgctctgcgtcctagtccacttacatagttttcccaggagcgtccattttgttacacgacactagcctcatggctacctggtctggacacttgaatcaagttggtcaatgagttccttcctcagagtttctgtatttgaggtcagagtatacttcagttctctctctgtgtgtagttggctttgttaaaatgtgaagctctggagttgttggtgatggcagcaagaagaaagaatgaagttataattcagatagcaatagtgacaagagacatgcagaggcctggctcattctgtggcaccagtgtagttgtttctgaggcccagggagattcctggcttttgattccctaaagcagtaatgatgatacttcatgttgacatcatgcttcaagcactttaaataacttatttaagtctcataataatcctgtgaggaagatagtattatcatttccattttacacatgaaaaaactgaggcagagggaggctgagtagcttgctcaaggtcacagagtcaggacttgtacccttgtagttagatttcattctcttcacattatacctccaatctttgtagcaattatctaaatcacccttgcctaagccagttcaaggaccctgctaccaccatccctaggcaagagacagggtcctaatagatggaattactttttgtatgcccaactttagaagtttaattctctctggctctttctcctttgttgcctcctttcttctccttttcacttgccccttcctttcttcttttcttcatttcttctcccgagctcacgctctccctttttgaaatttgtcaatcattctccctattttcttgattattcttaacaacatgcaatggtattgtcattttccatattaaaaactgctctcttgactccatttcccccttcagtttcagccccatttctatgctcctctgtacaaccaaattctttaaaagggttatgcatattcagcttgcaattcttctgcttttatactctcctaaacttacttgtcaggcgtgtgccctccaccactctactgaaactgcaagtttacaagtgacctccacattgctaaatccagaggtcatttctcacttcttacattaattgccttttcagcagcatttgacaccttcactccatccttgttcacttcctcacttggcttctaggatgctacactctcatggtccttttcagtgtcacttgttggtttttcttatatccctggccttttaatcttggcgttctcctggcctcagtccttggaccttggtcatctccttggtaatctcatttagtttcacgactttaaataccgtctgaaagctgatgatttccaactgtatatttgcaacttggacctcttttctaaccttcagattcctttattcaactgcctacttggcatttccacctgaaagagattcagcatctcaaacttaacatctccaaatctgatcttccttctcaaatctgctccttctgtagtcttccccatcttggtaagttccactggtttgtgccaagaagcttcattcttcattccactctttctcttacagcctgtattcaattcattcacatgttcaaaatacatctaaaatcataccatttctcataacttccaatgctaccaccgtggtccaaagtcacttttatttcttttcttttcttttttctttttcttttctttctttttttttttgagaaggagtctcgctctgtcgcccaggctggagtgcggtggcgggatctcggctcactgcaagctccgcctcccgggttcgcgccattctcctgcctcagcctcccgagtagctgggactacaggcgcccgccaacacgcccggctaattttttggattttttagtagagacggggtttcaccgtgttagccaggatggtctcgatctcctgaccttgtgatccgcccacctcggcctcccaaagtgctgggattacaggcgtgagccactgcgcccggccacctttatttcttaactagattattgcaatggcctccaacgggtctccctatttcctcccttaccgtttacagtttactttccactcagcatccagagtgatcctttgaaaatgctagatatatcatgtctcttctctgctcaaaaccctacgatggccccagttttcacgcagaataaaccctagagtccttacagtggcctatatggtcctattggatctgggctcctgttacctttctgaattcatcttctcctatgttaccgttttcccccctatactccaagtgtactgtactccttgctgtttttgaatacattaggtaagttcctgcttcaagaccttagcatttgcatttccctctgcctagaacacttcccttccggatatatatgtaatccattctcttacctttaaaaaatctttgcccaaatgatgtttcctcaggtgttcaaatatcaccctatttaaaattcaatatggcccaccaatattctctatcctctttcccatttttatctttttccttagcacttagtaccttctcatatattatataatttatttactttgtttattgttagtctacttgtgctatggattgaattgtgccccctcccatttatatgttgaagccctaacccccaaagtgatggtatttggagatggggcctttgaaaggtaaatagggggagatgaggtcataaggatgggccctcatgatgggattagtgctcttataagaagagatattagagagctttctctttctctcccccaacttctctctttctcttcaatgtaagactgtaaaaaagtggccatctgcaaaccaggaagagagccctcaccaggaaaccaaatcagtcagcaatttgatcttggactcttcagcctccagaactgagaaataaacttctgttgtttgagctacctagtctatggcattttgttatggctgcccaagctgatggaaacagccccctaccccatccctagagcataagctcaaggacaagaagctttgtctgattgcttactgttgtatcatcaatgcctagaatagttgtctagcatgtagtgggtgctccgtaaatatttgctaagtaaatgcatggatgaatgaatcagatatggtccttgcagagaggatgacatgtacatgagcacactatgaggtggacagtggttaagtcacatgatgaaggtacagataaagggttctgagggctcgaagaaacggagaggtcattcagagatggagagggagtgaggggaatccaggagggcttgatggagaaggtagcatttgagttagaccttgaaggaagggtaggttttagacttgtgaatgtatggggaggcacagggagttcagtctggctgaagtagtgtatttgaagagtagtagaagtggaaaatacaattagaatgaagtctggagcaaaatcgtaaaaggccctgaatgccagggtaaggagatttgtctttaggtgtggtatgaagtggagcggatatgaaggttatagaattgtcagtaaaactttgagtcatcaatcaatgatagtttctgatttaacttttggttctttactcaattaattgtctcttacctaactccaagttctttaggagcttgatgatatggttcctaaccataatagacaagaagcaaacaagaagaaagaggagagattggatatgaaaacagatatacttccagggagaaagggaaaatagctcgatggcttcttggcttgaaggatgaagatggaaccctcaacttcaggcttaatacctctgtgactgtgcaatctaataactaaagttatcagtggcagcatggatccataatgcagaggagaagtcaggacaggtctggaaccttttaacaacatgggaaaggatgtaaagtatctcagaaatgtttacaattttttttaatttaaaatgatttttaaaagattggtactggaaggggaacgtttcaactatctggtaagctcacttatattaaatactataaacaaggcatgattgtaatactggttttaccaagtgctgcatgcactgctctgtgtgtgtgtgtgtgtgtgtgtgtgtgtgtgtgtgtgtgtctgtgtgtgtgtgtgtgtgagagagagagagagagagagagagagaaagacagagagaaggctgtattaagtgaaaaacactgaattcagcattccaggtttttctctcctgaactggttcaaatgggtagaatatgtttcattagtgtattaaaactcatccacacccttgattctttgagttcctcttcatactcctcaagaataatgtctcagattcatctgtacatcccctattgtctggcagaatgtcttaagacagattaagcacttgaaccacatatgaattgaaatattgaatttcacatcttgaggcccagccacatgaaacagactgttttactggtgtgggcacaaaacttactttcttaaaaggggataagatgatgctttatgtttttctttctttctttctttctttctttctttctttctttctttctttctttctttctttctttctttctttctttctttcttctttctttttttaactctgcttggaatttcttgcctttttatgataccaaccacccattgggcagatgtcttcagggacgtcaacaacgcctagttcctttcctgtgctagaactgatggtttggagcctaacatctcgtaagcagtgtttggctcattttttcctaaatgcagtactttatacttgctcatattgaagctcatctgtcactccttcacatggaaatgcaaacttgaaggcatatcctgtcatttatgcattgacttagaatttcaaaatgtgcaaagaattagtatgccaatcatttataaatcttattgtttaaaatatattttattataataagtgattctatagagcttaccatgtgatgggcattattctaagtaatttataaatattaacgcttttaatgaagttactcctggtaccactttgggaactctcactttacctttcatcagtcttcctgctattggtgcttctttacatagagacttcaggtagaatttagtgtgtgaatttggatggaaaagttaaattcatatttttactaacctctaactgaaaattggcattttctttccttataaatgtaggctacaatctacagagatgttagcagtacctgtgcctttttcatcagcatcacagatattatcatatcacatgatattgcggatttcttgagctgtttatgctcatcactacttcggaactgaagtggttattaggcttgttgctgtttcatattgctatttcaggtgttaaaggagcatatatgttactatatcacaaacatgttttaaaaatattttgagaagtatactatttcaatatccagatggtccccaacttacaatggtttgacttacatttttcaactttataatggtgtgaatgcaatgtatgttcagtaaaaattgtattttgagtactcatacaggtttctgtttggtgctgtttttctgtttcagtacagaaacagattccatttttcacttttcagtatggtattcaacacattacatgagatattcgacactttattataaaataggctttgtgttaattttttgcccaaatgtaggctaaagtgttctgagcatgtttaaggtaggctaggctaagctatgatgtttggcaggttaggtgtattaaatgcatttttgacttatgacattttcaacttacgatagttttattgggatgtaaccacatagtaagtcaaggagcatttgtagttggtttcctttgtattttattttattcatttaaaaaatgttattctgataaggagttcatgtgcttcaccagacttacaaaggggttcatggcaccaaaaaatattcagaacccctactttatattccctcagctataacaggcagaggctggagctgaagtggggtagagatagggagaactcaggaatcttacattctcatcccagctccatcatccacttagctgtgcgacctagggtatagctcttcatcttttgagacttgttttccttagctgcaataatggtgaggaagtcatctgcccctgctagttcacaatgtgttgtgaagatcaaatgacataatgcttgtgcacggagttgctttgaaaacagcttaaagcatcatataaggtatttattgaggaatagtaacaagttaaggtttcagaggtccgatgccacagaggactattcatattcaaacagacttggagtgaatgcagttcggtagaacaccctttaatgtgtcttgtataccatttccacccaagatctgatgtcatctccatagggctctatagccttgaatgtgcatacctgtttgtataatcaattcttttctttccttctgttgccccaataattaattgctttagtatgcctttgaggtcatcctcccagatagaaaacttaagcaagcttagaacttcaaagcttactgtcaaactgaaaaactgggttgatgttatgaatcttgggaaatggtagaggagataggacctccttggccttcttgttaatgggatgtggtctatcttgtaatgggagtgggtagaattggaaggatacttagactgtatcagaagacagtagaaggaagtttccccactgtgtttggcttgggccaagcactacctaactctaatggagcattgttcagtaaaatctcctgaatttctctgagccagcaggtctccttcttttaagttattgtgtggcccattactatgaaggtagctctggtttcattaaagcattgttgatatgactattggttggataatgattatagctatttattgagcacttactttgccaggcatagtactgggcactttacattgatcaacacctcataaatgaaacttcaagggaaatatacgattttcactttaaagatttaaaaaaggctcagagaagtgacagtgttataaagtgacttggggcaccatgactgtgtcatttagcaggctcccctaccagaatataagctcttgggggaaggggacatgttgtgttcacctttgaatttccaggactaagacttgcacatatcaggtgctctataatggcacatgaatgaacaatatggggtttataataatattaccaattaggttgatatgaagattaaataaaatattggagcagtggaaagttttaagcttgtgattggagagaccaagattcaaatttcatttctgcctcttaaaaacttaagcaagtggccgggcacggtggctcacgcctgtaatcccagcactttgggaggccgaggtaggcggatcacgaggtcaggagatcgagaccatcctggctaacatggtgaaaccctgtctctactaaaaatacaaaaaaaaaaaaaaaattagctgggcatggtggtgggtgcctgtagtctcagctactcaggagactgaggctggagaatggcgtgaacccaggaggcggagcttgcagtgagctgagatcacgccactgcactacagccggggtgacagcaagactccgtctcaaaaaaaaaaaaaaaattaagcaagttacttcacatctccaagtctcagctgaaatggaggctaatacatttacttttcgcattgtagtaaacattaaatatatatatgtgtgtatatacatatacgtgtgtgtatatatatgtatatacatgcatgcatatatcctggtaagtaggaatcactaaataatgttagcttttatcattattagtgcatatgaatgtagtttatttttattttttatttttttgagacagagtctcactctgtcacccaggctggagtgcagtggcatgatcttggctgactgcaacctccgccttccaagttcatgcgattctcctgcctcagcctcccgtgtagccaggattacaggtgtgcaccaccatgcccggctactttttatatttttttagtagagacagggtttcaccatgttggccaggctggtctctaactcttgtcctcaggagatctgcccaccttggcctcccaaagtgctgggattacaggcgtgaaccactgcgcccagcctgaatgtagtttaaaatgctacacaaatactaatgtaacaaacctttactaaacacctacagcgtaccaggttctggggatatggcagtaaacaagaaaaacgagaaccatactctcatgcaacttatactctggaggtagggtgggggcatagatagtaatagctcaggtgtcaagagcacgaggtcattaccaccttatccacacaattcatgggtagtcagcactgaatattttcacaattagcttttatggctttggctaaagggtgaaagacttaagttcagtgtgtcgcagctacccttctagctttttgaaggcaggggacagccatactccttttgtgtcccattgtgcctgatagtgtttgggacagagtaaatgtttagaatatgtataaacagctgaatttcgtctcttgaagtccagcaacatgatgtggtcccacaattctatgtatgaatacaaaaacttttttttttttttttttttgcagacagactctcactcactctgtcgcccagattggagtgtagtggagtgatctcggcttactgcaacctctgcctcaagcgattctcctgcctcagcctcccaagtagcttggattacaggtgcctgccaccacgcctgactaatttttgtatttttagtagagacggggcggggggggcgggtctcactatgttggccaggctggtctcgaactcctgacctcaagtgatctgcctgcctcggcctcccaaagcgctgggatcacaggcgtgaaccactgctcctggcccacagaaacattttttaaaatgtgagtaaggtcatgaactttggttgaatcacaatcatacctcttattgagaactcactatgggccaagcactggttgagcaatttgcagacgctatcttgttcactctttcctgccattctgtgaggtaggtactatttcttcttaattttgcctgtaaggaaattgaagctcttgttgtgtccatgtgactcgcctgaagacacacagacagagactttgggcatcatgactacctaataggtgctcagcagatggtagcaactgtggtagaaaatgaagccatatctacatgatgtaccatctaagacagctgagaatcccaagggctcacacagttctactgggcgagttaaaacttctcacacatttatgctatcttttcaaataatacagtttattctgccttatatgaaaagcatacattttggggccaaaattaaaaaaaaactctatataacttgaatgcagatgtgtctttaattttctatgaaaaataaccttcatttgcattgaagacatttaacaagcaacttggtaataataaagtcagaattagagatgtcacaggactagggaaggagataaaaaaatcatttgtaaaacaaaagaaaccttccattcattattatattgaagaaacgctaactactgtatctcataaacataacaaaacagcaatatttcaaaattctggaggaacaacagaaccataaatagcactgagactttgtaggaaaaagcagcttcattaatagatttctatgatggatgaaaaggtttgtgagagatggtatgtgccacaatttgattgtgtaatataatgtatattcatatgtatatatctatgcttatctatatatagatatatatgagagagatctatttattttaaggaattggctcttgcaattatgggggctggcaagttagagatttgtagggcaggccggcaggctggaagttctggcaggagttggatgttgcagttttgagtccaaaggcagtctcgaagcagaattccctcctcaggggacttcagtcttttctcttaaggccttcagctgatcagatgaggtccacccacattataatgggtaatctgttttactcaaagtctactggcttaaatgttaatcacatttaaaatataccttcacagcaatatctagactggtgtttgaccaagcaactgggcactatagcctagccaagttgccacacaaaattaaccataaaaactagtatattcaagcaaactgggaggagtatacctatactaaactggcaggagtaacagaaacagacaatctgcaatgtaagttgattaagtgaaggagagtaaggtatttaggtgtggcagctgttgctttaaaaattttttttaatgtattaatatcatggtaaggagtttgattttttttcttttattttttaagtaagttccggggtacatgtgcaggatgtgcaggtttgttacataggtgaacgtgtgccatggtggttttgctgcacctcaacccatcacctaggtattaaaccccgcatgcattagctctttttcctactgctctcccctaaaaattaatttagtttatttaaacaagaaataactgtaaatggaaagtttcccttgatttcatagatattattaaaattaggtattccaagagcccgagactgatgaatcaaagccttccgtagcattgatgagagatgcatcagtgagcaagctagtgtaaaattaacctgagcttcctgctggtgccacagcagggtgcttcagggggaagccagttttcagcacgaatgggctgctgtggaaccctgtttccagttgtcaagacagacttggcatctttttccaacattctagtaacccaaaggaaggaactgagataactactaatggattacttagagcgtaagtcattaaaaacaggacacaaaactgaggtataaaaaggaatatttatcttttaaaaatacaactttgaacactactggcatctcatttacaaagtatttttgtgaaatactctccattggctttgcttgctcagtacattcttttatcttcaattgagactcaagggagggtatgcttgcattattataaataccacaaccaccaccacacacaataaagaccatctctgcctcaggacattcgccccaaacctccatcctctctgtttactttccaccaagcagaagtttctgaatggtccactcacatgctgccattgcgatttgccgatgggcactaccaaggtgtctctggcaattcgcactccaggtggagctgacctatttgtagaaagcctcacaaaccctagctcattatttattcattgattcattactattaatacttatatcaagtctttgcaaacattcagcatgaagtaaacatagtatttacagcagtactcggtttgcaattcaacacactgacaacagaagcaaagggaccaacagactgtaagaaggccagaggggaaagaatattaatataaatcccttctgccactgtgtgcgtgcgtgtgtgtgtttgtgcgtgtgtgcccacacatgagcatattttaattcacagaaaactgaacatgccctcctttaaaagcagactatttacaagtgattctgaatagcatgaacacatgccagtcatactggatacttgctttctgtaaacacatctagatgtactttttacaattctgaaacagatctttaatgtgatatgttagagaaaataactttggaacatttgtcaacttttggttcatagtaattttgcaaaaagccacaaaccatgctttgtcgtttaaaaggtgaacctggtcaggcaccttctagaagacactgatgtgttatttatttactggtctactggggattggaaagacaatggcagttacacagaggacttagtgctgctctcatgcctttcaccagtaacaacattaatgtaaagagaagtttagaaacacaaatcacatacaaatcatcaaaacatttcagttaacagtgtttaaaaaaataccaaggtctacaacagtagtacagacactgaaaacactccaaatactgtttagcatcaggacttttgcaatatttaaagacaaccaattgacagaaaggggaggaagttacagcacttgtggtttgaggcaatttctctttagggcctgtagttcgaggtgctgtcctaggatccttattttaactcaaaagattttccaggaatgaactgacaaattcaaaggaacttccacttgaaaaccattaaaaatataaatcactttctatgcttgtccaacacatatttatcttcaggatcccaagttgttaggcaaagagatttaggtcagcttcaagccctcgaagccacagaatttccatctcttttccaggctggctccaactccagtcatttcctgcttgaaggtatgctggagtctacccatgagacactccacatcgctggtgcagatctgtgggacagagagaacatctccattcaaaaccagttctattttcctaatcttctttcccagtgttgcctactttagaatgctgatgtgtctgtgtgtgtgctgcaggggcgtttaacctcctcctgctccttgcgcatttgtgtgtgttggcagagtggcttccagccagcagcgttcctctgctgtgaccatcagacagggtctgctgagttgctattggaaagagctggggtcagtcatgtggaaacgcctgggtttgtaagaagctgaatgatggctgctcagttctagtgatgctgcgtgcaggtccactgaagctgctgagccttttgggaggggaggaaggtagaaatggctgccaccagagcagaatccctcacaaatgcgttagttcataatggagaagtaacaggaagggggaaatcgctgtgttcatacttctctgcatccccatctctctctctctctctctttcacacacacacacacacacacacacacccctcaatacgaaaacaaaaacaaatctgtggactcctttaggacttgttttaggtggtcatcttcacattagtagagttagtaagttaccctcctcactatgagccttggcaccagggcttgggtaaagagcaccaggggatcctgaaagacacccagagttggtgtcacagtgaatatccctggagctggagggagccccgattctgttggtatcacctcaggctctctttgggagaccctggcactactccggcaggaagttgctaaggcggagctaggcctaggctaggagggcagttatgccttcttcccagtgctggcagtagactgtatccagtcaagtgaatgaagcacattccagggtatcatatagagttgaatccccatttcagaaaacatagataatgtgtatagatatatacatttaatataggtacagcacacttgcaggaaagggtctgaaatatgtgcccaactgttaacagtggttatccttgagcagtgggattgtgcgtggtaacttgcactttactagatttctacactgcttacatttttaagataatgtgcatgtattatttttgtaaattaaaaaataagcagatggtttttactgacacatagttcaatttaataccattgcaatggactacttggtcctagtattcacattccatcctccccttcactgccaaatgggctatttaattgcagaatagcatcacttcccagagggaaatgagggggcagtgctagctagaatgaaagcaaatgccattgaagaggatgtatcaccacagctgggatgtggttagaacaataagattcccaagtgggccactgtctttgttaagagaacatatgcttaaatgacttaacattttggacagcacctatattcaatggcacttctcaaaaggcccagatcctatgaaataggcagtacaatttatgggcacatttcactgaatgctgcttctgaaaaaaaaaatgtatcctgagctgattcattctgaggagtcaagagtcccctcctgcatcttagaggcatccttgatttcctagggaattagcacttacccctgctccagatgccctaggagttcccccaaaggatagcatccagagaaggaaatggaccatgagatcatctgtgagcaaatattcagtctgtgttacagaggctctcagctcattgctccatcttttttttttggcacctgcctcccttgttttgtaatagataatagcaggggtgatggtgggagaggtggatggaataagacttcccattttgaaaatgaacattggataatggctaaaaaccagggacaaaagtttgatggggccgggtacggtggctcatgcctgtaatcccagcactttgggaggccgaggcaggcggcttgcttgagtccaggagttcaaggccagcctgggcaacacggcaaaaccctgtttctataaaaaatacaaaaattagccaggcatggtggcatgcatctgtagtcccagctactcaggaggctgaggtgggaggattacttgagcccaggaggttgaggctacagtgagctgtgatctcacaaatgcactccagcctgggcaacagagtgagaccctgtctcaaaaaaaaaagtttggtgggtaagaaagctgatatgggttggtttgcagcttacaggtaaattaagagaggaaaagtcttctaagatatatgttggaaaaaggatggtcaacttattcaagtttgcctgagactgccctggttttaacatcgaaaatctcaagtcccaggaaacacttcagtctccagcaaaccaggacacatgggtcatcccacttgcaaaggggaagctctgcactgaatcacagtgagagagcaggtgagggaaacttcctgaaagcagtaactaatgacctatttatgcttgaggagagtcaggtcacctgttaacaaaaaatcccacatccccttgcatccccattttaggcccccatataccttattatcaagacggtgcaagtaggaacagatgtattcaatgcttgctccaaatgggtgaacatgaaggaatgtggagataatccctacagagacaagagcatggaggttatacttgagccttgtatttctcgaggttccacatgacagtgaatagcaagagctgactcatatgtacaacagaaatatactggacactattctaagtttacacgtattttactcatttaatctttataataatcccatgaggtgtgtattgtcatccccagttcacagctgaggacacagatgcactaaaagtgtaagcaacttgtccaaggtcacacagctggtaagtggcagggctggtatttgaacccagacagtcacatactgcctcttactgtgctatatcacatgtagaaaagctggcatttgaggagtcactttcattacttgtgatggctaaacactgtctgaattcaaggattttacaatgaatttacactgtgctgggcttttgcagttccttcacagtctttaaattagactttagcctcttaggtgttaataatgccttgctgttgtggtaaaagtaaaaatcatgtactttcctgattaaccttgtgcctctcacaagaaagtctgctgattgtatttgggtattattttgtgaacagctctgtaaagaaaagtcaaacatttcattcacggctaactcaagtggtcactagcattccatgcttagagccttgaatctctttgtgtaacagaattcttatagcagtttacagcctccaggaatgcccctgatttccacttagcctaactctggggtggctggcagcttcacatgctgccttcattgttctggccattaggttaattgtttaatacttctttctctgggaacaggtggaaaataaatttttcaaaagtataatatttctttctttcaatttttttttttttgcgttcacctcctttcataagatcttaagtgcatcaaatagacccagaattgagtttgttgaaaattgtcaggaaataaaagcaaaatttgatttggtttctaaactacaacttgtctgtccctttaagaggctgacaaagactagcacaggtttaaattgtagtttgaagttcaatcaaaggggtaagttggggaagggttccagaaggaactgagggcagggctcaaaatctgttccaaagggatgctattacttagaacattactttattcttaaacgactagataaattgaatttctaaacactgattctggctgagaaacttaaattctgaagaagacattccatgtttgaagaaattctagacgtcttggccaagaaaggctgtcaaatgccaagaaataactccagaggtttaaaaacattaagcgattttgtgggttcacacccaaaaagctgattgaaaaaatagattttcctttctctctgccagcccaagactaccttcttgaaaaaacaaaacaagaaagacttattttaagaatctttttttctaggactatccattcacagaggcttccttgtatccccagcatttctctgacaggtctccctgttgccatgccaatttgttaagaacttggagttggaagacgttaataagttgtaataagttgtcacttttcttgaagattcaatggcaggtccccctgtgcatctttattaacatatcaaagtgttaaatctgaggataatatccattaccaaaggaggcagagatatcttaaaaatatgcagaagccagtcagtgtggagggcttttgagactagagtggggctactgtatagctcagcttcctagatggcagctgggattatctgctgtggcctaagaccagtcactcttaaatgattagcccctcttaaatattttagagcctcaatctgccactgttctccaaatggaatataaagttagccagcatttgtgaatggtgctgtgaagtgtaatatgttttctacttactgagggcttactatgggccaggcactatgctaagtgatttaggtgagttatcgtattaaatactcacaactgccctttcgggtcggtaatatcattatgcccattttgcagatggaggaactgaagctcagagaagaaatggtggggtcaagatgggaagccaggtctgtctgattctttaaccatttgtgccatcttgcctctctgaatgaatttttacagacagcaatgctagcatggacctcatcaaagcccactagtgtccaaaacaccagtttcctgagtcatctgtcactgtgatataataaaaaaattaacatgtggtctttgtccgtggtccccggggcgcacagctcctaaaacctttggaatttctggagtgataagagttaagatgagtggtagctgggggccccttataactttagaattggggctggccatcagaaagacttaggcatgattagagggaggagagagtggctggagattgagctaatcaccaatagccagtgatttcatcagtcatgcctatataatgaagcctccataagaactttgaaatgatggggttcagagaggtttctggttggcaaatacatcaagatgcgcacccaaaaatgtatagaaactctgcataccccttcccagtaccttgctctatacacctcttccattgtatcctttatgctaaatcagtaagagtaagtaaggcactttcctgagttctgtgagccattctagcaaattatcaaacctggggtgggtattgtggaaacccctgactttgtagccaaatcagacagaagtagaggaaacttggatactgtatatttgagactggcatctatacagagggcagtcttccaggactgagcccttaaactcatggagtctaatgttaaactctaactttgggtagtgagtgtgagaacagaattcaactgtaggacacccacttggtattgaagagttggagatgtggtgttggaaaagacaccacgtatctggtgtctggaggttaaaacaaacaaacaaacaaacaaacaaacaaacaatcccttgtcatttggtgtcagaagtgttgtaaaaatagcttagccagtaacctggaaaaacttgagaggcctatagttgctccagaggctctctggaaaagctctctgccaaatacggtctgcgctagccccctgagtggacatgagagggcttatctatccttgcacagatatttaaaaaaaatctacagtgtgtttctccagctgacccctcttagcttagtgcttgtactgacatgcttgactgcttgacatggcagtggctacaaggagtgtgagggaggctggcagctgctgttaaatttggaaatttgtacttgttcttaacctatcatcttcagaactctgagttcttgcgctgccatgcttcataaatgcttggcatgtgcttattaatcttaggtaaagccctcctctcctccattgtacccaggcattgtacgtggcatgtgtgcattagcttccttacccactagcagtgcttcacgttcagatttgataggactgctgttcatggtcttctcaagagggtattcgctatcctggtttgaggcacacagcctagaagcacagctttcctgtggacacaacatgcttctaggtcagttcactttatttggcaatagagttggtttcaattaactacacaacaggtaacttaacacaggaccataaaaacaataccattcaatttggattactgaatgggagagaaaatagcataaattacaaaagcatcacagatattccaaagtttatttatagggctccaaaacacagaaacatttaaacatttaccttcaccagtttttttttttttttttctgccttcatcttgactttatacaagcaatctgggcaactagacccaacatttatggtatactaacaagatgctaggcactgttaggtaagtattatctccattctacagatgaggaaagtgaggctcaggtaaattggctaagatcacactgcaaggaagtggagccaggatttcatcccactgttaaaaggaccattgtttttttaaaaaagtttaaggtccacactctgttaatggtaagtcccatctcaatggacaatctacgttggctacactgccaatccactgatagtgaatcaactgttggtttttgaactaaaaattagagcttatattccactgacagttaatcaactgttggtttttgaaataaaaattagagctttcatttactagtctttctctctctctgatgaggacattatcagttagaatattcctgactttacagcaagaaatgaccatgacaaaaaatagcattagtaatggccttctttgttgtggaaagttcttctctttcagaatgtagcaggaaggggcggggggggggggtggtcctaagagaaactcaggtgaaatccatgaccagcagtcaaactgaaaaatacctccagacctttcatggctctttctttctctctttgggtacggagaatatcttttctgttattataaatgtgaaggcaaagctttcagaagaaggaataaaagaaatcactgcttcttttactgctgaaaagaaaatgctgctgaaatgctccttggggggcagatcatggctgactcagatgcattttcacttcttctctttccacaaacccttagaagggacaggattccttctgttttcttcaaagatgtcttcaaagcttccaggatgctgtctctgaatgaaatgaatggtctatgctgcaagacatgttgttgtgtgaatttacaggcttcctggctgtagtcagaggggaaccctttcttgatgacctactcaatctttggcctttagaatccaatccaggcagtaaccattatgccaagtttgatttaaactactagctcacttctaagccatgggcttcacatctgcttctgacccccttaaaacattaaatgatacggtaagccgtttcttaagtgtgagagtttaacagattggggttgatttaagatgtgaaaatattctgggaagttttagccatcttgaatagaactgcagccttccttaaacctgacttcaattttattatagctggcatttaaaaaattagaaggtacattgaaaggatgcttatcaccttgaattttactagcagatttaaagagcttagttctttccgcactaagacagacataagtcacactgttatactgcaaaacactgacaataactcaccctgtagcttactgtcaagaaacccaaacaaaagcaaataaaaaaagagatccctcctcaccaaaacttattgctttcctttcaacctgaaattatttttgcagtctaatgtgatggtactttgcttcctaacctaattgtgtcaggttgaaatatttggtcacaaatcagcttcccagagaagatcagtttataatgaactgtcatgaatttctctaaaagaagctttgcttaaaataacaagaaaaaaacatattttgactcactgttttttggattatcagttggatcttttcccctgtcctcatcagccaacacttcatggtctattcagtttccaaatgggaaacacttgcccttaggcacaatatggcaagtttcttctatgccatttgacctcttacttctttaaatgaaatactttacaaagcagaaagctacttacacaaaaaaatgtccttaggtcaaattgtgatgtcaatcctgaagagtaattctaagcataatgtcatgagcataaccccatgtctgtctacagtcttctggatacataatccattttatgcaggaagcaaaacagagctatgtggcagctctgggacactttagaagccccgatggcatgaggaaagtcctgataagtaaagcagctttggctcttttcaattaaatgcttgataaatgaatttctctgggattatgcttgtttctttaatagtgcccacaaaactggaaagtgagttggttttatgaagtggaagaattaaaagcacgttgcaaatggcctctagaagaaaacactttcaatcatttgtttcaactacaccaaggttgccagttcttaatgacactctaggggaaggcactgtgctggtaaacacactcagggcctgtatgcactgcatcttcctgagctgagaacagaagataaagagaatatgctcttgaggaactgtatcactgttgatttctgaccctcggtccaagctcctaatcttctcttcctttagagaattaaaacaaggaagttttggtgaatgggcttcccttttcagaggataacatcagctgagtattgatgcatcaaggaaattggagaggttgactttacacaccttgaatagaatgggcacctgattcatggttgtgatacatgattctatccagatattagactctctggtcctcattggtggttcttattgctgagagctctcaattgataaagtcccatcttggcttctagctttagaatactgtgtctcattttttttccccaaggtttctctcttcttggtattggctattcctctcatctgcagctgctcattattacactaaattgactagctgcaaagaaatgccaatgtgctagctgcacttgtgtttcttcctttaatgaaatgctcaattaaaggtgctttgtgtcacatgagttttctatgttgctatttgcttgacaagatgaagcagggaagaggtgtgcactctggtcgtctccaagagagaagactgaggagttttagggatgaaccgacttcttattcattgaaaggtgtacactccagaacccttagaaatgccaaggactcacacctaaaagcaaagcccttagtataagaattacccccgagaggggcttttaattcccaatcggccaaaaatgtttggccccattgatttctagggcataacttccagggcattttcactgtcactgaaaagtaggtaaaggggcaaggaaaaaggttcacttagggtgcatgtaccttttctttaagattttccaacattttttccacctgtaacttgtcatctttgagtttttcaagttcagcttctttctttttgtattcctcttggactttgagtagatgctacaagaaaagaccaaagacaatcaatttatgaattacggagccacacttcatttaaaatctctggctgaaatcagatatcaggtgggcctgcctcactttcctccagcacacacgaccatttttccataaagagattgggcaaatcaagatattttcactttacgttattttgtctgcctcttacgaaattcctttgaacttgttaatattttagaaaggtcctgagaaactaattgatccagtcacttaacttcttccctattctggccaggggtcagagtaggatgcagttaatactgtgtgggcaatgttttgattgctgcatataagtaaatgtaatgttgtaaagcattcttgcaaatagccatttgccaagccaagttcaatttctgtgaggatagtagtaaataatccaaattttacatgttagtttccatataagtaggcaggaagctatatttagcattattaataatttcaacaaataatatttattgagtgcctaatatgtactaagcattgtgctaaaggtgttacatgcacggtctcatttaaacctcacaatgaccctatgttactattatccctaaggctaggagaggttaagtggcttccctaacgccattcagatagtcagtggcagagctgggatttaaaaccaggttgggtcaaccccagagttcatgtccttacatgccttattatactatacgtcttttgagataagatgtgagaaattttatcattgtttacaaggcatttttttcaatacaaaataatcaaaatgagtgaaattattttttaagacgtagagacctaattctcactgaggtctttgaagtgatgaaatgaaataaaatttcatgattttcgaattgcatttaagtagcagaactatccttatgtgaaatggtttgaaaatcaaagaggggaaaaacagcaacaacaaaaatgtttccaaagtcttgcttttcagaggcttgcaaaagaccactggaagggttaaaaagcatgatacaatgtacattgtcaaagttctttgaagtgtaggtgaggaggtgcattttttcatagaaagatctctgatataatttacatgttctaattaaactccatggtgacggtaaaaggaaggtgagcattacttcacacattttgttaacagaaaaggtgaaatattaatgtcatattacttgtcgtataggaagacaatagtggcagaaagaataacatagggttcctagtgccagaatagactgctgttcatgatttgtaatttccaaccagcaattagctttgccctagacaatttcaaggcatacagttaaaaactattgcacaatttaagatgtaaggacaatggctggtagtctagcatgacagaagacaatagtggccttactcagaggcactactcctttactatagtgaaagcagctgttgatatcttttaaactgtaggatcactgtggtgatggttacgtaaaactcctagatgttgaacatctgctacactatgttgtctgtgaatgcaatcgcagttgggtgcatttatttactttgctttttacactttgaattatgcacaggtaaactcattcacataagtgactgttaatacaaaacaaaataaaaacaagttggtattatgtgctcaaagcattgacacttaaaaacctataatgtacctatttctactgaaatcaagggtcgattcctgccattccttttaaaaggctgtatttcttggtattctatcaactagatacttgttcatcagctctttttcatatctaaataattgaggttctttgtaaagaccctgaggccctgtctagatccctaagtaccttctgaagcataaagaaaagattagattatgttcagtgtagtctaatgttaaatatttttcactgaatgctcattctttgaaagttggcaatccattgctatctctgtattaattggaatatttaattaaacacaacaataactccttcctcagccatgccagataatattacatcaagaagaataataggtttgatattcaatttgattgcaggggacccttttataggtgagaagctgatgctattctacccagaagctcagaaaaccaaaatgcctttacctgttgcattccttgcagggcttgttgcaggagtttcagctgctgttctttgttagggtcatcttctctgtggactttgccttgttcttgcttgagcagttctacttcattccggtaggcatcgagctgccaacggaggctgtcattttcttccttcagagcttctgcctgtgatactaaggctaacaatcaatataaaatatgaaaccatatatccagattcatttgtgattcatctggatatcacaaaaaggttggttcttcctcttgatgaagaacttcaggtttgagttggccatctcagcaagagatagatacaaaagcacacaggcctgtttttataaatgaactaggattccaacacacaaaagtttacatcatgttcctcattctccacctcaaatataactaagatatttcgaggtagcatcaattttttttatttgaaatgtaggaaataacagccctataataataatataggaccaattcccttgaactgacaactgcctacacaatcatgttgctgacagatgtttttaaggaatgcagcattgagaaacttaacctcggaatttcctgctgctctgtagctttgtataaagagtcagattctaacttcagttacactcattttatttttactgaaaatgtaagggggaataatgaagaatcaaaagtagtgccagaggttagcaggctggaaagcaaatgctgagggacatggttatgggaggcacacaaatatgggggcccggaaaaagaaatacaaggcacagatggagttgtgttagtgaatatgcaatcgcatttcaagatttctttctttccttccttccttttttttttttcttttttttgacagagtttcactctgtcgcctaggctggagtgcagtggtaggatcttggctcactgcaacctccgcctcctgggttcaagcaattctcccgcctcagcctcctgagtagccgggactacaggcggccacaccatgcccggctaatttttgtattttcagtagaggcggggttttgccatattggccaggctggtctcgaactcctgaccttgtgatccgcctgcctcagcctcccaaaatgctgagattacaggcgtgagccaccacgcctggcccaagatttcttaatatgcacgttttcatgtacttcttttaaaataactgttaaacaacaatttgaaacacacacacacacacacacacacacacacacacacacacgaatatagcattgactcgtctcacagaggaaaagtaaatgtaaaaactaagacataagatttccagtttccagtctggcatgtaaggacctttagaagctgccactctgtcttaataacaagtaaaaagctgaacaatgtgaaaaatcaacaactctttttatatttgttagagaagtgaggttacagggcaaacagctgcccccaaaacaaaactggagatacagacaggtgaatacagagaatcacaatttactggaccaaagacccatgagcagaaacttccatgggacccagtccttgggtaggaaaacctgaggtgtaattaacaaattgctggaggctcagtgtggacaagtctgtgaaattagctgggcgtggtgttgtgtgcctgtaatcccagctactcaggaggctgaggcaggagaatcgcttgaacctgggaggtggaggttgcagtgagctgagatcacgccactacactccagcctgagtgacagagtgagactcagtcttggaaaaaacaaacaaacaaacaaacaaaactccaggaagacccagtcattggagagctcccacacatttgtaagttttagctccaggagatataccagttccttacagtgaatatcagagaaaaatctcctcatgtttctggcaggggaaggggaaaaggaacaattttgaaattgcagaccatcctggtcttcttcacaaggcctgccctcgggaaaatctattttaccagagcctcacctgctggggttttagaagaacctaacagacctgggggaagataaatgtccaactccagccccctcagccatcctgtcccaccaaaggtgtgtgtgtgtgtgggtggggggtgatggtggtgggagtgggataaaactgagaagcactggtgaagttcacagttcagagacacaggttcaccaaaagactgagacctaatcatagaactagagaatgctttcccttcctctacaccttaccacaatattactaaagggctacttatgagaatttctttcacctagtacatcatgtccagattttaatgaaaaattacaaggcatactaaacagtagaaaacacagttttaagagatacagcaaacaccagaaccagactcagatatggaagagatgttggaattatcagactgggatttttttttaaaaaactatgattaatatgcaatggtctttaaagaaaaaattagacaacatacaagaacagatggataataagagcataaagaagaaattcaaagaaagaataaaattaaatattagagatcaaaaacactaatagaaatgaagaatgcctttgatggggaaattattagactggacataactaaggaaataatccctgagcttgaggatatgacaatagaaacttccaaaactgaaaacctgtcttagtccgttttaactgctataaccaaataccacaaactgggtagcttatgaacaacagtaatttatttctcacaattctggaagctcagaggtccaagatcaaggtgccagtatcttcagtgtctagtgagggcctatttcctagttcatagatggtaacttctacctgtgtcctcacattaggaagggacaagcggctctttggggtctctttttataagtgtactaatcccattcatgaaggctctgcccttatgacctaatcacccccaagggcctcaccccctaatagcacattgctgattaagtttcaacatgaattttggaggatacatacattcagaccatagcaaaaacaaaaagaaaaaaacaacagatgctggcgaggttgtggagaaaaaggaacgcttttacactgttggtgggagtgtaaattacttcaacaactgtggaagacagtgtggtgaatcctcaaagacctagatccagcaatcccattactgggtatatacccaaaggaatataaatcattgtattataaagacacatgcatgagtatgttcactgcagcactattcacaatagcaaagacatggaatcaacccaaatgcccctcaatgatagactggataaagaaaatgtggtacatatacaccacagaatactatgcagctatttaaaggaatgaggacatgtcctttgcagggacatggatggagctggaagtcattatccttagcaaactaacacaggaacagaaaaccaaatactacatgttctcacttataagtgggagctgaatgatgagaacacatggacacatgggagggaacaacacacgctggggcttgttggagggtagggactgggaggagggagagcatcaggaaaaacagctaatgcacactgggcttactacctaggtgatggggtgatctgtgcagcaaaccacaatggcacgcatttagctatgtgacaaacctgcagatcctgcacatatacccctgaactttaaataaaagttgaaaataaaaaaaatactgaaaaaagtacataacagaatatccaagaactgtaggaccactacaaaagttggaaacatgtgtaatgggaatacctggaaggagaagaaagaaagaaacagaagcaatatttgaagcaataatgactgagaatttctccgaaattaatgtcagacaccaaaccatagatccaggaagttcagagaacacgagacaggataaatgccaaaaaccccttcagcctacgcatatcatattcaaacttaagaaaatcaaagaaaaaatcttgaaagaaaccacaagggaaacaaacaccttacctatagaggagcacaaataaacattatatccgacttcttttcagaaattgtgcaaataaaaagtggaataaaatatttacggagttaagagaaaaaaaatcaacaacctagaattctgcaccctgtgaaatctggatctacataaagaaaggaagagcatcaaagaatgaaaaagtgaatgtaaaataaaaacttttggctgggcgcagtggctcatgcctgtaatcccagcactttgggaggctgaggtgggcagatcatgaggtcaggagttcgagaccagcctggccaacatggtgaaaccccgtctctactaaaaatacaaaaattagctgggcgttgtggcaggtgcctgtaatcccagctactcaggaggctgaggcaggataatcgtttgaatctgggaggtggaggttgcagtgagctgagattgtgccattgcactccatcctgggcaacaagagtgaaactccatctccaaaaaaaaaaaaaaaaaaaaaaagagagaattatgctaaatctactcttcctgtgctttagaaacggaacaacaaagtctgggtgacagcacatctgtttacagtatggtttaccaaatatcttaggcccactgttgagacctactactcagaaaagaatattcctttcaaaatattactgctgttgacaatgcacctagtcacccaagaatattgatggagaagtacaaggagacaaatgttgtcttcacacctattaacacaacatccataccgtagcctgtggatcaagaagtcattctgactttcaagtcttattattttaaaaaatcatttcataaggctatagttgccatagatagtggttcctctgatggatctgtgtaaagtagattggaaaccttctggaaaggattcatgatgccattaagaatgttcatgattctggggaggaggtcaaagtatcaacattaacaggagtttgggagttgacttcaattctcactgatgaatttcaggagttcaagacttcagtggaggaagtaatggcagatgtggagggaatagcaagacatctagaattagaagtggagcctaaagatatggattgaattgctggagcctcctgataaaagtttaatgaacaaggagttgcttcctatggatgagcaaagaaaatggtttcttgagatggaatctattcctgatgaagatgctgtgaacattgttgaaatgacaaaaaaggatttagaatatttcataaattcagttgataaagcagttatggggtttgagaggactgacttcgattttgaaaaaagttctactgtgggtaaaatgctatcaaacagcattacatactacagataaatctttaatgaaaagaagagtcaattgatatagtatacattattgtcttacttgaagaaattgccacagtcacatcaaccttcagcaacctccaacctgatcagtcagaagccatccacataaaggcaaaattctcccccagcaaaaaagattacaacttgctgaaggctcagatgatagttaacacattttttttagcaatacagtcttttaaaattaaggtatgtaaattgttttttaggcatttgcttaaaagactacagtataatgtagacttaacttttatatgaactgggaaaccaaataattcatatagagtgctttattgcaatattagctttattgcagcggtctgaaatggaacctgtaatatctgtgaggtgaggtgaggtattcctgtatgcatttatgtatgcttatggacaagttaaataaatgacagcaatgatacaagaaatggaaggggagaatcaggagcattttgctattataagatacttgcagtacccatgaaatggtatagtgttatttgaaagtggggttgaattaattgtaaatgtatataatctagggaaaccattaaaaaatgtgaaaaaaagtataaatgatatgataaaggagaaaaatgtggaataatataatatgttcaattaaaaatacaaaaggcagaacaatggagaagacaaaagaaacaaaaaacaagggtaaccaaaagaaaacagcaacaaacatggtagatatttatccaactatatcaataatcagttaaaaaattattgatctaagtatgccaattaaaagacagatgtcagtgtggattaaaaaataagacccaaccataggttgcctacaagaaatctgctttaaatataagggtgcatatagataaaaaggaaaaagatggagaaagatataccattttaacactaattaaaagaaagtggaagtggctatattaatttcagacagagctgatttcagagcaatgaaatttatcagggagtaagaggagcattgcatactattgaaggggttaatactccaagaagacataccaatactgtttgtgagcctaataacagagcattagaatacacaagtgaataactgatacgactgcaaggagaaatacatgaatctactattacagttggagagtttagctcccttctatcagaaatggacagatccagcaaacagaaatcagtaatgacacagttgaactcaacaccaccatcaaaccactgtatataattaccatgtatagactatttcatctaataaaagcagattacacattcttctcaagctcacatggaagtttaaccaagagagaccacattatgggccataaagcacaccttaaaaagtaaaagaagagaaattttacaatgtatgttctcagatcacagtggaactaaattagaaatcagtaacagaaagatagctggaaattccccaaatacatggaacttgaatagtatacttataagtaacacatagattaaaaaagaaatctcaagaaaaatttacaagtattttaaaataaatgaaaatgaaaatacaaattattaaaatttgtgaaatgcagtgaaagcagtacttacgtgggcaatttatagcatttaatccatctattagacataaagaaagttctaacactaataatctaagcttttaccttaggaaactaaaacaagaagaacaaattaaacaaatccaaagtaagcagacattttgtcagtttcttacaaaactaaacatactcttaccataccatccagcaatcatgctccttagcatttatccaaatgaactaaaaacttgtgtccacacaaaaatctgcacatggatgtttacagcagctttattcataattgctaaaagttggaagcaatcaagatgtccttcagtaagtgaatggataaataaactatggtacatccagacaatggaatattattcagtgctaaaaagaaatgagccatcaagccatgaaaagacatgaaagaaaattaaatgcatattactaagtgaaaaaagccaatctgaaaaggctacatactataggattacaactatataatattctggaaaagacaaaactttttactggagatagtaaaaagattagtcattgccagtgattagtgaggaggaagggatgaaaaggtggaccacagaggattttagggcagtgaaactattctgtatgatattacagtgatggatacataccattttaaatttttcaaaacccaaagaacatgcaagaccaagaatgaaccctaatgtaaactataaactttaggtaatgatgatatgttaatgtaggttcatcaatagtaacaaattataatcaattgtaacaaaatgtaccattttggtgaaggatgttgatagtgggggatactgtgcttttatagggacagagattatacggaaactctcaactttccgtacaattttgctgtgaatgtaaactgctctaaaaaagaaacttattaatttaaaaaatgaaggaaacttaggttatatgtaattatttatggtttaggtcacatttttcaagttcaaaaatcataaagcctatttcaaaatatttaatcagaagatttcattcactcaacaaacattcatttagtacctttagaatgaaaggtagaatgaagtggaaagcaaaaaattgtgtaagggtagacataaattagataaaaaggcaaggcttttattttgagccgtctcctcaaccttatttttaatgagaaccaaataattatggtgggttttccataggtattaaagaggtcaataacactagtttcaatgtagtccaggaaatacaatttagaaaatcaagtttcaggcttatgactatggtttaaaaaatatgatcccactagtttctattgtttacatgccaaattaatggaaacatttgtagtttataccttttttgattactaacagaacacaaaacccagaaaaagagacatttttaaaatggatcaaagcagactgggccgcaggccatggggcccgcgcccgcctggagggatggggctgcccagcacctaagggctgggcctgctgcgtttcatgccccagcagccgcgccccacatccacgctgggatggtgaacctagcagccatggtgtggcgccggcttctgcggaagaggtgggttctcgtcctggtctttgggctgtcgcttgtctacttcctcagcaccacctccaggcaggaggagagggcagtgagagagaggaatcccctgcaggttcaagaccatgatcagcccatcccgtggaaagtgtagtttaacttgggcaatagcagtcgtcccagcaatcagtgccacaactccattcaagggaaacacctcatcacggatgaactcagctacgtttgtgagaggaaggatttgctggtgaatggctgctgtaacgtcaacgtccctagcacaaagcagtactgctgcgatggctgctggccaaatggctgctgagtactgtgtctcctgctgcctgcagcccagcaagcaacttctcctggagcacttcctcaatcaagcagctgtggcattccagaacctctccatggcagtcaaagatcacttggaattgtgcctggtcaaatgcaggacctcatcccagagactgcagcatgagaacacctactgggaccccatagcaaagtactcctactgagaaagcctgccagagctcttccctgcatgacaggccagtggacttactccagcctgggtgaggaggccccactgaagaactcccctcctggggcccagcttcagcactcaggccaggccgtgggaagaagacaaaggcagcgttaggaaaccttggctttgaccacttcttgtgttgtcatctttggcttcattcacgacctgggcttaccagatagaactcttctgtaaagcagcttggaccctccagctggtcccatttgggaaagatgaaaccgcaggccaggctcatggcagtgttggcgttcttgcatgactccaccctgagacctgcacagggacctgtgacttgtgttcgttggggactggtgtcacttctaggtttgatccagggcttttcactgtaaaattatttattggattcctttggagtagtgggaaaattataatgttttatgtaggaaaatgccttgcccttctagttgaatatgttcaaggaaattatttttgttgttgttctgtgttttcaagtttcacgagttaagtcatcccttcacccagataaaatgttttgtcttttaggacatggatgttctctctaggcagttatttttgtttgtatttcgacagtatcaagcgtaggccctgaacataacctgttagccatatcctgatgtctaaaattatctaaaaactcagacactcttccattctaatctaactgcaagatttctagcagtgggcactgtgtgtcctccctcagtttcttttctagtgacagttgaatgtgctcatataccctatggagagcactgttttagtagaaatctaacttctcatcctggagaaattttcttttgccacttaaaattaactgtgggctgctaagccagggtacaatgggagcctcaggaagatcagaggcaacttcttctgttctgtcaatagaaacccaatgttgaggcaattcctaaacagagatgtacctaacagcttgctgtatgtgttcattctttattgctttcagctttgggggcgcaataggtataaatgtttagtttccctattatttgcaaggaagaagaagaaacccaacttattagagtgctgcaagagaagagtcttactcctaccctgagtgggagatgagaatggtcattatggcttagagaatgctgcatgtgtaggttgctggtgtgccctgaatccacgtgcataaagcactccccatttttctactgtaatgcagattctctgattcaaggtctagcatatttgatcctaagatcaagacatcattccctttgaatagtactgctctttgatttcagtagtcacattaacacaactctcctatattccttcactaacctcaggattgagcaaggtcttttttatttatttttttttgttgaaattattgacctgggagcagggtgctagttctatggtcagaattcaatattttttttttcagtggagctttttctttgggcatatttgtcttccaatacatttctgcaatatttccttaacttcctactactacctcttatactcatctcccaaaataatttgcctcccttaaataagttttcttagatggtaagttgtcaggcaattttaaaaatattagatctcaagaaatctattccatttgcattaaacatttcagattctgtgtgtttgcagcaggactaaatcaaactctgacgtgaaaaaataaaaataaaaaaatggatcaaatttacaatctgtatattaaatgtataagaaagttaaaaggcaatttgacaaagatatgaattttcttgattacctatagggaagaactttgggtaggagaaagtaaaagaaaagtgatagaaattaaactggctgggtgcagtggctcacacctgtaatcccagcactttgggaggcctgaggttgggagtttgagaccagcctgaccaacatagagaaacctgtctctactaaaaatacaaaattagccgggtatggtggtgcatgcctgtaatcccagctactcgggaggctgaggcaggagaatcccttgaacccaggaggcagaggttgtggtgagctgagatggcaccattgcactccagcctgggcaacaagagcgaaactccgtctccaaaaaaaaaaagaaggaattaaacaattaaaattattagctataaatggtgaaagaaggttttatctaaaggaatttcaaagagaagactcatcctctacataatgaatggaaagaacttgtgcattaccaagatgaaatattgctgtggtttggttatgatttatttttcttcagcaaaatgcatattgaaattttatccctaatgtggtggtgttgggcctagtgggaggtgtttgggtcataagggtggatccctcatgaatagattaatgccctccctgggaaggggggtgcattctcactctattagttgttaaaaagagcctggccgggcttggtggctcatgcttgtgatcccagcactttgggaggccgaggctggtgggtcacgaggtcaggagattgagaccattctggccaacatgaaaccccgtctctactaaaaatacaaaaattagctgggtgtggtggcatgtgcctgtaatcccagctactcgggaggctgaggcaggagaatcacttgaaccagggagtcagaggttgcagtgagccaagatcgcgccacagcacaccagcctggtgacagtgggagactccatatcaaaaaaaaaaaaaaaaaaaaaaaaaaaaaaaaaagcctgacacctcccctctcctcttgcttcctctctcaccatatgatctctgcctacactggctccccttcaccttctgccatgagtggaagcagcttgaggctcttaccagatgcaaatactcaatcttgaattttccagccttcggaattgtaagtcaaataaaccttttttctttataaattacttagtcttaggtattcctttatagcaacataaaatggactaagacaagtatatacaaaaaaaaaaaaaatccacattagcgtgaaaacattctgtactcctaaaaggaagctgcctttagagaggtgctgggtttaattcaactccttgaacatgggggttttcctaaaactagtatgtactgatgtaggctgctgtggtcagatggtctatccaaagcagaaagtggcaacgtaatatgaagggttctggttagaagtatcttctactagtgttgttgaggtgttcttagcatccacatttgttttctgcggatggccatgcaatgatcctgatacagcagttttaaaacttgcattttagttttaaagacttataaaaagatctttggcatgacatattcattttatgattggttttattattaattttaattcttgttgttatgcagattttgtgtctcttggattccaagcactccaaataatatctatccttgccatctcttccagtggctgggatacttttcatcagacaagcactaacaaccacaacatcaaaagaagatactatgagtgaagatgatttttatatacaaaactctatagaaaaaggcatattaactatctgccaaacagaggaagaaatatttggtttgcttgcagggtgagtaccaaggacagcatcttgagctggagtttggctgaatagtacacaggttactctgtaaatcaagtgactcctacagattaacaattattaatttctgttttggtttgcatgtttgtcctctggcagtccacatggctcaatacaaaatagtgatatttcattttcctccttttatttcttcttgtactgcaggccagtaattatgctcatgttctacatgtcacacggagatacatggaagagaaaagggcagagatctaggagaatgattagaggcgtattctccagtttaaatgtaaaaatattttccctctgagaaaatgaggaggagagactgtttttgtcctgggggaaagggcatgctgatgagcagtgatggatacctgcagcaaagtgggagcagataataatcttctcagtttggacctgtcaccaagtgaaagaatgtgatcacctgtaatgctactgaggggaccttacctacaaaatatatttcccactctctgaaatgaggggtttttgtcattttaatgaggacaccaagtctttcctttcacagacttaatattaattgggcccatttctgaagctgaagttctttgtacattgccagaacattgaaaagttcaatattaccttttaataatatgtttgagtaggtgaatccatcagtcctgatactaaagagcatagtacagtgaatgtattcatatcctgccatcattagttcttggcttctcctttttggctatttcctatgtggggaaaatgtttctctttatgacaattgttcctcagatctgaaggctgccagttcatcatggcaatatgaaagtatgaaggcagctgtgaactcctctttttagcggagccactaacagcaaaatcccagacatgtttctgtacaacaaaagatcaaaaatgattttgtgccattaaaaaattagtgcctgagtctcttcaatggtacaaagaaaacaagaaaaaaaaattagtagaagtaaattcagggagtcagccacccttttaaagcttaattacaggagatgctaaaaatgttacaaaattatggaaggaagaatgggtaacatttctctcaaggctaataagaaagtttgagctgaggtgattcacaaagggaaaaagctaaaaagaacaaagagtgggaagaaagagcaggaaatgatatgaataagacctattggggtggctgcaggtcagctcaggcaaaaaatctcaagtgggtttcctgacctcacaatgccttgctttcccttgcctctacaggttattgtcaccattccaaccaggcttctgtcagcatggatgcacctggaacctcattgttacccctcttacatctctaaattcccatctcaaacacagaatcctcatctaccattttcctcactgcctctcatcaccccaagactgctctctttccttgctgggatctttaatctcacggagtggccaagttcactaagctagttcattagctgctttctggctgaatagatcccagtgcaacctcctcagtgccttgtattgcttcagcttcctgaaaacctctggccaggcttaccatgccaatccccaactcacagtcacttgactccactctctcttatcctgggccacagagaactcttataggaagttgcagagctaggcagctacatcaatacacactcatgttggcccttgctgatgggtctctcacctctcactgatttcttccttccatactgcccatagcatttattccaaatcggttcccttctcctcgtggtctcatttccaaatcatttttgtgatgaataaacaatctcttagtatatggagaagcctgggctacctatattctttcagcttcccctctcttgtctcagagaaagagggctctctcctctctaaagtaaacgctacttgaatatggatcccttccctttcttctttcaaagattccacttccatagtattcttttattttctagcatcttcaatctcatactctccattgcctccttcctttttattgaacaacaacaacaacaacaaaaacccttaactttatcgattctagttgccatttataatatccatatttccttttgcttagtacccaacttcttgatctatggtctttgtttactttattttactaatgtcatgtattctggcccctacctctatcactctactaaaatagctcttgcccagcattgtttctctcaattccgattttctttgtaacatctgttaatgtcaatgactacttacttctataaaaacttttcttggtttccacaacccaattcgtttctagttttcttccagcctctcagaactgcttttttctaactcctctgcaaactcctctttctttccttctcccttattgtggatagtcccccaaattctgtatccaaccttttgctcttctttcacttgtctttcatattcatttaataattttctcagggcttcagccgatacctctacactaccatctactattccttctagtttcttcaactctaatttgaatacaaaccccttctgcccatttctcaatgatctactatctgcagttcatctcatcatattccgcaaatcagtcccatccatcagtccatttctgtcagttctactgttatggtttgaattgtgtcctctcaaaaaagatatgttgaagctctcagaatctggcttatttggaaacaggttctttacgaggtagtcaaattacaatgaggtcattatgatgggtcctaacttgatatgattggtatccttattgacagaggaaatttggacatagaaacaggcatgcacacagggagaacaccatgtaaacatgaagacagagattgggatgatgcatctaccagacaaggaacatcaaagattgctggaaaatgaccagaaactaggagacaggaatgcaatagattctccctcacaaggaactaaccctactgaaatcttgatctcagacttctagcttccagaactgtgagacaatacatttccgtcatttaagccacccactttgtggtactttgttatgacatctctagtgaaccaatacaatcaacaggtctccagtctctcagactagaaaacacagactcattcctggctttttccttttcttaatcatctgtatccaatctggcactaaagacttaggtatattcctcgaaaatgactcctagcatctttaatctcattcaatccattgcctccttttcttctaccatttttgtctcagttcctcttgccttcactccggtcccacccttcagcattttacatctcacttcctgtaaaagtatctggttagactctcttaattgaagattatcttttaaaatgtataattcatgttgctttcatcatattagcgccacagacaagatgtgcttatagtggcatattgcttactatgcgaaatctaaggttggcatacatagccctccataatttggacccatctactctactcagtcttttgtcccctatatacatcatgcttatttcccactttgagccccgacccttttactccctcccttccccccaccatcaagatgctttcttatcttcctatcatctaaatctgttcatctttcaaggccctgatcaatttttcactgactgtgacaactctggcccacacctgatatctcttgccctgctgcattctaatcagtaccttccatgttagcagcaagtggtatttctaaaattttgtgtggatttacacatatttatatctctatctccatcagcttataggacatagtgcttgttaattaattggccaaactcttgaagtggaaataatggaaaataagaggtggggaaggaagaaggagattagattaatattaagggaacagaaaactttggccagaacaatgaaggagaattagtctaagtccatgttttccaaatgtgcttcctggaccaccagcatcgaaatcatttaggatggctgataaaatgcagattcctcagccctattacagacctattggatcagattctgcagcttagacatctgaatttgtaaaggtaacccaaatgattcttcagtataccaagtctgagaaccactagtctaagtaaacagagcagaagatgggtgctgaaagggaagagcttttcttatgtttactgggtacagtactttccatcatggctaacaagataatgaaataattttacactatcatgatttgctttgatgtgattgtccctcttcaatagattgctttgtgtacatcagtcctttcttccatggcaagagtatttaaagtactgcatcacaaatatgggctggctaatatagagtctctcaaataacagaaattttgtggcactccaaggaaagataactgagacttctaggctggttttactttcttcaggaagtaaaatctaaccagaaacataccataggttcctacaattcaagtttggtagcatggacagagggaaaaaaaaaaaacaacaacaacaactctgagatctcgttgcttaagcttttaattggaaccaaatgatagctaaaacatgtagccactttagataaaaactgaagaccttttcactggctcacaatgagcgggatttctgcagttgagtactacagaagtgagataacagaattagatacaatcgaggggaagaaaaatgcacagaagtccttgaattaaaatgaattgaaaccttctgggagaaaagctatttggtaagctccattaagtctattgtagatagctttatttgccaaagcagcatcctggcatgtggaacaggaaagaaaatagctataagatgatctgtcagggagtttccagtctctaaacgaataagattctgtgcagtagccaatacagcttttaactcaaaagagacacagaagcaaaatgcaattatataactctagtaagtgcattcaatctgagtctcccatatacccctctcctcctccaataactccacaaactcagcaatttatcaagtggatgcttaaacttatggcagcatttatttcatggtaacactgactaaatactgtgtacaatactgtagatactgaggtgtaaacaatcatacaagtgaaagattaatcagctataaaacatcctagctaagcacttaaataatttgaatagttcaattcttattcaactctgtgtttattttggctataagtttacagtatttatttgcagtaattagttgactatcctgaaaatgctagctaaccactgattacaaagggtttattcaatatagatagcagtttgtatgtttagggttcaaacatatggcaaaaatagaaaaaattcagatgtaatagctaataaatatctttttcaaagtctgacttgatgtttttctttccttcagagtttctgttcatggagtgaaaattctaagaccactcaagtggctatagagctgctgacttcactatacaagcactggaaccaggaaattcagatttgaattacaatctctctctctctgtctcttttacacacacacacgcacacacacgtacacacacacagcaggaacagtatacaactatatctccaatctctagtatagtgcttagcatgtaatagttattaaataaatgaactcatttaaccatcacaaaatccctgttagatgtttttttgtttgtttgttttgaggcagagttttggtcttgttgcccaggctggagtgcaatggtgcgacctctgctcactgcaatgtctgcctcccaggttcaagggattcttctgcctcagcctcccgagtagctgggataacaggcatgcactaccacacccagctaattttttgtatttttagtagcgatggggtttcgccattttggtcaggctggtctcgaactcctgacctcaggtgatccccacccacctcggcctcccaaagtgctgagattacaggcgtgagccacagcgcctggctgttaaatggtttttataatgtactccttacaagtgtggaagctgaggctcagtggggaagaagtccctcctaggtcaagaaggacagagttcggactagaactcaggtgtttcaactttaggtccagtggcttttccactgtaccttcctgtaatctgactcctaagattgtctggaatggtttgcctaaaaagagtagtcttctggatattttattatctgcaatggtaattctcccatccaagatagtttattatgaaattgaagaggagggtattatctgttgttcaaaaagtttgccctatgggtcccactaaggacctgtaacacggcctctgtctcagagtgaggttctgactatactaggttacagctgcttaaatgcccagcgctttttggaaaagaaagtccacttttaattaggcacttcaatgcaaggtatggataagtgaaaaccacagaaaatcctgtagccacagagctgataatcagccagtatgtacacatatggccttgccacttatttctagctggtatccaggctgataggttgatggccataccttactgggtattaaaagtttgaaaatatcatgtctgcaagtacatgtttattaaataaagaaaacagaattatctttacctgattcctcagtttcttttgtttctgtcatttcttctatttcatcatcagacatttccatttcttcttctcgcctgattcccattaattcatcattatgaatgttgcgaatttcctaaggttaaaaagtatgctttttaggtgggaattccttgaaaatgttgaggaaatgaatggagttaaggataagataaagcagcatttttttttgacatattaggaaaaaaatcctccaaatactcttaaggcaaagaggcatgttgaaagtaaaacagtctcagacaaagcagacttggttatactctgtcttgcattaggctttctttccagacccagagctccaggagtctatgattcttatattcctatcatattagacagtatttttggccatgaaagacattttacctcttacatggatttgtggactttcccttaagggttctgccattttcacctccccacgttggaccctttaattttgctgcttgccattctcttctctgtctttttatagttttactcaacataactcttaattgagtttttgtagttttagaagttacagcaaagatgagctttcaggagtaatattctaccagaccaaccttcccatggataataactataatctttggacaaaacacaaaacaaaacccattaactacttgatgacattggagagtgaacaaaagcagacatattctgaagagaagctgacacttggaagaaaggaatagcatagggtgagtctctcagtttttaaagggcaatttagtctgaggtagaccagagttagcacctcataagatggctaaatttctaatagaaagcccatagtctttatggcctaaagaactcaaggagagttcacggcagttacagccactggaaagtaagaagggaatcccagaaaggagacaatagaggcagggggaaagaactttaaattctgtatataagatctgctcaaatgtctgcatgagacccaagccaagaaagcacaaggaagattcccaacagcacagctaaggctaaaataactgaaatgacaactgagctggccatccaagagatagaattcccagcttgaatccaactaagtaaattgaccgttacgacaaacgaaaacaaagtcaacattctttgaaagaacatagcataatccagagtcttcacaacataatatctgtaatatctaggataaagcccaaaattacttgacatagaaaaactaggaagatatggcccatttccgaaagaaaggacaattaacagagaccaacactgaaatcacctagatgtggtaatttaacagacaagaaactaaagcagctattaatataactgtgctcatgatgtaaagaaaatatgtttataatgaatgaaaagatagaaaatctcagcagaggaatagaaacatttaaaaggagccaagagttcttttgtctgaaaataaaaagaaccaaggattcttttgcctggaaataaaaagaaccaagcattctttaaaaaaaatctctattcctctgctgagatttcctatcttttcattcattatgagcatatttcttttacatcactgagaatcgttataatagctgctttataatctcgtctgataactaccatatctgggtgattctacagctagaaaatgatacctgaaataaaaataaccagacgagcctaaaagtagaatagagatgacagaataatgagagaacttaaagagagagaaaaacaaatgtatccaatctgaagaacacagagaaagataaatatttttaaaaaacagagccttgggaccttgtgagattacaaagatctaagatacatgtaaataaaattgcagaaaaagaggagaaagaaaataattttaaaagatttgaagaaataagggttggcaatttctgaaatttgatgaaagacattaatctacatattcaaagagctcagtgaaccccaagcaggatatgtgtgaaaaaagtacatcatattaaaacagcagaaagctaaagataaactctggaaagcagccagagaaaagcaatacattatacagaggggaacaacaatttgaatactttgacttccttcagaaacaatttaaggccagaagtcagtgaaataatatatttaaagttcatgaagaaatacaaatatccatttattcagaattctgtattcagaggcaaattctctcaagaataaagctgaggtatattttcagacaaaattaaatgcaagaattcatcaccaatagacttgcgctatagaaatatgctatagaaaatgctgaagaaagttcttcaggctgaagggaagtgctaatggatataaacacagaccttcaggaaggcatgaagaacactgaaaatgattaagatcccatgataaaagtcactttaaaaaggtaagcacaacaactgtgcattttgaagcagcttgcaatcatttagaggccaattaatgcctgtcagaggcttgtcagcactgaactgagaattccttgcttggattagcctgtactgggctgtacacaggaaatatccgaagttgtctgtgaaaattgcctccatttaggggaattatatgtgtttcaaatggatttttaaataattaatggtgtagtcattatcacaaccaacatcctcctttttattcattttatcaggaaaaataatgatttctatctcaagttaagttttcactaaaaataaataaaagactctttttttaaaaagtgagctatttagtatcatcactgatagttaagaatagaaaaagaagatgctaacatagactctcccatgtgcttcaggggcattacttaaaatagaaaaaaataatgacttgcttgagaaaaatgaactttaaagggctgtgtcaagagagacttgctatgtcttattcaaacttattacacagagaacaataaaggaatttctcatttctgagaattcattctatctcaggagtctgattttcagttatcatcaaagagctgttaccggaaaggtgattataatgaagtttgacattggcaaattcgaatattgtacaacttaccgcattaggaaaagtcatggctttctagttgcctaacaaaaatgtagactattggagagtataagcagagaccaactctcaattcacaaacatgtcacataaccctgagaaagttattgtgtttctcagaagagtaaaatatgttccttctagggaaatgtcccagggcaggaatatctgagagctaagacatgtcctctagcttttcagcatccacaaaacatctttcttcttccagctgggcaaaaaagtgtaatctcttcttagaaacataaaaagttaaaaaaatatgtgatacagcttatctagtctttcacatcttcaaaaatccctggaaatataacagacctatgaacaaattttacctaaatgtttcaaagtacttcaggaataagaatcaccagttgctttaactgataataaagtaagggtaagaaaaactaaggggtatgtttccctaagtggttcagtcaggcaggcaaactggcagagctcagagccccctacccactagacaatcctttctagctacaaagaaactcaggctcatattattattcttctataaatacccaatactatatcacacgaatgagataaaaggtaaagagagcagcagaggttatggagtactatactaaagtaagcttatggggaacatttagtaagtgacagtactcctaaaaataaggagtgaggttttaattctttgaaaatctttcccttaaagcacttgatgtctgagctacttgtcttctgtattctccggttggatcagaaaagctctactttgggaaggaaaccctaacaaataccttcagagtgaagggctgaaaggtgacatgaaccccaggaaggcattctacctagtttggacataggtgcaggcaggggaaaaactctgagccactgaagagcagacagcaaaggaaatagctgtctcccagatttgccccattttccatcctggcattttgaatccagtgctgaaaccaaaagaatggtgatggcatgtggaaacatttttcagcaatttgcatttgtaaatctctacctgaaattgactgggtcacatcactggtagactacaacaaaaaaggtaagatatccctcctaaagtttttataccattctcctgcccacagtagatctgtgatatttttcatttcaacaatgaactgttagtgatttctggaaacacattataatgactgagtctgatctaatgataactttttctgaagcttagaaattcacacactactctataatggggaacaatgtactttcatatagaataaaactgaaatcggagacaggaaaatacatgaaaagaaccacttctgtgccagctgacatttttgatttatcataaagtaagcaaatcataaattgttacacattaattatctaactatagtttcacaaaaatgtatgtggatttaaattaatcttattcatgttttatgataggaacatgattaccagacaaatcagtttcttaataaatgtgtaacaaaattctacttagccagagtttctttttttttttttttaacagggtcttgctctgttgcccaggctggagtgcagtggtgtgatcatggctcactacagccttgacctactgggctcaagctatcttcccacctcagcctcccaagtagctgggaacacaggtgtgggccaccacacctggctaatttttgtatttttggtagagatggggttttaccatgttgcccaagctggtctcgaactcctgaactcaagcaatctgcctgtgtcagcctcccaaagtactgagattacaggcatgagccaccatgcccagcctaagactttcaacattaagaggaaaattggtggagaagagatcagacaagggaatggaaagcagaggatagggagatagcttctacacttatgtagaaatttgattctgagatatcatttaatataatgaagcaaagtacaaactcaggttcttaattaatgtctattatatgatacatagtggaaatacaaattaggtttatccaaattgtgttagtatgttttttgatggctgaaggccaacagccggtgttagtgcagataggtcctaaaccaagggtatgcagattatttgaatatctatctgcaaacagttcttcagagtttggaatggtaggcctgtaattctataaagaaagttattttagcaatcacagtatttcattttacaagaatactagtaatcaccaagtcccttttcctctagccccatggtgtaaaaccgcatctgagggaggatataagaggatatctcctagggcttattgttatggctctagtttttacacattatcaaagctttagctttgaatctaggccagctagagagaaacacataggttttaagtgattctgtagaaaaagagttcccacaacacacagaactgccagtaaagtcactatagacaccaacttttagtaaggggagggacttcattcagccttctcctaataccgttttcagttgtattagcagggacctcacacacatataaatcaggaacgtaaagcaatgaaaaagactcattagcaaactagtttgcttgacatatgctaccaaagtcagtgtctaagctccccaaaggcggaaactttttcttcatactccacatcctttctctcagcagagtaagaccgtgttggctgctggtagaaggatgacaatgagacaaggaacaggcactttgtgacatgaggaggtcattggttgacttgttctcagatgcaactggtaaaaaggttgaacgtcagaaactcactttgatgaaacccttggcttatgagttctatgtagcttggatgcctaggtcaaaaataaggcagcctagttgattaagtttttgagatgttctgattttcaaggggtgctaagaggcagccacaatttaagaggatggtttatttatttctcacaggatacctcctttcagtcctcacagttgcctgctatcaagtaaaagtttgcagaggtaaaaaaaaacaaggacaaaaataaaaacaaaaacaatgacttaaagaggcaccaatataaagtgaaagagatcttttaggtttagggaatgcaataccagagaaaggttatgagctatgtcccactttcagctggtgtagtactgaacaagatttgagatattcaaggtggaccttaatttaattcaatcaaacaagcgggaaggattttttggggtttctacagtctacaaggcacagcatgaaacatgtagctcctggaaagtcatgctggtcatgtactttatcatcaccactctgccaaggaagttttgttacaatattgggcaatagggtgcaaatatctcagttctctataggtcctaaggagtgtccagctcactggtacagctatctctactgtgagtctaattaaactcaagtatatatccgctagataagtaggcttgaaatattaatggcaaaaactgcaattacttttgtatcaacctaataactacacagacccttgatgaatatgattgatggataatattttatggccacatagtttgcaaaagtgttgtgacggccaggcatggtggctcacgcctataatcctagcactttgggaggccgaggtgggcggattgcctgagctcgggagttcaagaccagcctgggcaacatggtgaaaacccatctctactaaaatacaaaaaattagccaggcatggcggcgtgtgcctgtagtcccagctacttgggaggctgaggcaggagaatcacttgaacccaggaggcggaagttgcaatgagctgagatcgcgccactgcactccagcctgggcgacagagcaagactccgtctccaaaaaaaaaaaaaaaaaaaaagtattgtgacctaggcaaatcagcattccaaccagaggctcccttcctcctgcaaaaaggcaatgtactgtcacggctttccttaaagggtggggccattcagtcaacttcttctaacccaaagaggagttagaagtgtacgtgtatcaaagggaaggtagaaacttaatgcctattctgcttttctacaatcataagacctactgagcatttttctctcgacttttattcttctgaactgaagactggatattttaaatttagcgtgtgaaactcccctcctcctcttgatcactttcattacccttctaactccctgagggcaaagatcatttcattctatgttgcctatcatagtgcttgagatggagaaagtgatcagtaaacatctgaatcacaaagttgaattttgtttgttgaaggtgaacaacatgaggcagccctaggattctaaaaccattttgtgctacagtaagataatagtttccttttctcccctaattctttaaaaaacaagtaaagatgctattggctatttgtgactctaccaacccattggatggctgtcttcagggatttctttctagtgactcccagatccctttgccgtgccagaattgatggctcagatactatcagtttataaacaggatttggcttattttctcctaaatgcttttcatggttttcaaattgttctcacacaaacatatctcatgtattctcgtgaaggacagagagaaattactatccttattttataggttaagaaacaaagatccacaaaggttaaataactagctcgagaccacaaagcattttgtaccagagctcacagtgaggagaataatttctagtccatttgctagctttgtaattttgtgtaaatcacttaacatttttacgtttcagttttcctgcaggtaaaatatgaaatctatacctactcactatcacttatgaagctgttaataaaaactgaagtaatactatttctatttttcaaactttttacacatttcctaactcatctcatcctataagactggtttcattattgtctcgaatttacaggtgaagaaatagaggctgagaaaggctgaataacttgctcagtcacacagcactaacatgtcagagctgagatttgaattcatgtctggctctgagttcaatacttttttcacttcaccatgtctactgtgaggctcacacaggtgagataaccaatgtgaaagcactttataaatgtaaatatcttgtaaatgctatttaaaagttaaggaatatgacaatttacatggatagatataatgggactgctaccaggctggcaaagaggaccagaaatgtagttgaaaagttgctgcatatataaattgaaaatattgggacttggtaaggaagttgcccataggaataggaggacttgaggcatatgtaacaggattttcaatggcagatcagtgaaatctcccatctcagtttttaatctttgatgcagaagagcaatctaatcacatcacatttattctagtgttatgctaaaaatgtcacttgagtataagcagagaggtgtgtgccaaccttaacctaagatcagagtcctgttacctttaaagcttccacctataaagatgactaaatgaatttgataaaagaagctcagaaatttcaaagatccagtataacaccaggcggcttccgtccttcactgtcaagacactctaaaaaatgtaagacagccctaatattactaacactagaagcgcaggtcagtaattattgttgtacccaagactagctcgctaagagaagtaaacttataattatcccagctacattttcactactaaggtttccatccagcagaatgcattcaccacagcacaagcacatttattacccttttgacagcaggtggtctggacacagtgacaggctatagaacatatcttagtgtttcattagggccttattgtgaccatgggagcttggcactatttaattctggctaaactccagatcaataacttgttaacgaaagaaactgtccccccaaggggctaccagaataaaaagttaccaacctcagcttgtttgcaccacacgctgatgttcttccgctgggcttttgtgaagtggtcccatgccttctgcttggaggcggaatggtacacagccactatctgctcaactgcagcatcaaatcagcagttggatcaggccagggtatcatccagggatggaaaaagagaggagaaaagaaatgaaataaaagagaagcatcaggcttgttgtatcttgttgttatgacactatactaagctgtggttgtgcttggaaaaggctacatgtgttggggtactttgattttaaaggagacgcaaaggaaaagacatcaacatacagaaagacaaaagggaacaccagaggtttggggtaaaatggtaacaactagagttttaatacaggcattgtgaattcatggaggcaggagaggaagagtcatagcaaatgcacttttatttagtacttgtctttagtttagtactagtgactccacacagcatggaagaaaatggcaaactgtaccagaaactctctacccctggctcctttcatagccctctgacacacacttggatgccttgcttcaacagaattcatgcttttactattctgaggtatgtttaacaagaagcatcaaatcaaaacctaagatggattgaatcttttttaagtctaccaagatagactcgttgactggaaaaatataagttttagggaaggatgctgtgtaagtgcggtcctagagagtatttttcaaggtctcttaaaatgtcaaacagggaaatgtgtgcagatgttctggggctttatcctaatcacagttcaagagaggggaagcttagacatgactcctttgggaaaagaaaagcaggacaagagcccctgtctggttgggtgttcacagtaagaaaatccagaggtattattttttttttctttacatccctgtttgcaccctgtcttctaatgacttaaggatttatagtcccatgatgcgtgctgctttctctttttaaaaatttatcctaaagtcctgaagacatgtgcttttgcctcctggattttatgcccatatatactttcaaaatacaagtggcaaatggaacaactcccccttaatcacaattatgtatgagtcaagtacagggaagtcaagtttggaaagagtggaccataattgtttaaaagcaaaatcataaaattatacccttattcttaaggtgaatatactttcttactgaaaaaataagagtgtataattttataatgtggtaaacaaaaaattacttgataatttatctgatctggctcatttcagagaccttagataggtttggagcggaatttctttttaaaaatggccattttggtagcttctcaccttgtcccagtgtctatgacatccagcaaaggtagcagaagaaagtaaactaaataaaaaatgtagaagtagcaaatttgatttttatccaatcaccttgggaaatataattacattgatcattgaaatggagtttcttgaaggcatattacatgatgataattatacaaatctgaagaaaagcagctttaaaatgctgatgctacatcgtaactttagcaataaaatacccagccctctattgaggcccagggctgtagaagtataggatgtggcctaaggatcagtgtttctaaggagttgaagtagatataccagagaaaatgaagctagcaggtgcgcacatgtctcctgtgaaattggagcttgggcatttgacaatataaggagagcacaaggcagtgaaaaagggagccttgagccttaacacaggatggctctggaggcctgagctcccatagagagcaagtgactaagtgaagtgacttattctcattccagcagaactctaagttccactcacattgaatgagaattccagaaagggcctgcttgaacttctcctttgcttcttccatatctttctcatgggcagctttctcgttcaccaggcggcggacatggctgttggccgactggatcatggagtagaagttattggcgctacgacggttgacctctcctcgctctatccaggtaagcaaggtctgtacagcttctgagaatttggaatcatctgaaaaaaatatatttttataaccaacaaaggtaaccaaattttgatctattttcccaacatgctggcaaagagggcatcatgatttttggcagtgatgggtaaatgaattgctgaggatgaggagccacacatacacacatgtgcacacacaggcagtaggcaggcagacaaacaggaagaatggaaggatcaatgtagtcagactggttgtggtctgtgatgaattttcagaaagagaaatgtttccttgaaaaaagttttctgtactgatatataggtttcatgtattgcaaatttcttaccctctctgattgtgtgtgtgtgtgtgtgtgagagagagagagagagagagagaagggggaaagggggcagaggggagacagagagacagaaaaaaccatgaattagtgagggaacttcagaattctacagtcctgtgttttaatgaggaaaagcaaacttgaatcctgagtttaacttgaatttaacagtaactttaccttggatccatggaattacagtgttgggaggagcctcagggaagagttaattaagtaggtcattctttagatacaaacatgcacatcttcgaccttttatagtatcactcctgtgttcaatccacagccccaggccttccactcagtcccactcacaatctattttgatgcaatttattttatttctatatttctccacatccttttttctcttgcatgaagaacctccatgtagatttctgcagctagttaggagttattctgtgattagttaagatagtagcacagctcttccaaagcttctggttcagctccccaagatagccacttatgccttctgttcttaaaggctccagagagggagagtacatttggatctattgaagcccaattcaagggcttcacatccttctctggctagaaacccttatgttaaatggaaatttccttcactgcagtttgaacttcttgcctcttgcccctttttcagtgcagacatataacaagcagtcagcctcccctttatagcagcttttcactttattacttagatatagactttatgttgatgctcagtttttgcttctcttgaaggtcacacacccattaaattcatttttttaaacttaaactgatttgtttggtgttgtgtgactaggcaagtcttggacctggcgtcttaccaatgctttcagcctttccagtttttcaaaatgtaccattatttctgtgcctctattctggactctaggttttctgcttttcccttaaagaaagtcaaaaccaatttcttacatgtgtgaatcccttaggctatgtggtacaaacatgtctggtgaaggagacctatttggaaagtagggttagcagtatcttgatgagttgagaacacaagaagcagggaaaattcataccattagagctggattggtgttaccaataagatcaatgggacaccagcattcatccaataaaatcatctatactcagaaaatgagaaagactggatttgagctactaagacaggagaccaggcagagcaattaatgttaaattaacaaaatggctgagagtcaaacaaggggaacaagaatcaaaactaatgggaaagcagtctgattaagcaatgtctacacgtttccacagtcactgttttaaataaactggccttttaaagtgatttaaaagtctttatgttttagttggtggtggctaagtctttgagtcatctaagaagaatgtacagcatgactactttctggacctccattttctcatctttaaaacaagaattttaccagagtttttcaggatcacatcaaatcctatcatcctgattcactcatttgacttggaattataacctaacttgtatccactataaaagagggcgcttacaggtcccaagtcatagatcatgcctaaaagtctctgacgtggaaagtgaggaaaacttgtttatttctagtcacctgatgtctgaagagaaaaatgccatcccttgagacaatgaaggagcagacacaggtagtagggataaatttcctggttcttgagttactaggtacacctctctatctgcaaggctccaacacaagaaatgcttagaatccattagtaggaaactcaaagtgtaactgtcaacaatgcaattatatttatgacacttctctaaagaaaagagttcttttaatcatgaagcttgagtgcctttgataccttttaatttttcagcaacaatgctgcattcatgatctgaatagtggaccactgggggtggagatggtggacgcaatctttcttcttccattcttctacgatggcgctcctctctggctagcatacgctgtttacactcccactcatacaggtcatctcgagcctgtgcgaaatcaacgtggagtctgcctgtgtccttcttgtcagtactagagcccaggcgaatgcggtaacctaagtccacaggagggtgaaagggagaggagagagggagagaaggagagaagtagagggagagagagacagagacagagagagagagagacatgaaagactatacatacttttccaagttcagtgtttcagatgtcactgcagcagttccaagtgaccacacaactccaaattctctccccatgcttagcaagtaaatcatcaaaagatttagattatctctgataatagctcacattctatgggttgggttagtcttgttcttaagagttccattcctccatctaataccttacctctggctgaggttggctccgtgggtaatagtatcaagcatgatcgttatatggcaccaagggctgggaagaatggaaaaggtggcctcaaacgaacttgtctttaaataaattcaagagtgtccattatactatcacaaagattttggtaaaacttaaatgcattaacttggtattttaatccctaaaattgcttcctagaagcatttgtcaactgtgagccattttttttctaaaaaaaaaaaaagatggggagtgatgtgtgacccaggtgacatataatttgggatccttaaaaaaaaagatgtagtgtgattataatatagtagtataggactgggattcagaaaacctgattcaactccatacctcctctttctgtgccagctatacttacccaagtcatgtatcttaaaaaaagtggggaaaaaactaagtactttttcagtttcaagagctcagctagatacttccataggaatttatctcatttcattatcagcacaagcttgcagggtagaagggtagaacattataccaaacagaaaactgagcatcaaaagaggttagggaggttaagtggcttgccctgggtcagacaattagcaaacagtagagctggctcttgaatccaggacattagactctgtgctttcctttattctaacctgcctctcaagaataatacccaacatagacttttgcttctggctaagatagagtaacgggttagatttgtcctcctaccttaaacaactaaaaatatggataaaatatatgaaataatgctttttaaagaactgtacataagacaatgaagacagggatcactgagagacaagaaccaaatgaagtgatccctatgattgccccagtttatttcctaataagaaagtttcctaataagagagtttttgggcctcagcacagggaagggaactcagacagggcacgatggtgttcccaagttaaggagactgaactgggagtctaggaagactatggaaatagagttcataaggcagagtaccagaaagaagaaagctgcacagagaaagagcttcagagatatgcagagggtcctccactattatttagctgagtactaatgtctatatgtgtgggaaactacctgagcattagaggtaacaatccctgaaaagctcccacagggttgggaatagctccttttcctaccagccagagcagaaaaactcacacttctggtactgggtgatcagaagggttctgccttaatagtggagaaaaattagccctaaactcctctggtcttgctgaacaaagcttaagaagcaagacctaaaaggaccaaaattttcccaagttacttaactgcatttagaacaaaactcaagactatttatagaaataaaaatatgccaccaaataaggtaaactttaataaaaaaattacttggaatgcaacgatgcaggaaaatatgacccataataaagattttaaaaatcagccaatccaaacagacccagaagtgatgcagataatttaattagtagataaggatacaaaaacaatgatgaaaatttgatttcacatgctcaagaagctagagaaaagactggtcatactaaggagaaacatgaaagatataaaaagagccacaatcaaacatctacaggcttaagctacaatgtctaagttgaaaaaaacatcaacagacaggactgatggcaaattagatgctgcataagaaaaaaattaatgaaactgggggctcccagcacctgagccttctgcctgcacccacctgagaattctaatggtgactggggaccagcctgccctccctatcgcagccaccacctgaaccctgggggcctgagaataagcctgctggcccggtcctggtggagtccctccagggcccccgcacaccatccagtgggccacttaggggcctgggaattgaaggactgcttagctcagtccatcactgctggcgcctgaccacttggcctgaggcctgaggttgggcccaagcagccggcacccccacagttgcctcccactctcacatgctgaaaggcagagtccctccccgtctttacacagagctgtgtaaaagaataggtgagccacaaagctgtctgtactgggctgagggaagagcttcctccccaaagtcactcctttcagctacatggtagcctggagatagatggacagtgtgtaaactgagtcaggagccccaggagagggttgtgacagagaaacattgtgatcctgcctgtctaagaagtggagctgatgtggccccctcatcccctgaagagacctcggcacatttctccaagagttcccctagccactcctgtcaggggtgctgcctgtgctcatcattgggttattcgtgggtgagcttgtttgtccagctccacccagctttgtcctccatccactctccctgggctgaatagggaacctggaatttcacagaccagcccatcatctgaaagaacagagagcacctcacagtaagaaaacatccagtacataccgatctgcttctgccacaggtggctcttacctgtaggcgccacctactcaccaggaggttaaactgcacagcacaataggacacctgctgacagaagtgcacagggctaaagaagcaaagccaaaggaccctacccaacatacgctacagtcacatcttcggagttgggggacgtcccatccaaatgaaattagattcaaaaataagaagtgacagcttccccacgtgaaaaggaaccagtgtaagaactcggggtgttgcaacaccccgaaaagatcacactagctgtctagcaatggatcctaatgaaaatgaaaattctgaaacgacaaagaattcaaaatatggattgtaaggaagctcaatgagatccaagagaaagttgaaaactaacacaaagcaacgagaaaaacaatgcaggatatgaaagaagagatagagatcttgaaaaaaaaaaacagaacttagggaaattaaaaattcactgaaggagttagaaaatacagtcggaagctttaataacaggctataccaagcagaagaaagaatttcagagcttgaacactggtcttttgaactgaccctgtcagacaaaaataataaaaaaggaatttaaaacaatgaataaagcctttgagaaatttgggattctgtaaagcaaccacacctatgagtaataggcattcctgagtgagaagaataaaagtaaaaactttgaaaaacatatttgagggaataatccaggaaaatttgcctggtcttgcaagggatgtagacacccaggtacaagaagctcagagaacacctggaagatattttgcaagaagaatatcatcagggcatataggcatcagattatccaatgtgaaggaaaaaattctgaaagcagcaaaagagaagcatttcttttctcctgtctcactggattatatgaagattgggcttttggatgtgtgaatttagtaatactttaaaatgtaaatgcaggctattatcctaagtgaaataactcagaaacagaaaatcaaataccatgtgttctcacttataagtgggagctaaacaatgggtacacataaagatagataatagacactggggactccaaaagtgaagagtgtgggaggggaatgagggttgaaaattaactattggatataataatcactatttgggtgatgggtatactagaagcccaaagctcactattacacaatatactcatgtaacaaacttgcacaggtgcccccgcatctataatgaaaaaaatgaatgaaattgaagacctagcaatagaaactatctgtaataaaatacagaaagaaaaaagactgaaaaaaaaaaaaagaacagaatagcagtgagctgcgagacaacttcaaggggcctaatatatgcctaattggagcaccaaaagacaggggaagagaacagaaaaaaattaaataaggggagaaaatttttcacatttgatccaaactcacagatccaaaaagttcaatgaaccccaagcacgagaaacaagaagaaaattacatcaaagcatatcataattgaattgctcaaaaccagcaataaatatctttttttattattattatcatactttaagttttagggtacatgtgcacattgtgcaggttagtcacatatgtatacatgtgccatgctggtgcgctgcacccactaactcgtcatctagcattaggtatatctcctaatgctatccctcccccctcccccaaccccacaacagtccccagagtgtgatgttccccttcccgtgtccatgtgttctcattgttcaattcccacctatgagtgagaacatgcggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatatgtctttatagcagcatgatttatagtcctttgggtatatacccagtaatgggatggctgggtcaaatggtatttctagttctagatccctaaggaatcaccacactgacttccacatggttgaactagtttacagtcccaccaacagtgtaaaagtgttcctatttctccacatcctctccagcacctgttgtttcctgactttttaatgattgccattctaactggtgtgagatggtatctcattgtggttttgatttaaatatctcaaaagcatccatggacaaaagacacattatgtacagagaaacacagataaagataacatcacatttcttgttggatacaatgcaagcaagaaaatggtggaacaacatctgagagaggacaaacatctttcaaaaagaaaggtgaaacactttttcaaatcaacgttgaaagaattcatcaggaacagacctgctctacaaaaaatgttaaaggaaattcaagcatagggaaaatgacaccaagtggaaatatggatctatagaaaggaaggaagagcatacacaatgtgtgattccatttatgtaaagttctagaaaatgacactaatctgatagagaacagataaatggttgcctgaagggagagtggtgaggggtagaaggacaggattgcaaaaggggtgtaaaggaagcttttggggataacagacatattcattattttcattgttggtgatggtttcatacctgaatacatatatagaatattatataattgtatttttgaaatatgttaagatcattgtatgtcaattattatacctcactaaaattaaattattatagctaattaaagctgttacaaagaataatattacccagtaatgccaaaactgtcatacattctttttagaaaaaggaagaatgaatacatttcataagcaagcctttctagggctctttacagtttataatacacttgcacatccattcatcttatttgatcatctgagccatcagaaaaatggggctaccaatgattaccttgcctattctcccagaactgtggagaggatcaaatgagaggatgagatgaaagctctacataaacctcattaaagatgctacaatgctatggggtgggtgcactgtgcacagtgccagctcccaaaggtgctccaattccatcagaaaaaaaatgaagatctccacattttctagcccccttttgtaagggattttttttttgtttcttttaactgctttcttttacaaaatgagataacagccaccccattcaggagattgctagcacttgggcactttcagggggacagattcaaatttaaagggcaaaatttagttgttttcatatcactgatggaaatcccctttcttttggcagccctaagaatgtttctaggaggtggctgttaacagagagctgattttggtgatgtttagatggatgcttcctgaacagtatattgtcttttaagtacacctacgcagggttttttgagacctttatgttcttattaaaatagtctcgtggaatgctctgttattattaagtgctgccgaatttttggtaattagattctatagcacttaccaaatgtaaaaagagtattctccatctacacctcctcctttccttacccatgttaccagcctactttttcaaacctttgttaccttttccctggcctattacaacaggcttctaactgacctcctctcctcttttcacatctctcctctaatacagttttatatagagctgtcaaattaatcttgcggaaataattatcttccttgttcaaaaatttcttcaattccctattacctgaggagtaaagacccaactgttaagccttttggagtgtgctaataactgatattttgcctcctcctctcatgtctacttagtaaacaaaccactactcactgtttcctgaatgtttgccaaagcttaccacctttgtacttttgctcatgctgttttcatgccccattgtccacaagcaaatgttttccctttgtcaaagacttggtccaaaagctacctttcttgatgcccccagttaggagtcagaaatattctcgttctccctctcctaccttcctccctcacttcctcctccatggcacttataacttttaatctcttattagcagtgtgtgtatcatatcagtgtattgagtaatgcctggcactaaatacatttttctttaataaataagtgtatgactacatactaaccctaaattcattaaggggaagaactaggttttactcattttctactctgcatagcatctagcacaagagtttacagaaaaaagatgttcaataagtacctgttataccaatgaagatgctgtcatcatgaaatgtctagcacttagactcaattcttccaaaccattactgttaggcaaagaagtagttcaatgtggcagtattaagagctggggcctttaagaggtgattgggtcatgaagtctctgtcctcataaatggattaatccattcacagattaatggattaatgggttgtcatgagagtaggactagtggctttataagaggaagaaagacctgagctaactctctgcagagagcaagaaggcccttaccagatgtgccccctagaccttagacttccagcctccataactataaaaaataaattccttttctttataaattacccagttttgccaggcatgatggctcacacctgtaatcccagcactttgggaagccgaggtgggtggatcacctgaggtcaggagttcgagaccagcctggccaacaaggtgaaatcccatctctactaaaaatacaaaaattagccgggcgtggtggcaggcgcctgtaatcccacctactcgggaggctgaggcaggagaattgcttgaacccaggaggcggaggttgcggtgagccaaaatcacatcattgcactccagcctgggcgacaagagcaagactccatcttaaaaaaaaaaaaaaattacccagtttcagatattctgttataagcaacagaaaatggaccaagacacaccctaaatctgaatttttactataaacaggagattttatgcaaagtagttcttactatctccactccaaccactgtactatacaggccaccatcacttctgggttagactaatattacagctggttaacttagttcccagtcaccactcctgctcatacctctcagcccatcttctgctcagaagtaacatttgtaaaatgtaaatcagatcatgtcactgaattccttaaaatcctccagtggcttccagaataaaactcattgtcatagttgcctgcctttcagatttcatttccctccactccctctctcattttctatgctccagtcatactaactttctatcctctgcttgaacataccaagtccattttcatctcacggactttggcttggtgttccttattttggaacgctcttccccaagatgtttacatggcaatctctcttcacattattcaagtctcagttcaaatgtcagagaagacttcctttcctaacaactctgggtaccttaaccttttttatcttcctcggagcacttagtactgaaagtaacttatttatttgttttcatatatattatattttgccatttccagaatgtaaaatccttgatgacaggaagtctatctgcctcaccctttgctgcatccccagcaacctagcattctgcctagcagtcaataaatatttgacaaataactgacttccataactatttatgagtatctacttttgtgccaggttatgtgctagatgctggggattcaatgttaaataagacacagtccctgcccttaaggatttcacgttctggtgggggagatggatgtggaaagagacagttctagcatggtacagtaggtgtcatgttgggaggaagcaccaggtgctgtgaaagccctgaggaaggagtgcctaaagcagtgctgggcagagtggggagacaggtcagagatagctttccagaggagggtgtgcttgagctggagctttagggggtgtgtgtggtgggcagggtgactctagtcagaggaaaaggcataaaacaccatggcacattctgggaattcgagttcacttagtgtggttgggacatggtgtgtgagggaaggaaggactgggagatgactctaagaaggacagcccacagtcaaggcctttagatgccacatgtgaggagtctggatttatcccatagacaactgggagctactgaagagctttaaaggaagaagttgaatgggaacattcagtttccacctctgaaggcaagagcaggtaatactaagcccaaacttatctgctatagacacaaatagttctatctttaatatctgcgttgtgcctggtgggcacaatcctcacatctaaacacctaccagacagatacagggctttgtccaccatgtactcctcagcaaagcgaatgtggcagaagttcttcttgctcttgcgaatggcaatgatctctccacactgctcgaaaacttccacaatgatttgctctgtcccattttcaggcagaccacccacaaatactgttttgcatcctggtggtctttctcgggttgcaggaggtgggagatctaagttgtaagggcaaaaacatttgaaattaaaatgtttgcttgggacagacctcttcgaaatctaacatttccctgctatccctgtcaaacttttgtctaagagtgtcagaaggatgtggcctctgaggtgttcatctctgctccacagaaaactgactgagtgaacctgaaaatcattttattcaatcgtttgctgaccatgatatctggagcataaagacccaggcctatttgtctgtcccatccagagtcctttagttttgttcgttacttttgttgtgacaatccagctatgccaaatttttagtcatttttattaagaaattagtgggagaaaatcccactcagtttaaactgttattttcaagagttctcagaaccagggttcctgaggaaggatttgtttaattcagattgtagttactacattctctctgttaatgctttttgaaggaacagattcaggattaatttgacaatgatggggtacctacttacaacaatgcctacagctgtcagaatgatttggtttcacaaaatcagtcagagtacaaaccatcccttttatgttgtttttttcaatatcagtgagcctttcctcaaattccttgctggagaggtgaggtccagagtctgtcttgcagcatttacagggaaatatgaaagacagcagagaaaataagctcgtctgggaaatcattaactaaagtgagataaatttggccatagagaatcattaaaaacctacttaatgagatgattctccctctgcttcaaaaaaatatgcactcatcttaaacataaagcctgttctatctgccagctctttgttgctatttatatgtatcaaagcaatttccaagcaaactcctacagtttgtagcccaacaaaacaaagcatgatggtcatgggttttctagtgttggttttgtatccgcaaggatttattttgtgtaatccattcttttccattcagctcttaacaacaattctcctagctcaagatttggagagctcaacaaccagtgattatagctcacatgcaaaaataaatgagtcatgttcatagattaggccaaggcccccaacctgactcttatccaagttggcaagcagttgatttgggagcctccttgggtatcaggatctctagcttcctcactttgctactactctctgtcttgttggtgtggctaagaataatcagttactcataatactctctttccctgtatttggtcaaaaaaaggggtaaagggattcagggaacttacaaactttctgttaatttttacaagtctgtaatttcaagacctcactgtactggttttttgttccatatgaaaggattagagggaaagggaaaataacctagtgagcaggaatctgaaatgtcttagtcacaagcactgaagaggttgtagtttgggccaaaatagagaagatgaggtctagaattgtttgagacttatgcttttgagtttttaagaactggaagggattctagccatcacacttccagtgattcttaactctggtggcacatttgaatcaatttggaagttaaacaaataatgcctgggtcccaccccagtgggtctgatttatttaattagtctggggtgcagcctgtgcattcgtttttttttgtttttgttgctttttaagcttctcaggcagttgtaatgtgtagttaaggttgaaaactattgacttagtctaaatctctgatattacagaggaaaaagcttagtgaggttaaatgtctcattccaggtcaccacattagagagaaggaacatgaacttggagcaggtaaacctaaatgtaaatcttaacttcataactgactgtataaccttgggaaaattatataacccctgaaaacttcttccttcatctttaaaacagggatgctgttcccaccttacaagggttattgtaggataaccgataatatactgtctatattgcatgtggctcaatgcctagcacttggccggttcccaataaatagcagtcattgtagcgttattattatttactattatagaacccaggtttcttaattcccaatctgggactttctaaagtcctaccagaagtctggagtagagtggtagctaagacctgaacttctaaacttccagatcttagtgtcacacagatctttagacaaggctgggtttgagaaggaaccactcatatggatagagaaatctacagctatgaagatacatatggctttgaccatggaacacaacccccccccccaccgactatataaggtaaagaatttccaagagtatccatatagttagaaccatgttttaaaattagagactttagaatacaatcctgtttcagaatcaaaaaggcttcctaagtttactatttaggagaattaggtggcaaagaatccttttgtgaagttagtaatcacttttataccatttgagtttcctttagtctacctttaggtccactgagagactctaaaaagcatgtggttactgtggcagttacatgtaacactgaaaaggcaaaggctccatcccctggctacatttgtgggatttaaaaattctttggggggctgaggtgggcggatcacgaggtcaggagatggagaccatcttggctaacacggtgaaaccccgtctctactaaaaatacaaaaaattagctgggcatggtggcacgtgcctgtaatcccagctaattgggaggctgaggcagaagaatggcctgaacctgggaggcggagcttgcagtgagctaagatcttgccactgcactccagcctgggtgacagagcgagactccgtctcaaaaaaaaaaaaaaaaaaaaaaaaaaaaaaaaaaattctgtgatgaagtcatcaccctatttaggtgctgtgattcttctgtggtgactgttttctaagtaaaagggcataaaagccactaagagtaatgtcaagaatgctgaggatttatttattttccttgggtaaatgtagaaagcctctttaatagcatttgctgagatttaggggtatgccaccaagcagggcaatgggctatactatcttccttaatggatagtacccattccttaattaacagctcaaagcactttgtcgtctgggcctgattttctaatcccactgaaatacagtgatcagggcacagcaatgataacccataggagagcaaattcaaagcccacctattaatcaggtaatgtgctaagctctatagcaccccaatcaccactcaggatggagacaaagaaaagttccatgtacaaagattcaagataactgggaataaaaagaactctaatctctggtaatggaaaaggaggagcttttagcaattctaattatacccaagcatctactctggggagctatgttggggcaatctgagtcattgctgatctttgagaagtgaggcaggaagcagtatagagaaccgataagccacttgaatcttgcttttcaaaggagcatcacagatcactcagctggtttgccaggatttatatactgcaaagtctttaagtcgattttattagacagctcaagattgaaggtcccctggacaatcagcaggggttaaatgtatcttaatgtaatcccaactgattggaaaaattagaaggctggggaattttaattaatgctcaatttctctaactctctttatagcattcagccctgagagtcttcccattttgatatggtaaaatgaaaacattgttcttgctctttttctggctcctgggtattttcccatgttcctggagacggatagcagatgatattccattacttattccctgttcactgttatttcccagtagactcaaaatgtaacctctccatagaaggtctaatcgctgaagtgaaaaatcttggcaaaatcaaattttctggagagaatcgtattacccttttttttcaccactaagaactgctaattgggaattcagtaaatctctgatagacactctgtgaaaaaaaaaaaaaagtgtgttccagggcacttatttttttcttgttatatctcagtttcctggaaatcagagaatgttgcttctgcaacaatggggtactcactcaccatttatctttaggagactggtacttggtctgctccagtctagtttgatccattgactttttagaccaggtctgattttgcctagtctacaacagagaagttaagatccttatcagagatcttatggctatttagtggtggagagctgggatatgaaaccaggctggcctgtgtcacttctgagcttgaaaacttacccattatgctatagtgcctgctccagagaaggtacaaagctctacatgctacctgccaaccagcccttgcttttcctaatgcattttaaagggcttttgcctatgtaaataattattgtggtagctacatttttaatgtagagaatcataactttagagctggatgaagcattagaggtatctaggctaatctaacacaatatttttgctttacacacaaggaggttgagaccaaggaggttatatgactatccccagatcccacagctagttagtgacagacttgggaatagaacacagttgtcttgatttataaactggtagtctgtcctctatactataataccattttttgtacatttgatgtagacacacccagaatagtctagtaggcagttggctacatgtatctgaagcttagaagagatatagactaaaaatatagatttggaagtcattagcatgtagtagtaattacctcatactctcttgctttgctttctagacctctgacccctccttctgtcatcatccatccaatcctccctcccaccatcattcaacaaatatttattgaacacctactatatgtaagacacttttctaagtgctggtgatacatcaggagacaaaaaagacaaaaattctgccttcgtggggtttatattctacaaattatatagttggttaaaaggtaataactccagtatgggcaacatggcaaaatcctgtctttaaaaacaatacaaaaattagttgggcatgatggggcatgcctgcagtcccagctactcgagaggctgaggcaggaggatcacttgagcctaggaggtggaggctgcagtgagccaagatcacaccactgcactctggcctgggcaacagagggagaccctgtctcaaaaaaaagaaacatgttttataaaaaatagagaaggtaaataggattgggactgtggcagagagataatttttaaataggttatcagggtcactgagaaagtgacatttgagcaaagacttgaaagaagtgagagagttagccacgcagatatttagaggggaagtgttctagctaggtggaagagctagcgcaaaggccctatgatgggagagtggctggtgtgttcatggaacagcatgaaggtcagtgtgaccggaacagaggaagagatggggaggagagtaggagatgaagtcaaagagacaatggaggggaggaacagatcatatctgaccttctaggcaattaaaaggactttagtctctattgtgagtgaaatggggagccattcaagggttctgagtagaggaattacatgatcagacttaggttttaaaaggatcactctgtctgttctgttcagaatagactgtagggggcaagggtgaagaaggaagactaattagaaggctattacaataatttagaaaatgaatcatggcagatacaaactaaatcatagcagtggttattgtgaatatggaaggattacagacatatgttgttaggtagactgacataattttctcacagattaaacgcactgtgtgagggaaagaaatccattagatttggcattcactatttaagtgaaaatgccttagagtgattcactacagttttagttccgataccttccatgtggaagtgaaccagaaaggggtatgcttgaagttgggctggaggagagtgtgaggagtatgaggtcaggaagtagttgaacctgactaaatggcaggtatgtggcaagtagaagtgatggattgaagacagtcatatgaagcagacaagtaaaaggtttttgaggtcaggagttggactatgaatctgtgggcagtgggagccacaggacaattttatggttctatatatgtgacaagcacttggatgaaatgtcaggtgggacacaggggagggaatggatggcaaagatactttctaataaagcaacaagaattagaagcagaccgtatgagtccctgaatcacaggaccttattgctgagaggaatttcagaggccattgagtgtaagagaatataccagaggcaggcaggagtaaggagtggggtttataattgatatggttcggccctgtgttcctgcccaattctcatgtagaattgtaataccccatgttagaggtggggcctgatgggaggtgattggatcagggggtggatttctcatgaatgatttagcaccatccttttggtgctgctcttgtgatagtgagtgagttaccgtgagatatggttgtttaaaagtcaggagcacctcatccccactctcttgttcctgctcctgccacacgagacacctcgctccatctttgccttctgccatgattggaagcttcctgaggcctccccagaagcagaagccactatgcttcctgtacagcctgcagaaccataagccaattcaacctcttttctttaaaaatgacccagcctcaggtgtttctttatagcaatgtgagaacagactaatacaataatcaaggcctgatcaggcagggttggtgggctgagatgataaagggttcagtcacaccaaatccctgttcttcctttcctaccctgctcttcccatctcaccttcacaaagcaatgtcttggggccaccaacaacaatgtcacttttgccatgctttcagcagagaactaagagaagcacttctattagtgttttctccacccaagtaatccaagcccactttgaacaaaactcaagttctaaaaagcaaacagaacaccagtttactttaagctgtgtcaagagttttatgtttgaattcaattccaaggccaggttccttcccagaagccaccaatttactggtgctagttgccccgtaagcattctcaatacaaggatgaagaactaaaagacggagccatgggggagatatgctgccctctcactctgtgagaggttcttccaactcagaactgtagaggcatggctgcaggtggggaaatataaaaatgtatttgagagatgtcagtccgtttcttttactagaggctatcaaaagttagagccttcttaagctatatatttctagattcatttgaagactgctcaacaatatggtctatgtgtcataaacaaggcatctgtactttagaaatttagaaactgaacatcctgtaaagtaaactactgcaaccaacctggacattacaggttgtgagccatcctgttagcttagatatatttgagacaatgaaagcctgctgcaggctgattatgcgataaatgaatgattaatcagcaggattctaccctttcataagcaggaggttttaacactggcagtgcctaagttcatggctttttgtgtagaaaaggtactatcaggaatacaactttctctaatctgaaagcaacatgctgaaaggtaaaaaaggccattgcccacttgtagggacagtggaactaagagtaagagacagataaaatggtgctgctcattcacttaggcactaaacacaaatccaggaatggccatttgagctggcaagtaaggcctgcaagggccatcttattctccattccctaattctccttgtgacatactagctcttctctcaatacagtcctctgagatgctggcctcctagatttcttattggtctggaaggatgtatcttgttgacaaccacgttcaaaaaccagaagaaagcataaagatctgttttttttttctagcaaaagaggccaagatgatctatccaaccaacctgattgattataaaatcctctcagttatgagcagaccatactaagtaaaatctgggtccctgccagggcttgggccatgattaactgattcctattaaaggtaggagatgaaatatttgtctgaagtcacatgtcaaagattcatatttatcctgataaggcaaggtcatttgatctatgccctaaaccactgaatgtatctcttaacaaacagctctaatctttgtactgcagtggtggttcccttggtatgccacccagtatgactagaactatggaaaaatcattaatgaggcttggggcacatgcagaatcagcttctaatcactgaatgtatataaaaccccaagtgcatctggaaaaaaagttttagtcaattattattagtgggacattttaagtaaaatagggccaccctatctttacacatgttttaaagtgaatctaaggagaagcctcctcattactgacaaaatggatctctagattacttccacatgaactgcattgactggtggctatgagtagtgtgacttagtctcaatattcctctttgcccttccaatatgttgagccatgcctcactgtatattacaacccatcggttgaatagcagtggttcgagtgatgtatgaatagttgctagcagtggaagattcttagcaccaaatgtatattctcatgtgcttcagaccacactctgtctctgccaccatcagcacatgcggcagttacgaaaagaaaagactgcagatgatggtgttgagcaatctgtatgcttccttctttactaacacacttgaattccttaccagatggcattagaaacatgtatcatttgtactgcaacctgcacacaaaagtctactgttgtgtgcataaaattcaaccctgcctagcaagagaaaattttcctgtcttctgttctctaggtgaagctttcgtacaaacatctatgaagcccttgggtattcttttgagaaagaagaaagctttcttgtacactaaaatattgtgtcttgtgtggagaaaaaagcagaatattacttggatttggagggaagagcgtgcagcttttacagtgtatgatctcttttactactggcatatctggaggaattggtggaggtactattcccaaaccaggcatcattggagttattggtggaattccagtcatcattccaagagcaggatcaaagtctaaaaaaggagaagagagaacaataaatgacaccaggcaaagttaagtggagatagaatgttactttgtaagcttcaaatcaaaggcctttctaagacagaggcaaaatatttaacaagcatggtacttagtattcccaggtcttaaatattatcttatagttgtgcattttcctttcaggatggggctgtttggtttgaccagggcttatttaagtctctgcatctcattgtggcatccaaggtctttcataggatggccatgccttgtctattgatcttgcctctcctagtttccaacacacactctctgctccattccgagaaggctttttactgtcccttgtacatgttttctttgtacggtacagcatgatattaagagcacagagttttggggatcaagcagacctgggttttaggtctaccatttgcttagcaggatgaacttccatttcctcatctgcaaaatagggttaatatcacctacgctacaggaagctgtgaggagtaaacaaaatgatgaatctaatatgctgagcataggtttgataaataactattctctgtgcctttgttcatgtttttctttctgcctggaattatttgggcctccgcaaattctccccatgcttcaaggcctggcttaagtgtcaccttccttgaagaggcttttccagataattctggttcattcttgactttgcctctaaaagctataggttctatacctgttaccactgattttttttttattttgcattattctttgtttaattcagggatgcctctagcatgtgtgggggcacccaaacaagtattttttgtggggcctatctacgtacatggtttgtttcactgcgaatcagtactggcagcattttcgtggcacaatctcacgcgataccatgaaagaaataccacaccagccagctggagtggtttccttgccaggccactctcctggaaccaagactttggggaggattccatgagtcctgaagcttcttggggcatctagttcactgcacatacaggttagaggattggatagtatcgcaaaggggagaaatggggactcaggtacacatgtgtcctgtttaagattggggcttctcagatgataatgccagtcacagtcagtcccagacactggaggggaacttagaaaatttcaagaaaggtacttcttacaaccagaatacaaggaggagctgctctggacccaggacagctgccctgatgatactgcctgcctggccagtgcttggctctggaaggggacttagaaattatccaggtaggcattccaaagcacaggggtccctgaggaggagccccacttgcctggatctaaggctggtattgatttcattgtttaaatcttgcctctaggtcaaaatggaatttctgtgagagaagggagtgcactttacttctttgtttctctgcctcccacttctgccttcgctatagaacctgcagactgcaaagaaagaaagtggactgcaaagaaagaaagtactgcagcctgaggggttctggtaatgcagaggcagttgcagcagcagtagcaggacttactcccaaagacttcaccatgttcaccacacaggccagaagagcaatgcctgtacacatgtccttaaagtggccctgaagtcccctgggtggctctttgtctctaagatgctggatgaggtcaacctaaatggcaggaaaaacccaggattcccacagaagcagaacctcaggtctgacaggcacaataagagggagatctggagctgggcaggcagatggcacatggacatcccctgttacaaaggcagcccaagcaagctagggcactacccagcctctcacatgcctttttatcctgtgatgtcaagaccctgaaaatgtttgggaagaaaaaaattctcccaagaggaagttttatttttatgaaaatatttacttttagccctcaaatgtcatctcactcaacttgcatgtacacacacacacacacacacatacacacacgtactctccccttccctccctcccacccatggctctcatatctatactctactctcctccatatagtagttatgtgatgttgaagaaagtttcttaatatctgtgtgcctccatttcctttttggtaaaagtggggggttaatatctgtatgcctctatttcctttttggtaaaagtgggggtaaataatggcatttagctcaaaggacgaaagcacagaacagatatgaagacctctggcgtgagagatagtactgataggtaagtttccttccttccatttaaaatgtgaaaactcacactgataaattcactaattgaggcattcattcacacattcacaaacatctgtgataggcttcctatatgtcaggctctatgcaagtgttgggggtggtgtctaggtttcccgtttgatcttagagaacttaaggcttccgataccctgtcttcctatgctgtaaaataagagcactatggttaagaatgccatttatgtcttcggaaaatttgatttctcatgcagaagattttggagaaattattaacattatcttacccatttacaaactgttatttttcgttaggaaaagatcagattagattgtgtgccaacaaaacaatcccatctatttttcctcttctactgaaatgtttgtcttccttctattgttctgcctgcctccttgttattcgtatagctctgtcactcacaactctaccttaccacagattacagaaacatcagctcattaaacaagttctgccactttggctgagaaggaaatgtctgtctccatttactgtctactaataaatggagacaaacaaaaaacaaatatacaggataaatataactcctgactgatgtacttaccactctgctgtttcgtataattacattaatattttataaattcatttaaaagcaaacgtattcattgcatatggctaaagccagagtagataaactccccctcttccttttgttcaatatgccaggagttccataggctacactgcccataagggcttcctagagggcaggttgtacatgacatttcaaaggcttctatcacgttgattatttcttttgtttatctttaaccattaagcaccaaagtgaatgtggatttccaatgtcaaccaagaaaaccatttgaagtcatgggctttatacatatattgcagaacctgaaaaatcaaagaattccagcaatttaaaacacactgggaatagaacaccagaggaattatctcccttttccaggcccctggcctggcttgtggagtactaccaagtatgtaccattgccacttatattaggaattcaaagtttcaaagatttgaaatcatataaaagagttatggaaaaggccaagatactcctccaaagtccttttcgcaataaatatcctgttctattttgcttttatcgtctcttctaacaccatttccccactgccttcttgactcttggcatggccattgctgaaagagccatgacatgttgatttgtattatctctctctgttttttttttttttttttgagacggagtcccgctctgttgcccaggctggagtggagtggtgcgatctcagctcattgcaacctccgcctcccgggttcaagcaattctcctgcctcagcctccctagtagctgggattacaggcatgcgctaccatacccggctatttttttttttttttgtatttttactagagaagcggtttcaccatgttggtcaggctggtctcaaacttctgacctcaagtgatccacttgccttggcctcccaaagtgtggggattacagcatgagccaccaggcccagcccgtattccctcttctgattcatgtacttcccaaagtcccagcccactggaaattctgcaaatgctgtctgttagctggggccagcttgctcctcagacttgcaactctaccatgtgatttcaagtaatgtttccatgtagctttgagccttcctgatacctagcaacttgcacttactcaaccttggcagagtgattattgtccattctctgtacacatctgagccaaggaattacaatggaggcaaatgtcatttctgtgcagctacccagttatccctatatctattcattcaatattttgatgacaggtcctatgtcaggtgttggggctgcagaaatgaataagacaaaaatccttggccttatactctagtttggaaacaaccacgcaaacagttacaatgctgtaccatcagtgaaccaccataactgtttattaagtgcttaaaatgttttaggttcagtgctaagcattttatataatcacattctaatagacctgtgagcttggatattgttatccttcattttatggataaagaagttgaggttcaaggggggtttagttacgtgctcaagtttatacagccagtaagaggcagacctagaattcaaatccaacttggtctaattctaatgcccttaaccactacactgcctctcaatgtagtatgacaatggtttcaatgaattaatatgattgcagatataaagtgaagcaaatatgttggaaaaaataaggcatatgagcaacaaaatgtttacatacaattcttcttcccccaatatggtggattaaagttggatataaattctttgattctccttccatcaaggtaagggtctatgcccctatccctttgaatctggatgggctctagaactgctttaaccaacagaatatggcagaagggatactgtgccctttttcaggcccaggcattaagagagatgcaatttctaccttttgtctctagaaatgtgtgatacaggagcttttcatcctcatggaaggctgactaccctgctagagagaccatgtggagagagacttagagcaaatgacagaagatggatccagctgagcccagtcttgtatctgtccttaccaaggtgccatgcatatgagtgaagtcttgaaatcagcctgccacaactgaggtatcccagttgatatcatatagaacagaaaaattgcccatctcagtcctacccaaattcctcaaccagaaaaatcttaaaatataataaaatgattgtgttttaagtcactaacttctaaggtagtttgttatatagcaatagataaggagaatatccagcatggctgcagtggaatgtgattggttaatagagttaacaattttcaaggaatgaaaatagaaagtacactaaacagccaaactagactgaccatgatttttctcagatttttgaaaaggcgctttgggatcctgcagggcacagagccactgtcttgggcaactgatgccactacactgttgctatatggaaggaccattgttcagttggaacaatgtcagatgactgacgttctactaggtgtactaagataacagttgtctaccaaaccgtagaaacctcagaggtgttctacatctgatgtctgacaaagacatcacacgtgcctattttatggttcagtcctaatagtttttggcaggcccgttcatgctggcttttcttttctttttttttttttttttttgagatggagtctcgctcttatcatccaagctggagggcaatggcatgatctcagctcactgcaacctctgcctcccgggttcaagcgattctcctgcctcagcctccctagtagctgggattacaagcacgcgccaatatgcccagctaatttttgtatttttagtagagatggggttttaccatgttggccaggctggtctcgaactcctgatctcaggctatcttcttgctgtaaaatgccaacttttacctttgtggtaggggagaggaatactagccactcattaattggctacttatgaatttccaggttttatacactgcatctgacttaatcttcacaacaatcctaagggatgggaaataatattccctattttacagatgaggaaactgaagctgaaagagataacacagtaaggatacacagtaagtagctcttactaaacgtgctcctaaccattagtctacactgcttcccacaaagtccacagtttcatagagaaagacagatgccctttgtcagatcagtatctacctactcaaccttgtacgtggccttcaaaccttcctatccaggaggctatcctggggttgcttatctctaaacccagaagttcctattgagatatttcacacatgcattgtcacagtgttttggggcctctttttaaaattcattgttgcaattttgtgccacaaaagaagttgaaattgtggccatgtatcaattggaggcaggcaaaggtaggaagtgacacacattgactatcttgcttacaattttcagaactggaccctggttcttactggaagcccctttacactctcagaaaggctttgcctgcacttaacgacttatccccatccaagctcccctggcccaataaaagcatttccaatcttttaggtgttccagagacccctgagccccaggaggtagtttttactcacagtaaaaccactgaaatgcaaccacagattattccaaaataactatttcaaataggatctaattatatatgcataattaagctattttatagaaagttatgatttcaattgagctacatatttctgagacattattgttatttctttacagttcctacaaaattcattggaaaattaagaattatgcctgtgtactgggaaattttaacccattacagtcctgcctcctttctacatagtttctttaaaagactttttaggcagtctttgtcagattaatatctacctactcaaccttatatctctcttctaatctgaagagagaacacagatttccaaggacagcctggctgagctgtaagatgattctggacttctcaccagccctcttggaggcacaagttcccaaatttttttacaatgactctcaaattctacctacatctgtcccgtttccccaaaagatcatctaaacacttgtttcagctcagctggaaaggtgagacagggcctggctcatgtacaacagcaaacaatctggcaaactgggattggtgggttatgtggcacaatttcagttcacaaaggtcctcccaaacatatctcaactttgatcccaaatttccaccagtggagctttattcctttagtgcaaagttttgcaaaatctccctctgtagcccatcttccctcaactcctttttattcatttacactgtgttcttgcctttttagaacatttgacaggtccagagtcatgccctccaaaggtattcacctttggaggggcattagtgaggacatttcccactacatctgtggttcccagatttctggattttggaaatgaataaaattatacccatatttaaggtcaccagcctcttaatttgacaagaaaataagtggggaaaaaataaaaagaaactaaaagaagattttaaaataaaaaatataggaagtctatcacctcagaataaagggcagtcctttcaattgagcaaatttagcttcatgacaaatttactgcatttttagtttttacattttgccataaacgggtcctggcctacacaccagtgtttgggcttttgagatcactcaaccatttcacttagtgtgctcccctatatatgaaacttcctgtgaaaaatttctttcagaactagaatgtcacacacacacacacattattaagggccattaaaagcttcacttcccctgaggactggtatattttttcttcatggaaaatgcaaattatataactgatcaggtttcccttttttgttttggctgctttgtcacaggggcagctcaacttcagaaatcaggtgggaatcctatgacctacacacctgaattttaattaacttccctacctggtctttgtcttctattctcatttatattttcccagatgctgatttattttatttttttataaattattgtattttttcatatactgtaatctttcttataagctgcctcaaagtctttgctgaatgaggtgatgtaactcaatagttaaccactgtctccatactgtatacccttgcataccttccaatcattgatgcactgtttcctctgcctacactgttcttagttctttcatcctcctgacatactcctatatatacctggacacctagctcaaacattacctcttttgtgaaccttctctgaccactgccatctacctagcatttcccctcaccacacctgggctaaaacaatacttatgtacaagtttctattatgacacttgcaacatgatagtgtagtggtatttactttgttgcttctgccactgcaacttgagcttgaaggcaaggattgtgccatgcccatattggaatcccctatatctagctcaatagattttcaatgaatggatggataaataacagaacaaatgaacaaaatgaaaggaaggcctttgagctgttgtcagtgaacagccagctcatattcgagaacatgttggattagggagagaatgggaaagttctaaaagtattggagtcactatgagggtaggaaactttgtctttcttgttcattgctctgtccgcggggcttctcacagtaccttcataccggcaggcttcagtgaatatttcttgtatgaatgaatgaataagcaaatagtttgactcagttctttctcctaatagtttccatggggagtcttttccttttctttttaaatgatttttcctatcactgtgcatttacttattccagctagttaacgtcatgaaattcttatctcaaagatcctctagcccttgagcttcatgtactcttccaaaggctttaaatagtttaaaatgtttccaagagaaaacagctccacagcatttacctacacagactgtgatgtcgagcgcctcactatctgtatttcttggtgtcttccttgggagataggacctcgttctttgtggggacctcaatacacagtctctattatgttgaccagctcctgtttgtccttctgtggcccagttaatcttgttgttgccagtaatcaagtcaaaatcatgatgtgcttgttcccaaataaaaatatgacaatacatagatcatataaactcatacatttttgttgaagtaaagtacttctgtaatatcaagataaataactacaacatttttaaccttttcagctatacaatacagaactcatgcatattcataaaagtagggtcccaattatgtccaaaccaaatgatgacgcctcggtctttttttttttaaaggatgacctgacacaacagctaactgccagctgttgtgttagtacaggagcgtggtggcatggaggagacttaaatgagtatctccaggtgtagatatgttccatggtgaatcttgagagtaccatcagtaggtagaattcaggtttgttttgaagagacattaattttatctggtatatataatgtttacgtattattggctcttggtaaaatatataccatgatgatgaacagtgctctcctttctcaggattgcaacttttttgccactaaaagcatactctatttgtggcagatattaaaaataatacaaaccgaagtccaggccttcctgaggagcttgcagaacagtggtctgtcatgtatcatacaaactccttctttctttctgttcccatcagagttggtctgttggatccagtgagaactgcctccttaagaatgagcagggctttgctctggaaataaggtccatgagtccatattttccaatatctttcattatggagcagacacagtcaatacagtggggacatcataatgagggactcttctctttttggacttcacaggctccacacttggctgctaaggatattttaattgaggggaaaataaaggaagcagcaggtagtattcagcaagtatcccttaatgggtccatccttggattcatctggaatgactggggcagaacaatgttctttaaccagagggcctgactctattgggttccactaacattagtcttatttgaccagcttctcaaagcaaatactcttgcaggaaagacagctgccagccagaggggacctcctgatctgccatcattatggattaactttattgaaccacagctgtacaaaacaccatgttagttgaaagggaactccacaccaaacctcagagatagcctgtttctactccctactcaatgaatataataattatgccagacattgccttcatgacaagtgtgtgtccaagagactcagcatccatgacagtatagattagaggtctctgggggaagtgaaggaagcttacattattgttagtttttcatcaatgtcaaaagacttttctattgtcacagacaggccagatgagacaggacaaagaaaagtcttctggctcagtaggaaacctcctgagaagcataaaagtagctgaattactgagcctttgatgggtgacttcaggcaacagctccatgaggcttatttgctgccttttccattttaagaaatcttgaggcatggggtgctgatcagggagatgttttaacccattgtaaagatggcaggcactctgttctccagaccttggcaagaagaaaggtagggagcattggagtgtcgtgccaaccttccatttctgtgaaaatctccaccagatttataaggaacaggcatcagcactgtcagacatatactgttctcttcacctgttgctgtccagtatttcaccaggcaaaaatttcacgcttgcatttgctgtccttcactattgttaaaggtaaagatgagtcataattcaactttttgtgagccacatcgcacatgtgaacttgaaacactaataacaatagctgagttaattgaggaattactgtgagccaggcatcattctaaggctttacatgtattaacacatgaatcctcataacaaccctacaacataggtgccgttattatctgcattttacagatgaagaaactgaggcatagagaagtgaagtaacttgtcaacggtcacacaactagttaatgacagagatttgaacataggcattctggatctagaacccaagttcaaatgtcaatggtaaactgccttcctaaaataatacagagatgagaaaaaaccagttcacacataacttaagtgattttatacatagctttacaaagtatatctcagcctgatgttattgccccatgcactttaagacaagaagggaactatttaactaataccagcatttccatgaccaggtttctaaagagtcaattaactttccctggagcatggtggcagcagaatcactgaattacatacaggtcaaagagaaaccatttctttacagtcgttaagaaaacaagatgtggagaagggggccaatggtagaaattaaaaatactcttgaggtttcaaacgtctggttgaagctggatgtgcagaacgctcattagcatattagcattgacagtggctccatagcatccaaatactttcaatttaagtgggagcttagcagcaatttgaagaatgtatgttagtacttcctctacatcaaagagcatatagtactgctaagagtagtaataatgatgacagtttatctttattgggtgcttattatatggtaagcagtgtgctaagtatattatttaatgtccacagtaatcctgtgagctaggacactatcattatctccattttacagatgagaaaactgaggaacagagaggtcaagtaacttgcttaagggtaacacagtaagtggcagagcaaggactcaaacccatgtaatcccctgacttcaaggcttgtgttgttaagcactaagcaagatactgttatgaggattcaagccctccaccacactgtttagaaaacttaccccaatcttctagccttattattgaccccagctcaagctttgggtctgtaatgattgcttggtggcatttttgttctcaatgctaggcctttcttttccatgttatagatggatggctaagtattgaatattactttgtgagcatagatttatgcttatatacgataacttacaaatcatatgatatcagttaacatttagtcccctggaacacagcgcagatgtggcctcaatatttttcctgggacttttacacatatggtccagactgtcataaactggaaatatttaagtcaaattagattgtctagtcatcttagactataagtgttgtgactcagggacactccacaatatatatttcagtttaaaacaatataaaacaatatatatttcatataaatatataaaacaatatatatttcagtttaaattctattataatcaaataataaagaggtactaaataaaaaactcgttacttccttagaaatgtctatgagaaatacattagtaatgatttttgaagtattttaatagctgccatttttgagtaccttctatgtaccagacattgtgctaagtatgatttaattgtcataacaatcctaggagttaggtactattagtctgactttgtagatgaggacactgggtctcagaagatacacaactgctcgagatccaatagtgaaagaaacaggcttggaagccaagcagactgaatccagaacctgacctcttaaccactctgcaatactggctcctacagtaacattcactgatcccagattggccctaccagtcattcaaaacttaaggagatccatggtccaatcacggtagctctcaaaggatgtttggttgttcatttcaattgttgttgttctaatggagaagaatacagtccagtgaactacaacctatggtatgaattatagtagtttggcagagttctttgcacctgccatatatagaatttagactccttttttttctccacccatttcttattcacatacctttttttcttcatgtttggttgcttttatgcttgtttcttggcttttgatgtaataacatttcttaattcattattagtattgctgtctagtggacctcaccctcattataacttataaggatttaaaacctaggctggaattgtgaaataatatttttgggggtgtagctaactatataaataaatggcaagacaaaatggcattactctaaatctgtttctcaaatttagtgtgcctgcgaagcacctggggaccttgcgaaaatgcagcttctgattcagtaggtctgtgctggggcctgagattctgggattctaagtggttcccaggttatgcagggcacactttgagtagcaaggttctagattggcctggtcctgttgtgcttttaagtaaagtcacaattaattgaatctggggagattaatgtttaggctgtttaaaaagctgcctcaggctccctgagatggcaattctcaaatgtcttcaaaaatttattgtaataattaattagctctcactgtccaggaagcttttttgtgtctaaacaaaaccctccaggtgctgtgatgttctgcttctcattttatcttcagcggagatggagttagtccaccatgtcaattctattatgggttactttgtttatgtatatatgtatgtgtgtgtgtatttacacacagttcttcaatgttaaaaagagtctttgggctgtcctccaccgtctcctttcctctcctctaggaatcttaagatcttggagatatctaagtcagttctcttcctgtctccatgtttatttgcctcctctatgaaatctataaaattacacacgctttgtaattccttgccaaaatcctgttgccttgtatttcaaagagctgtttaaagcttcaatgaccctagcctgcattggatatacacccagcatgtccaaagtgcaaaacggagtatactagtaactactggccacccagactataaagctcatattacaaaaatgcacactctaggcagaatctggtaaatgtcaacttcaaaataagttgtgtcatactgctatatttataaccacatggtcaataaaaataagcacttgcgaggtgattaaaaataacataccaggtaaaattggttgtccggcaattcccagcggtgccattccaagattattcattgctgtggcccatgcagttggatcagacataggtagtgtcattgcagtggaatccacgttcagagttctactgttatcggctgaaaagaaatgacaagcaaaataatttgttgtgttaaggttctagcaactagtttacttataaacataaattctggcaaactgtttatagaaatggctggagaaatggacaagtggtggataaggcctcaatgccagctttcttataagggttaaaacaacacagcttgaactggcaggaagtcatggaatttgaaagtaatttaccagatggcattttagtataagtgtttccttccttctctccctttcttccttctctctctctctctctctctctcttttttcaagcatacacaacagaggagcttggaatgattaagaagttttctattcttctcacagtctactagcatatgattacttcagcagcttccatccaaactacttatgcatgtaaagcaagaaaaaacatcctagggcttctgtagttggcaataaaagatgaaaattatactcctgatgtaatttcatatctttgaagcagtactattgaatagagctggacacacaatcagcagacatcaaattagctgaatgacaattttgggggttaggggaacaatgagaaaaagcagactagagacacagtccctgccctcaaaggttgtacaataaaattgaagagactgatgatgatggtgataattattaccattatcactgttatcaccacctccacccactactacctctgttgaacacttactgtatgccaggtaaatcacttggcatgcatcattctcatttaactttcagaacagccctatgaggtagggactatttatatctccatttaatagaagttttagagacatttaagagaagtttcgaaaggtcaaatatattgtccaaggtcatacagaatgtataatttttagccactatgctttactatctccagttaaacaactaggaaacaatgaaagactcaaatggtatagatcagaaatgttactgtagtttatggtatgcagagctactgtggcctgagtaagcaggaaatacttcatggagaaaataggacttgaaagaatggaccagatttatatagagcatgtcatgagtgatgagcagttattagataggtaaagtagaggggccagacatcccaggagcaggaatgatataagcaaaaacattgaaacgggttttataagcacgtacatgtacacagtgttgggagagatatagtcatgagtcatctgagcacaaacagactttcgttttgggaaattttcctctgactactgatagccatagaaaaatctttctatggcttttttcctacctcccagtacacacttctgccaattacaacccatgaaggcaactctgttctaatagtagcttgctaaagtccaaggcaacatcagggctgactcttgccagggttatgtatacatgtgctattttggtcactgattggtcagaacaagcaaatgtaaatgtctaaaaacattatttctgaaatattagtttttgtcatttttctgtgctgcctttgcctcttcccccttaatccctccttcacacacacacagtgattgatggcactaagtgttcattaattacagtcagaagtcacatttcagagtgattactcctacagagtgatttctccatctgtaggaactttagtagttatatccagctttcagtgttctctcacaaaggcatatccaaaggctagaaatagcctccttgcaaatattatcaagaaaacaaatatgggatgctgaatatcctttgggttgagagtttacatagtgataattagtctacttggacttccaagcccccagctaggggaggtaagtttttagagaatgttacagctgaaagatacctttagagattattgagtctacactctgattttctctggttgctggagaatcagtcccagaagaaactggtaggtttagaaggactgggacccaatgccaaaaataatttcttacaacagtttggctactcattggttctgcagtcatgagaaatattaaaacaaacaaacaaacaaacaggaacacttctcagtaaaggattttgaggtcaaagaatgagaatttataatatattaacctagccaaactctggactaattaggggcgggataagtgtttgggggaagacaatgatctcaattacaattttgaaggaaaacacagtattgttattttcaaaatgtatagtaattcacaatgcttgttaacatgttagtaagtagagttcctggtatgcttgtttacaggaacagataaggaacatgtgtgattaacaacattatttcatctcaatgaaagtggttcttaaattcttaggaagttttgctttaaatgtccttcttatctcccttccctcccctaacacccatctccacctgtcaaaatcccactcatttttgaagggtcacctcaaatgctaccttgtttatgaaactgaaatggccaggtgggaagggctccctggcagagcctcccactgacctgcaccctggggtggagccttggaagttcatgtgtttgcagtgggaaggagcctggcccctcctcttcctgggtggaacctgggattcaatctatgaggcgggaagcacaccagcaggactctggccttgcagagggtccccgtttcccttttttacccctttttctccaatacattccatttttctcacccttcaaagtgtctgcaagcctaatctctcatggccgtgtgacaagaacctggttctttgctgaactaaggaaaaagtcctataacaaaaccacctcattggaattaattacttcttctgatgtgttctcataacattttatctagaatttgattttcacatgtttgctcattctctcactcattccttgcaaactaaacttttttgagtcttactatatgccatgctgttttgctagtaactacgaacacagagatgaacaaaactcatttactgctctggaagaattcaaaaacaataaacaatccaatgtaaattattataataagtactgtaattaaaccatgagtggagtgctctgggaacacagaggagtaattaaagctgctgcaatgggtttgggtatacgtgtttctggttgtggggtggaggaggaatgccagggaagccttcattgggaaagaatcatttgaagtaagtctttaaggagggataggattttcttccaggtagtgaatggaagattggggtaagaagagcattctaaaaagcaagaagcaccaagcatttaccaccgactgccttggattattgttattgtgtacatgtctcccttctgctggcctgcatgcctcttttaggtcaggtactgggtttgaggcattttctttccttatttcttagtttagtgtctagtataaagtaggtattcaagaaatatttaaattaataaagaaaattaatttacattgattttgggcacaataagcagtctatacaatgacacccattgattatttgtataccttttcagaatgacaaattgtcttaaagaggtggcattattgctaagccaattctttctctaggacagctgaatacttgtagaaatttgcttagttacaaccagggatatatgcccaactaataactcagtttgatctcattagctatgatctttttcccatatcggcataatcatacataaaagcttgcaaaattttgctttcaaaggaaaatcccagatgatcacctctggcagtaatctggattcaaggtccacggtaacaaaacatgttgtgctaagtatctgtttagaattatcacttaatggtggaaaagttaagttctggcctgatccactttctagactagaaatggacatctagtaattttcccctgaatcctacaatcactggcagcagccaagaatattcagaaggcgaatgctactggttgtcaagtggtctttaaaatacctaccccaagtctgaagaacatgtcttgccatgctggttctcctattctgctgtgtgacaagttctcaagaggtcagagattgtagagtggctgtgagtaagtgccttctaggtaatttggttgaagatatggcactttggaataagctccattagcaccaaaagaatacaagatttggaagtgatcatctacttgaacttggtatcattttataactatcaaatctctgccatctgtttatttttgtattgttgatgcatcactaattaacttgtcaatcactgtcaaagttatttgattttgaagactacacacacacacacacacacacacacacacacacagacacacacacaatttcctctgaaacaaggacaacagtatgttggtgctgtctcttcaactatattctttcattaagacaaaaactctccttctctgatgatttactctcctacaattctctttcttatgtccgagtggatatccactggtttttatgctcactgtaattttgttacacattattatgcaaagttgaggagacagttttgtcaacaaacatctattgaaagcctgttaaccacaggaagcaatcctgtctaatcatcaagagcattggtctgggagtcagatggctctggactagagtctaactctactacttagcaactgtaatgtgctcattcactttctttcttctcttcttgcctgcctgccttccagtcttcctttcatatttaccatacattcactgaacattatctatgtgtcaggcagtattgcagatgttgaggatattagggtgagtcaaagagacctcatccttgctcttgtagaacttatactctaatgcaatagacagatattaaaatacaaataattatgcactgtaataagtgttatgagcaaataactgggtttgacgaaaaaatgggaagctactaaattaggaaaatgaaagcatctaccttataggtttgttgaagattagataatgtgggtaaagaatttagcatgtcttctggctcatattgagcgctcaataaatggccataataacatggtaatagttatggtaaacgatgaggaagtggtcccagccctcggggggttcaaagtctactgagagaaccaagcatacacatgaattactagaatacactgtatgaataatgaaactgaggcacagagagtttaagtgatcagctcaacatcacacagctagtaggtagtagagcaagaatataagcccagtcagctctgatgccaatgctcacaatgtaactcatcacactaaactctcttccaaagagtacatttattctgtgttctcttagctcactgaagacattgctatcatagcccttactacattatatttttctgatctttttccatgtctgtctctccccagaaattgcttattcctccttgttatttctagtgcctagacacagtgtctgacatagaaaagatgtttaacaagctattttaaacaaatacatgaggaaatatatgagtatacaaaagagtcctccacagatattctttccagaagcaggtgtcaagctattcagaacaggatactactctattattgtattaagataaaatctcttttggagggtttcttttgagggctgagtgttaaacaaaaattttaaatggaaaaagaaaggaagataaaatgatgacaatttgaagtattataatccttacatgctgataatacaaaaaattcccaattacagacatacaaacttcaaggaagataaatctggggatgagaagatagcatcactgagaaattcttcacttatgagaaggaactaaaatttcttagagaatttaaggtaattaaatttactaaaatgaaagtccatgtagcagccatatttgttaattccttgaggccaggcgacacaaacctcatttacttctgcaccctttactgtgactagctcaaagtaggtgccaataagtgtgtttttaaataagagaactctacaagaactcagcaactgtacaaagtggggcttacctgcatagcctatttcgtagacccacagccatctaaaatctctttgcattgtgtggtcctcaactgtgaacttagctctgtcatcatttctgcagaaagaagatagtagtctcagctgggcgtggtagctcatgcttgtaaatcccagcactttgggaggcggaggtgggtggatcatttgaggtcaggagttcaagaccagccaggtcaacatggtaaaacccaacgtctactaaaaatataaaaattagctaggcgtggtggtgtatgcctgtagtcccagctacttgggaggctgaggcacgagaatcacttgaacccagggatggaagttgcagtgagccgagatcacaccactacattccagcctgggcaacagagtgagactctgtctcaaaaaaaaaaaaaaaaaagaaaagaaaagaaaaagaaaaaagaaaaagaaacagatagtggtctaaaggtgggtgggacatgggacatcaggcctctagaatatactaggactcagaaaaatgatgaataatagttttttttttaatactttaagttctgggatacatgtgcgaatgtgcaggtttgttacataggtatacacgtgccatggtagtttgctgcacccatcaagccatcatctacattaggtatttctcctaatgctatccctctcctagccccccaccccctgacaggccctggtgtgtgatgttcccctccctgtgtccatgtgttctcattgttcaactcccacttatgagtgagaacatatggtatttggttttcttaatagttttaaagatagcaattataataagactaataagagtcaacagttatataatgcttactatgcacctcacactgttctaggcactttatgtatattaatttaaaattcacaacaatcctatgaagtaggtcctttcattatccccattttactgatgaggtaataggaacagagaagttaagcaagctatccatagttatatagctagcttgcagtagagccgagattcaaacccaggcagtctggcttcaaaattcatgctcttgaccactatgccctactaaactagggggttcatcaagttatagaatatttgagctgagggctctagagctcatcattatacagatgggtactctcaatgtcctctattgcagtgccaagtttgccccacaggggacatttggcagtatctggagacatttttgattgtcatacctggcagcaggtagttgctactgacatctagtagaggccaggggttctgctaaacatcctacaatgtacaggacatcccccttcaagaaccaattatctggcctaaaatgtcaatagtgctgaggttgagaaatcctgctctactgtaacaatttttgtgtgttcttactggagaacgccttatacccctggtttcttccataatcctttcccatctatcacatgtataggcaactccaacttctgtagtttatgccgtaccctactctcttatgctatcgtgcaactaagactaatctgatcaaaccctcctctctgaccccatctcaagaatctattaacgctttcagcatggttacttctatgcttcacatcaaagaaatgatccttgttgtgggaagtccaggtaccatggaatgctcatgggttgctgtttgagaatagtcctggaaatagcagtaggcacaccatgacaaaggaaagagaaaggaagtttagaaaatgcttgaacaaaacgtggaagaaaacttcatttctggcatatcacataggacctcgcatatagtaggcattcgagaagtatttgttgtgaaaagatgacacaggggcagggttgggtgtcctaccaaggaataacattgtgttttctgttctctgtctaagggaaaggaaacagtagaacaaatcacatttggggtctgcattaagcctggggctcaaggctttatcttttgcgtagtatttattgcttatgaagcaatatattgtggcagtgcaggtgttattttgaatctctcttcatattccttgaaaattaacaatctatcattgtttgtgaacaatgcactgaagcctgaggcacaggccacagtccctcctattgcagacttcaagtgatgccacagcttgcatcacggtgatgcaggtgagagaactgacaggggcttttgtaggcttttgtaatacaaggctcccagatggcttgagagagatgatgctattagacaagcaggatggatcaaagagtcactcaagggaatcaagatgtcatacattctcttccttgagaaaggaaaaggagataagggaagggaaggcaaagggaggcaagggaagggtctttatgctggcctatatatatagtaggtagtcattttcacatgagttgtgagtgtggcagggtgggagttggaagagaatagcttgatcttcaaggtatacagatgagaatctcagcatagcgggtgctttcacaaactaaacctcatcctggaagatttattgttttagtctataagctagagggtcctgaagacagccacctctgtattggagcagttatcaagatgttcaatatttaagttagatcaatttaaagccacagagccaggccagccctccagatggcaattgtagtgagggtggggtgagggcgtggtatagtgaggaagaagaaggccacagaatttggtatgtgcctctccaaggaagtgatagcacataccctacatttatgaaggcaacaaggtataatagaaggaatacaggacttggagccagatagatctaaaatccaaccttggctgtactcctgactagctgaatgactttaggcaagttccacaaactttttaacctgtttattcacttgcagctggggataatgatacctatctttcatataaaagataatgataatgatgttgattcctaatattggttaaatgcttattatgtgctaaacattgttttaaagctttgcatgtattattacagtaagtagctagccaggcatgagtggggcaggagagggctcccccagccccaccaggaatgtcaggcgactatcaggtagttgtcacactgactctctaaaatagtaattgatcatagccagcgccaggaaaaagtagtttcccaataaataaaaacacctgaaactggtgattggcagcatcccaataagatctctggtattgggcaagtgggctcaggcatgtgcattaagagacaaaatggcacagttgaactgatatatgaccttccaggggcattccactggaacagggaagaacgcttcagatgagcatgtgtacaactctagtaaacacactgagcatgctcacctcccaagtgctagcaggcccccacacatgcaggcagcttaccctaatggaagaatcaagggaaacgggatgcaagatgctggaagtatgccagcatataaaaccctaggtccaaagtcaaacagggcacttgacctccaagatatccacttagacctcttccaagtgtactttaccctcttttcattcctgctctaaagctttttaataaactttcactactactaaaacttgccttggtctctccttcttccttatgcccctcagtcgaattctttcttctgaggaggcaagaactgaggttgctgcagacctgtatggatttgccacaggtaactcagatacttccaccactaacagtattatacaatataattcttacaaaaactctatgagacaagtgatatttatcattatactcattttatagacaaggagtatgaaacacaaagaagttaacaagtggcttaaggccacagatacagttaatgttggaattggaattcaaattcaggaagtatggctccagagacaacacgtttaaccactgggctatataccatcactaagaatgctgagcccaatatctgacacagagcaagtacctgatcatgactttaaccctacttcctttatctttcccttccctttttctggcaaggaagaaatcattcagatgccctgtggggatctttgagctgcggccaagggcttcttttgtaatttcagggtgggctggcatgggctgaggtatctcagggatagtacttttcagttccaggttattaggcaaattgagtcagaagaataggttaaggttggacccaggggttctggttggacccagggttctggaataccatcaggctccactgtgggaaccttagagggctgcctcagctactaagagcagtggctgactccccttgagaggctcttttggggtttttctggactacagtctgtaattgccaaccctctggcttcatggacttctcagatacctgtgaactaatgttaccttggtctagagtgaatggctgactatggtcctctaatctaggattacatcatcacatttattccatattttcttacctaatatttaggtaaagaacaccaaaaagcatagatgggcctaaaaaaaaaatgctacctgtctcagctcctttaatatctgcactaattgcctgttaagtcatataattcttttcctggttttgaaataaacacataaatattactgtcaggaccccaaatgttgtagttactggtgttcaactagaaatcttaatatttaaactaatcaactaactgcatttcaggtactgagcacgctctttaagttaatggcatagctgctggtgggggagggggtggagaaagaaaaaaacagaagcataaactttgttaagttcccaaagctctgtggtctgtgctttcccaaggtaagttgagtaaaaggtgacttggcaacactgctaccatgctcttggaagtctggcaagatctcttggaggaaaaaaaaccccacatcagtcctggggctaatccacaagccgttttgctgcagtccttgttgctgaaaatctttccaatatgtttcagtccacttccttgccatagaaaatagagtatgacaaggataaatatagcatgaacaagatctggagtttggaaggctagtttgaactctggccctaccgtttactcaccatgtagcaatcacttacacctgtgtttgtcaaagtacgttccaaccatgtgcatcagaatcaccttgggtgcttgctaaataggccaatttccagggttcactgctaaagttttcacctgggtggcactggggactctgcctgttgaacaagtaccctaggtaactcttacacccactacaaatttgagaaacacagagcttcagttttcttatttataaataagaatgatgccaccctttcacagggtggtggtgaaaacaacataggtaatcaatatgtgctagttgtacctgaatctttggtgaagttattgcaagactacgagatacattctgaatattaatttaacaaacttgtgaaagccatatattatgtgatggtacccaggtgaaaactacatgttttcctgtcctttgaggggctcatagactagtgagagtggcagatatgaaaacaaaaactactgtacggtttgaaaatggctaaacagagatatgaagaagggggagacagttcccctgctaggacggtgctaaggagagaaggtggtggaggagggaggggagcactgaggaagtgatgtgaagctggaggtagtgactttaaactgagttttgaaaactaagccaattatcatggtactacaaatatcttaaaaggtacagaacaaggctgtatttgtactaagtctaaaacctagaatgcaagttgttcttgtttggggaaatgggagtgagtggagaatattttccatatcaatttccttatcatttctctctcctaaaagtagaatgtggaacaactggagtcattttgtattcccagtaggttgactctgagaggatgggtgttgggctatattgttgacttgctgtgtaagtcattaactacatggccatggtctaagttggtgggggtagggggtgggaccctggccatgatgactataaataagtcaggtggtaaatcctgctaataatgggacctttggctgaagtactagctgcctcagcagggccatcctcagatattaagggcaatgctatatatacacatacaaccgcatgaggcagtgactaatggctctgccttgggccagcagctctggcccctttcgtgcttctttacctctgcaaagcagccaaactggagttttcaaactccactccaatttgacaaataatcaaaagacaatagactttattatacataccttcacattatcttcactacccttcatgtttcaaaatgactgtttttttttttttgaaaaccacaacacattcccatcaaccactagcatgcatttggccagaccaggcatgataaactctcaagccttaatgctgaacgatgctgaatgaagagaaaaacaagtagggttataacagtggttaagatcataatctttggattagatctgagttctagtcctggcccaacatttattacctgtgtgatgttaggcaagtgatttcatgtctctgtgcttcattttctacatctgagaaatgggataataatagtacccatcttatagagctatagtgaagattaaaggagaaaatatacaaaacagatctattgtggtgcctaacttagtaaatgcttgtagaatactagtaattattatcaatatactaacaatggtgggcattacctctgatatcttatggaaaacaggggccactgggggtaaggaaagaggggagtgttacaatttcttcaggtgaaaagaacatgaaaataccagtacaggaaccagccattaataatattagattggtgcaaaagtaattatggttttgtgattaaaagtcatggcaaaaatggcaattacttttgcaccaacctaataggagagaatgtatttacaacaaaaaaaggacaagatggtttatctttaacaagttctttaccaagaacactgccagaaaaaaacagtgggattaatttgtattcttctcatctgattaatgcattttctgaaagtgctactgctaataaaatcctaaaaagatgttccagtgttaccctccaccactgtacatacccccaacctatcagacctgctgccaaaacctatttgcttttttcctctaaaaccatggatgacatttgtatctgtgctctctctcctgatccccccatctgtggtggaggaaagccagaattacttagtgttgtagctcaattatccatgacaagattggaaagcaagggggtaggcaggagaagaacctgctcttcacagacagctttctaacaagacaaaggcagattatggccacggctgtgacctccatgacagctgggcacaggacacccgctgtatcggcatactccaggaacaatacacatgcaagtaaatttggttggcagtttgtgattctgggacagtattaataatagtgcctttcctgaaatctatcctgtatatgatatattttgccacgtttaattcaatagctcttctgaatattttaatacagcaacagtagtccaaatagcaaacacatgtgagttattaactttcttttatccatttctgctgtaacttaaattttcttcctgagtgaatctccaggccactagtgacatcacctttaatctatttgtgtggtgtgtgtgtgtgtttattggcattaacatggaggagacataagctgttaaaaaataaaaggcgtctaggctagtgatgatctccagagtaaaccttacagggattggcagagcaaatttgatttgaaaatgattacaaagggtgaattccctgtaaataatgaattggaaagaaaatcaggctgggagtatttgcttatccacttatttccacatggaagaaaagctgtaattcctgacagcctgtgcttacagtgtgactagattggccagagagaaaccaacgggtgataaaaataagtacacaaccccaccagttcattgcattctctgtcagttccaacaccaaggaaaaccataaagataataagtctttggataacagcccataaatccatggttacagttcaagcacttaacttcaaattcccaagtgaccatgccactgttcttatctgttaaagaagctagaagttcactgtcagaaaggaggtgaggtgatgggcaaggcagctgaaatactcaaagaccccagcaaaattctgggaaagcatgccctccttgcaaatcaccacttcttgagaaactaactcatatgtcactgggagacactgtcagagccaactggctaggtttctaccaaagtgcacctagttttcaagagtggctatcttccttgaaaatgtaaagctaatttctgtatatcaaatcctatttttttccactgactcacagtgtctttttctaatttttaaaattacatattgagtaggtacacaggaaaatttataagatacaagcgtaaagtataaacaacaacaatgcaatgaaatttgtatgcccaacatgcagtttaagaaaaagaatatcactattacctttaaagtccaccatgtacccctccctaatcgcttccatctcccctgaaagataaccaccgttttcaattttgtgttaataattccttgcttatctttataattctactacatatgttgataccgtctcttcaaaaatgttttatcttaatttctaaaggattctttaattgccaagagctttctgtgctgttttctttcatactcctgccccaccgtttccctctccctcccctccctctcttcctccttctctctctctttctctatctaccttcctttctgtgtctccctcaccacccctcctccactcagctagaggagtagttagtgatctaggaacaaacatgaatgccaaagatatcagttagcagtgaatccgtatgtaaaggcagtaattattttgtaacatggtgactttccttttgttctttaaatgaatccctgcatgggccctaattcgtttacccagaagttcagaggtgattagggaatatggaggtggcagcaggctacagagcagggtgacggagctgtgagtattgcctagcatgggtacctcaggggtctggagccagaagaccatgctatttgctggctatgtaacttaggcgagtcacttaatatttctgggcctgggttccttcatcacaaaaaatgtagaaaacagtaatactgatcttacagggttgatgagataaacaagggatattaattggaaaagtattttgaaagctataaaatactatataaaggtgagtaaacgatgttgctgttctgctgctgttgatgacatcagttctattaaagtcaaggtaaacaactaaatggttatgaattttctaagtttggagctaatccacagatttatccttgccagctgcctggtaaagccagcatatcacagataaaattaaaccttcttttccgatgctttattactggtccatgtggaagcttccccccgcatcccccgacttcaaacatcttccccaaatcccactgtacctgcccaatctgcatgtgagggagttgtgtttgctctggtctacgtcagtgccggagcccagggcagaaagtagtcacacattataggaatgcaacattttctcttcctaatcatttctcataggacagtgcaggttggtaactcaaatcgaaatgtatgcaagatgtgctcatcacctgatcagtttgcgcctgaggaaccttctgaaggtcctgacttttgcctgtgtgctattaacataaccatttgcatgtcatttccattctgttttttaaagggtctctccttgaagatctatgagaatgagagtaagcagtggacagccacgtttccattctgcaaacgatataaccaaatctgtaaatgcgcaaaaatacacacaagagacgctccataaagctgctggcaattattttggtgaacagacgcaagttgtgcacaattccccacagctgcctcaggtgttgaaggaagagattcaaacaacagagggggaaatattgatcatctttttgaatatagagttaggctacctgcttaggtgcccaggagggggtgtgagagaaagaatgctggtaatgttcccacacgtttcccagcttgaggctggacagccacatgcccatctgctgctaagaaaaaaaaaaaaaaaaaaaccagacagggcttaaacacatacgaaaggctgtttgacctttcaggttgtaaggctcttgccctccgcctaacagctgacgcctggaacaagcaggcaaaccccacatggcctctgaaggggctagcatgggggctccagctgaggggcggctgcagctatggcaacacatgcctgggaatgagttaacaccagccaaaggggttaatggaagaggcaagagcttttatacaaatgcattagggaaagaaatgcaatacagtgggaatgaggtccattaataaagctgagtgataaaatccacgaccattctcaaattggacttggcaacttaaactccttttccaaattagggtcctgtgttctagctgctcatggggatactaagcttctatctttaaaaagaataaaaacaatactataatatgcagttaaaaggagaaaataggataggcaaaagggtaaaaattagacttgcaaacaaaggaaggaagagaaacaaaagagatgtgtacaactatgttctgaatatgttcaaacagcttgttattactaacaatcaccacctgacaataaattacccctctacatgtggattaaaagctgcattattatgatgcattagaatcaatctgagtactaacgataatgggtggcttggtggctaaacatggcccccaattactgccaagtgccctctccctttgtggctacaaaacaactgtcatcaatattctctcatagagagtgttttcttatcagtattacatcctcaaacatccttggaaagcaggtcgatattgatgggcttttctgaggaaaacagggaggcatggagaggttaagtgaaaatcagcagaggcagccctcctggcccatcaaagaatttgggttataaagggagctaaggtaaggaagcaaaggccttcagcctgctctttccatgatggcagcacctatggaatgcaatgggtcagggtttttactcaccctctcggctgtagtgaaaagcatataatccttaagccactgcatttagaaaatctgattgtagcttgcagcacagacccacagaagacatgtttacttctggcagagtccaatacaagcttagagtaaaagcttacttctgagaagaaaaaaagagtacatctcagttcagaaacagtataatccaccaggggtaatattttctagttacaaatgaactaacagatactgactgagcccctgttgtgctatttgttaatggctgagagggacacaggagaagcagaggactctgagaagactgaagctctttcctcagagagcttagcatctacttgtggttgggtgtagacaaattcacacacaaaataaagaccaaacaagcctctacagaagtcccaagtatagagcgacaagtctggtttggcatactggttagaggaaaagatgggatgtcggcacattcccgcatgaatgttaccagtaagacttacactgccaagcatattagacatttccatcagcagtaaatgcactcacaacaggggtgaccaagggagatgaacaggaggaaactgaggtaaatcagaaggacagatgtcgttaaagggaaccaggagggaggtgtctgccattatctgaatacgatcgtgtcatttttgaaccaaactccaccgacagggcctgcttccctgggtacagtgcttttcaggcaagtactcttggttggcatgtccctatatacatctaagaactagagggcaactgatttaagattgagtgctctagtgagcacacagaaggcagataatctgtgttgtgggctgaagagagcgagtcacatattttagctattaagacatacaaagtggtcaagctgtcattctgtttcagaaattaaggcatttgacttgtgtgcctgtccagatggagtgttattccactcatagtatatctgcagggagggcttgaactttccttcaaaaagcattttggatcattttagcatctttgctagggttcacagtgtcccagatgatgccttcttgagacaacttcacttcccattctcctctgctccacagccacaggttacagacctcactttgccttgtcttgcaaacattactggctataggagactcgggcagagggtgtggatggctttagagaactctaccactgcacacacacactgtcctggacacagtggggcagcactgttactgtcacaggtgaaactgatctttgtaatgagcaacagcctacagagcttctggtgacgtacttgtaaatttcccattgtgaataataaaattcagaattgcaagctgattgcatttctttctataggacctattctctggaacagaaaattggcaattgctatctctttttcagacatttgaaaaagacaacaattatgcctaaaggaactatcatgctataagaagtctgtttgtgatcccagcccctatagattcaaggaattttaaccctaataataatctagatgcgactttatagtgtaagagtccatctttggatttttccaggagtataaatggcacattattacatgactgttacttgtagaacttgaactgataagtatatcagacacatacatcaggagcgcatgaactcacaacagggttggtcaaagggggtgagctggaacgagagagcctgtggtaaattaggaagacagatgaaggttaaagggaaccaggatggaggtgtctgccattatctgaatatgaatatgtcttttttcagccaaacttcggtgataggccttgcttccccaggggcagcatttctcagagaagcaagcttagaagtcatttgggaagaaatatttctttattctgacatgagcagcttggtagaaaagatgagcagacatttgctttgggagcaagaggtgctaagcttaatgcccatcatctcctagaaatggtgatgtattgtatatacacatggaatgtctgcagctgcttgctatttcctggaggtcagagtacgcaaccttttatctctaaatatctggttttcaatctggctgtatcttgaaatctgtcttgaatacagctcagaaaggaaggttttggttaagcatgtagttactaaccttcaagcacaacagaatgccaggagagcagcctgacctttgcagtaaaattaatttgatgcttacaatctaacctagagtccatagcctttattcatatgacagagtcacaggacaatttagcggggattattaaattccacctaagctcatcagaggagagaattgaggttgatgcatatctggaattaccagtgaattcgccaaaccacgtggggaaaggaaaggcagatagacttctaggaataaagataaggggctacacttggtatgtagtaggtactcaatgagaactgattcagtgaatgaggcaaaagagtaagctgaatctgctgtctgacaactagagagacccttccttacacccacaggtgcaacttcaatccctatgagcttcccatacagcgaagtcacttggcaagtgccagagatcccaaggtgaggatggagggtgagtgggttgggtatggtacaagacatgccatccttctgcattacccttcccattccagttggtggtaggaagtctggggcaggacattgttattcagaaacaaagaaagctaatggataccaatgaatcaggagggatgcattttactcgaagtggctaagagaacctcaacagaagaactttgttgggtttccagaaagcctttgcgacagtactaccaactacagcactacccagggggaatcagtgttccagtcactgcacttaaacaagcatgttatacacaaaagcctaagactgtttgcagtgggaaatcctggttggttttatttaggcaatatagtaatgtagctttctgaatctgatgttctttatttgaacattcattatgatgattcatctctgcttttctttctttaccaatgatatttgcattctactaggaaatataattcataaaggatgataaaggaatcaaaattatccaatttatttccatcaaaggagcagaaggaatccagcaatgatctgttctgcatcattctgttttcagtacgtttttctttaagtcagggtttgtagcattaaatattactcttcattgcagaatcagtactaatttaacatcacaaggataatctggttttgtctaagggacccctccccattttgtttcccaggaactgaacattttccactccggatgttctcttgtaccatagaaagtattctgactctgtacctctctaagagatacgtagcactaatgtgactctctaaatgcctattagcattttaccttgtattaatagctaaccgggcacccttgctattttccctgctgagatgtatcaataaaaactttgatggcagggatgacgcctaatatactgtcaaattacccgtccccccgcaggatatggcatagtgaatgtacaaatagccaacataactctatcagtttttgtcttcttcaatctgctgacagtattgtaacacctgacaataattgcagttcacactatttgttggtattttttaaagtggaaaggctttccttaacttttataaaaattgtcctcaagttaatcttgctaatgtcttccatactaatttttttcttttgccaactgaactcagcctatatgagagcaataaaatctactagggatcctctggtgagctggttgattctgcctataaaaatggccttaagtcatagagataatatcggggaatcaggaatgatgttcaaaatattcaaacaccagcatggcatgggcaaccaaacagaactgtatgcaaaaccttagtactggagcagagcctgggagaccctcttgctgtgccatgtgggcatgtatgtcggagcgatgctgtgaatctccagccactattttcactgtggattccacaggcatcaatcctacccatggagcctgtgctttgcaaggaaatctcacaagggaaaggactttgctttgttagagagctctttatattgcagttgaagagaggtaaaggagttgtttctggggtatttccttggaacttgcaaataaagacttgtggtgggttctgcctccaagctattggaagagactgactagacagttacaggcttctccattttcatgcctacttctgcctcctgctaagttgcatcagtttcaaacacaaaggttaagatgtgttacctgggttaagatgtcttagccaggggtcaatccatgactattacactgtggggaagtctaggtgatactagagggatcagggtggcctgggtgacaggtgatcacttagagggctcctgacagtgcttatttaccaactggtacagaagtttttcagtatctttaaactggtatgactgtccagtgcatattggctgactatcagcctgaagagacctacttttcaccagaacaggcagcaaaagtaagcagatcctcctacccatagctgcagtctccttaaaaaatctgcctcagggttcaaggaaatctttgtgatccaagttatctcttatactaacccgaatgcaaaaacctttcctatagaaatattaacatactccccttattctgtcttcccagggatatgaacttctaatcactttttaatctgttaaacatgttttttttctttaaagaaactattatttaaaattgcttcccagtcatttttgagcctaaaaacaggtcccactatctattgcttttccagtccttgcaataattgagtcgagcatggatagctgagaagtagaatgagcagctctccttgctgtcttctgcttgagtgaagaaagcaaaaaattttgtaaaatggcagaggcaggataacatggagctctcccttcaaaccattagaagcaacagaaataaaagtgccatgtttttgtgccctttaacaatcatttttttattctagtcccatatccgggtccctgggtgacagacctaccccacctcaacatgcatgggctggctgcatgtagttatcttgttctctttccacacctgcacatgtctattcaatggggctgtgttacaatcaatagcaaatacttatctgctgggagactgactgagttccaagaccttggttcacgtaaggctgtctttgccatctagtgttaagttttgtttgcaggattactagtgaaatttctcaggaagctggataggacatatgggaaactgccaaggtgagtaattcctgcatctctagaggtgatagctacagcaacagtagcttattgtgagtagacaccagttgcaaagctccttaggcacaggctgggtaaaggggtgaactggaataataatttctgtctagatggaatgtctaagcaacaacattgagcatgaagtgttcatcataccctagtgctgggaagtcaaatcctagattcttgcttagtgataacatcatttgacaaagtaggaattcacacaaatatatgtttaaaagaaaagaccaggaacatcgtatataccttactgtctggagtatctctcaggttggacgctagacaaacaaaagaacttggaatacacatgaacaaacagtttcagatggcatgttacatagtagctcagaggcagaacccacaagtctttatttgcgagttccaaggaaacatcccaggaacaactcctttacctctcttcaagtgcaatataaagagctctccaacaaagcaaagccctttcccttatgagatttccttgtaaagcagaggctccatgggtaggattgatgacaatggaatccacagtgaaagtaatggctggggatacacagtatcaccctgatatgcatgcccagtggaagagactgaccagacagttacaggcttcttcaattttcacgcatactgctgcttcctgctaagttgcatcagtttcaaatacaaaggttaagatgtcttacctggggatttcacttatgcaatagatgagccaaacatatatacgagtacaaatggctgcttgtgaagtacctgaagtttttccgataaaggaggaatttggatgtgttacttggcctgcactctgccaggggcatatcgtgctgacattagaaaaacatgctcttttcaacaagatttagtctcacttccctttgcctcctggtctcttgctaatgactggaagtagaatgagagttcgattttacgatgatttagaggtctgtgagttggctttctccctttggtatgtgaccaacttcaaagaagcaattgtgtaactactaaggaaattagttctcttccaagggatagagatcttttgtcataagtgagaatgagtaactaagctctctgactctttctcaagagggcccctgggctgaagagggcctggctcgtggtctaggtttgctcactggagcagcaggcagtcagatggtcaaaaaatattgcttgtattccttttgtaggcagaagcactggagtagggaggtgaggctgggtgaagggaagacaacaggaataagacagtaagtaaatgaacagatgtaaagtatatagcacaatgcctaatgggcatacctctttatatagcttccactttttgaacacctcctctgtgttaactactaaaataagcactatgcatttaatcctcacaacaacattatgagacaggtattactaatattcttattttatgggggagcaaaccgagccacagaagtttaagtaaattgctcagaggcttcagaaatagtaaaagatggggtcaagatttgaagtcagatttctttcttttggccctaggtatcaggctttgtgtttgatatattactaacgccaaatcctcataccattcttgagttgtgggtgtgattatctccaattacagttgaagagatgaaggttcaacgtgattaagcaacttgtccaagatcatacaggcagtaagtggtagaatgagaattctaatccaagcctgaccccaaagcccatgctcttaaccacaaaactctgtgacctcttttgcaatctgacatattttagacagtcttcaaatgtttgtccccatctcaaatggtacagtgaaggtagatggaagacaaagagttgaaggtaacttagactcggtagtcagagcaggaaaggttgcagagttgagctggaatcacatcttctgttttctcttggggctggtgttgagcaggatgtagttagaggtgataaaagacaatgaggcaagaagcaactgatttctatcccctcatctccaaattataagaggaagagagatcactcagaatacgagctagggctaggcaataacactattagagagttactattacctgaggactattacctgagctatgtaggtgtgctagttatcaatctaatacctcttagctccaaattcacccttgttgcctgctctgtgaaaatggttctgggccctttatatatttttcctttgccagctggcacaatgttaagctttgtcagtagagggcgttagggagacatttcaggaggaaggggcttttctttgtgggtcctgtgtgctggtgtgctaggtgtgctcacttggcaggttcctgtagttcaggctttcagcttccccagggcccagttcccacagcacacacagctccccaagcaccaggttcctgcagcatgtgcaatttttcaagcatgcagctctggtagtataatcagcagtgcccagcagcttctcccagtacccatccctcaggatgtttcatggtggggtgcctattgtgagatacctctctgtgaccagctttccctgacactatagagggtggatttcccagaagttccacagggcagaattccagcaagttctgctgatgtagtaccacagcaatttctctgctatttaatgagtcatgactgtgcccttgtcctgcaagatatggatctcagccctggggaaaaggttctctcctgggtgccctagttcagctctaggtgtaggggctgctccttatatttgttagtcctatattctttgtagttgtttttacttcttactggccaatcccctgttatagttaatatttatattaaaatttttctgttcaaattactgtgtgatttctctctcctgatgttttccagacatatagggttaattcctcttcctgcatctcaacattctgtaaggtgatgactagggcaaagggatacttctagggatacctacattcgtaggtagggaggatggacttttcctagagacaaggtccaaagagaaaagagcattttctttttcaggaggtaaaagatgacttctctgtcttgctttttaatatacaaaaatgagttagaacacgtgtggcctttcacttgctcaatttttttcaatgaggaggaaagaacctgttagataggaaaggaaactgaagtctgtggactgcgtggattgtgagactcaaaggactcatgatcattcagagtttaaacagtgcttaaagctctatagcccaggtattccaagggggaagtgactacttgtgatgatagccttcaaatgactaccatctttaatataatgaccaatattgtactcaatacctctatgactacccatacaacccttactcaaagctcaaggttatatcccctcctctgcaagagatcaaatgttttctttgcttaaaattttgcttttccatggacatatgtatagaaattttcagacatcataaaattcatgaattctggaaaaagcttctgaatcctcagggtagaagtttggggtttagagtttgcacatcaggatgttttccaaatatcactaagagaaatgattttcacaagtgcagaataccatcataatttttatattactcatggatttatgcagctgagttccttttgaatttgagtaaaatattttccaaaacacttgttgttaattaactactacctttctaccgtgactattttttttgcttcctgcctccaaccagctcaaagtataatactgtctctccaaagctcaatgactaagaaatggaaggcaagtagttaaataggagataatatggaaacgtaaatttcaaggtctgatcatcaactaaaatgctccctatcataatacaaattcatctttgtgatatttatgaagcattggctcacaacaaattcagaaatactaaaagcgtcacagctaatcagatggcctgctcaatcactagaaagtttctaacatacacttcccatgtgctagaaccctcatagcaataacaacagcattggaggccatagcagctttcgataaagaatgtttagccaaagtggcctggaatacctatggtctttgagaggcttccacgtggtcctccagatcatccaaggtattgtgtgttcatgtgtgggtgaaggtcccaatcaacacaggtgaaagagagaagtctgagccacagggtacgattctcctgctagaaaaccagtcaattaaagtttcagaaaatcggtccaactatagtctctgtttcccttcctgtgtttgctcctccaaattttggttctggcccaagttcttagatgccttcactagccttccctttgtcactctgtcctccacatatacgcacatgtatatacacagagggatcatataaccaagaatagaatgggaaaaggagcattgtttcagagcagtctgatgttttatactgcagtagctggtggggacaggtggaagtgacatgtagaaatttgttgctccagttagaacttcctaaagaataagaagaccattgatattaaccaggagttgctgtgaaccaatgcagacctgccttcatgttcagaacagaaaccagtcctatgttgctgccattataatgattgtagattagagcactagtttttacccagggtggttggatggtctggcacataaagaactggtactgacaggaggagaagcctagtgtttaagatgggcctgtaaatcaaaaagcatctgagacaagtctcaatcaatttagaaagatcctttgccaaggttaaggatgcacctgtgacacagcttcaggaggtcctgatggcatgtgctgaaggtggtcagggaacagcttgcttttatacattttagggagacataatacatcaatcaatacatgcaagattgacattggtttgatctggaagggcaggacaactcgaagtggtggggggcagagggtgggatggggggaatggggggcttccaggtcacaggtagatttaaatatattctgattggcaattggttgaaaaagttatcaatagaaaggaatgtctgggttatgataaggagttgtggagacctaggttagagagaatagactgtaactgtttcttatcagacttaaggtctgtgttgatgttaatgctggaggggtataatgaggcatgtccaacccctactactgtcatggcctgaacctgtatttcaggttaaattttagggtgccctggctgaggagggatacattcagatggttgaagggggcactggaattttatttttggtttacaggcctaaggatcaagacctgggtttgattatcagattccccctatcaatgagcaaggtacttaatctctctgaattagttttctcatgtgccaaatggtaataatagtatgtgcattatagaatgttttaaggactaagtaaaataaggtgcataaagtttacggtacatagcaaaaactccatatgtgttagctattattatttctatagttttatttataaaaggcataaagccataacatcttctgttgccttattctcttttgctagttttggagatgtggatagaggaggtgttgccaggggtaacaaaagatgggagccatacaaatagtctcaattgatttttgacaaaggtgcaaaaccaattcaatagtttttaacaaaatattactggagcaactggacatccacagttgggaaaaggaggaggagaaacttgatctaagtcatactcaaaatgaaacacagtatccctgaagaatacagatgcaaaaaatttcaacaaatttaacaaatactaatgaaccaaattcaacggaattctattaaaaagatcacacatcatgatcaaatgggatttatccctaggatacaaggatggttcaacatacaaaaaataattaatatgacattgagagaataagaataaaaatcacatgattgtcttaatgggtgcagaaaaagtatctgataaaattcaacacccttttttgataaaaactctcaacaaactggaaatagaaggaaaggacctcagcataataaaggtcatatgtgacaagcccacaactatatcacactcaatagtgaaaaactgaaagcttttcctcctaagatcaggaagaaggtaaagaggcccactttcaccacttctattcaacatactactggaaatactagccagagcaattaggcaagaaaacgaaataagcatccaaataggaaagcaaaaggtaaattatccctgtttccacaggacatgattttatatatagaaaatcccaaagactccattaagaaaatggttagaactaataaacaaatatagtaaaattgcaggaaacgaaatcaatatagaaaaatcagttgcatttctatacactaacactgaactatctgaaagagaaattatgaaaacaattcctattaataatagcacgaaggagaataaaatacttagtaataaacctaaataaagaggtaaaagacttgcataatgaaaactacaaaacattgacaaaagtaattaaagaagacacaaacaaatgaaaagacattccatgttcatggattgaagacttaatattgttaagatgttcatactacccaaagagatctacagattcaatgcaagccctatcaaaaccccagtgacattttattttcacagaaataggaagaacaattttgcaattcatagggaaatccataagatcacaaatagccaaatcaatattgagaaagaagaaagctggaagcatcacatttcctgatttaaaaactattacaaagtcgaagtaatcaaaacagtatggtactggcttaaagatagatatgtagaccaatggcacagaatggagatcccagaaataaatccattcacacacacacacacacacacacacacacgtacagttaattgatcttcaacaagagcaccaaaaatacgcaacagggaaagtacagtctctttaacaaacagtgctggaagaactggatatccacatgcaaaagagtacaattggacacttattttacaccatacacaaaaatcaactaaaaatgaattagacttaaatgtaggacctgaaatgtaaaactcctagatgaaaacagggggaaagcttcttgacattcgactaggcaatgatttcatgtatatgacaccaaagcacgtgtaacaaaacaaatataaacaagtgggtctacatcaaactaaaaagtttctgtacagcaaaggaaaaactcaacagactgaaaagtcaacctatggaataggataaaatatttataaatcatatatctgacaaagggttaatctctaaaatatataaggaactcctacaactcaataacaaagaaacttaacagcctaattttaaaaacaagttaaggacttgaacagacatttctccaaagaagacacacaaatggccaatagctatgtgaaaaaaatgctcaacatcactaatcattagggaaatgcaaatcaaaaccataatgagagatcaatatatacctgttagaatggcttttttttttttttaaagtgacaacaccaaatgctggctaggattctggaaaagtttggctgtttcttaaagaaatatgtaactaccaaatgaccccacaattacactcctgaacatttatcccagagaaatgaagacttaagttcacacaaaaacttgtacataaatgtatataactttatttataatagcaaaaaactgggagaatcccgatgctctcaacaggtgaatggtaaaactgtggcaagccctacaatggaatactcaatcaactatggatacacacgattattcaaatgaatttcaagggaattatgctgagtgaaaaaagccaatccagaaagattacatattgtatgattccatttatataacattctcaaaatgtcaaaattatagaaatggagtacacattagtagttggtggaaggcaggagggaggtgggcaatatgagaaacggaattgttctgcgtcttcactatatccatgtcaatatcctggatgtgatattatactacagttttgtaaaacgttactgggtaaaggatatatgggacctctccgaattatttcttacaactgcatgtgaatcttcagttatctcaaaatttcaaaaatttaatttttaaaaaaggaaaagaaaaaagatgtggatagacagaaggagcagactgaaaatagtctctgccatttgcaatacagttcagataggtgtcccagattatagcaggatttctagcttggcaggcgaatccactgtactgcagagatccctctggtgcaggaaagcaaggcagagttttcctgcagagccagcacttgctcctctcaccgggatattagttattgctcttacaaatttggaagctgagaggtgtgtcacaattaatgaaggttaggaggctctgggttagagtcagaactactaaagttcctgaaagtcctccaagcagctctgttgctgagatctaggctgctggtgcagaagcctcctcggaagtaatttaagcagagtggatctcaggggtaataggagtattcttttgcttggcctctgaaggagacgagggcaggccatatgacagctctctgtatggagacagcacggaaaagtaaaagagagggctgcgagttgtagaggagaaaaaactgagaaatcataagcttgacaagggagaaagcagaaatttctctgcctccatgtgtctgggtaattgggcatcaatttacctatcacgatgccatgcagtactacaggcaacttggaagaaaagtgttgggtaaagaacaactgagtgttgacatctcatttttaaaggcaaactgttcacacacaaatgattgcacagaatattaaagaccagccttcttttccatctggatgatggatctataaggagaatgcattcataccactggcagagtattttcaaatagatacaatcatctttcttgctgctctcttctcttctgtgatatcattaaacatttgattaacactgactttcaggccttcccaaacactggctccctgtttaccaaaaccactgaaaaatgcccaggctgaccactggcaatcaatagagttccttggggttaggtgaacatccaatgtgtctgaattgagacattcaaaggtgaattgacaatcctacttatgtgaatgcctgctgcagcttttgggaactggctgtctcacaggagcagtgcagggacatcaccacctctgtgctcattttccatcttccctaatgctccagaggcatggaggagaatcttgggtttccaagtacattttgtgttcagcccatttccacagggcatagcaccttcctgctgtttccaccttctcttctggctgccagctctattatctccatcagaaatttgatcctgttagaagtgctgtggggtatttttgtctattttttaaatagagccttccagtttcctttgggccattatgttctcctaaagcagtgctttgtcttcagtcattaatatttaatgtgactagaagctttcacaaaaacctattgagatgcacatgctttaggtggcaaagctgttatttaatgatgttggctgggtatactaattcaacctacccatgagggaaggtgacctcctggtccctctggttctgtgtctatattaataaaatggaaacctcttgccatttatgaaaatatctgttcaccatagaagagaggaggactataagatttttttctgacataataaaagtaactgatttctaaaaaattggaaaagaatattaaaaaatacaagtatgaaaagttgtacatacaataaatgtttattatggcattgctataagaagaaaataaattatgaataacccaactgtccaataacagaggattggttaaatacattagatgacatatttatataatggaaatctttgtagccagtaggaatgatgatgtaatctatctttactgacattgaaagatgccaagatacattaataggtgaaaaaaatcaggctacagaatagtatgtacaatatgattcaattgtttttattaaaaaaatagatacactggcaaaaaagccagaaaatgtatgcgatgaaatgctgatagaggttctctctgggtgttgtgattgtgaatgatttttcacatctttcttcacatttttcttctaaatttttaagcagtaggcacagtaaaattattttgctaaaaaatactacgggatggccaggtgcagtgtctcatgcctgtaatcccaacactttgggaggccgaggtgggcagatcacctgaggtcaggagtttgagaccagcctggccaacatagtgaaacaccgtctctactaaaaatacaaaaattagccaggcatggtgacgggcgcctgtaatcccagctactcaggaggctgaggcaggagagtcgcttggggagggggaggttgcagggagccaagattgtgccaccacactccagcctgggtgacagagtgagactccatctcaaaaaaaaaaaatgctatgggattgtggctatacaacttataaattacttttacttgaaattgtaatccaaatgaccttcatatttccattcaaacatctgtttttaatttagagaagaggatggcaaacttttatgtaacgggctatactaagtaagtattttaggctttacagcccatgtagtcacttgtaactactctgccttcccctttgcagtgctaaagcagccacagacaatatgacaattggtgtagctatgttctaataaaattttatttacaaaaacaggtagtgggctgaattttgcctataggtggtatttactgacccatgctctagggggctaaataaaggaggccgaagtctcagaattaagctagttttctctgttctcttgggtcaatgtgggtaatattagttgctgctctccagagtcaagaccaaaatggcttggagacatcactggagcgtctcatttttgctacttgagatgataattttcactctctatattggggccatgctttacatagggccaccttatccaccaaagtgaatcctagctctgccaaagataaagctgttgtgagagaagcccccaagtgactcagaagggttgaagaatttacaaccaaactactgagtgaccttagttagaaccagaaatttcaaaagaatcagtgcttcctgtagcccatccgtactaacatactccataaaccagttttctgaagaagcgaattattatagtgtatctacagaaaagcttttaaggagtcttaaaatgtccaacaacagcttaatttaggagtctgaaaaagacatacgtagctgaggcaaaatataatggggaaaaagaaggatgacttagccaaagatggtatggcactcctagtcacaaagagcaccacgatacccagaatagcagtggaacaaggttaactatgtgaatttagttcattctcttgtctttgccttaagttacaatcaatggtgcagtttcttaaagcagtttacttgacatatataatctataaagagtattttccaccttttctcttcaaagaagagttacttattgcatgcgcgtgcgcacgcacacacacacacacacacacacaacttacttctgaaatgcttccaaaatacatagcttccagatcaccccaatcctgccatctagaatattattaaatcacatttaatgttctggccactcaaagatagtcatctaagaagagaatgtattaggtccaggatccacggaaccagagccaactacttgggatttggggctacagcagagccagatgtcccaaatttctaacctgggaatttctgacatacagcacccaaaatttactgatagaatctcaggacttgcaggcagcccaggacacctgaggaacagtccacaacaagccattcagaggagtagggagtgggtaaggcagtctaagggggacaaaagaaagggaagtgggacaagatcatcaagagaaccaagaaagttcaaaggataatgtttcaaaggttcacaaggggctggaggatggagtcaagatgctaggtgctatgtgatctaagggcaaaagagaggaccagagaaggagcacagacatgctgttagtactggggcttctatttgatagaggcagattaagtgatttgttcaaggcccccatcagttaccttgaaatgtaaattcactctttcagtttctactctgatgttatatcccaccatgccatccagctgttcacaaagctggtgtcttttcctgaagatttaaacaacttagaaatattgtgtagtgtgtaggtgtgaaatagttgcttgactcctctgcggaggtggcagaaattttaaggtatggaaacttactgtgctaaaacctgtaagtgccatattctgaattaatagggctggatctttccagctgttcctggctagtggattaggcagcgtttccattttagagaaacaacactgaaatcactatagctacttaaaaaatctcaaatgtataacttaaatgaactgatgtagaggaaagcacagtggacaagaaatatggagacttgggaaacttggcttctagtgtcagctccatcactagatattctgtgttattttgactaagtcacttcctctctctggatgctagtttcctcacctgtgatatgagagggttggacttgataatctctaagggatctttcacttgtaacatttgatgattctgtaattcctggtgtgttttctctcctgacatttattcacaagggtcattctgccctccacacaatttaagtttttggcaaatcacagatggtctaaaataaaatctcccccttgaagaggggaaaagaacaggatgtttctgctgaaatagctcatgtcaggtatgacctttctaattcagagcagctctctagtggttcattaactcaccccatgggcagcacagcaagcaagtactatcacaaaaggccccaactgtgcagccaaagagagctgctctattacctgctgaaaacaaagtggtttcctctttgtgtccacatcggtcaatttttagatcaggaacatatgcttctatcactgaaggaatcctggccaactaatagaaaccatgtgccaagtctaacacctgctttgaagactaagctggagtcccttctacagggaagtgatggaattacttcgaaatacagatggtccctgacttaagatggttcgactaaaatttgtttgactttacgatattgtgaaagtgatatgctcagtggaaaccatactttgaattttgaattttaatcttttcccgggctagtgatattgggtacattagtctcctgtgacggtgggcagtggcagtgagctgcagctcccagtgagccacacgatcacgagggtaaacaaccaatactgtatagggtactgtgttgccagatgattttgcttaactgtggactaatataagagttctgagcatgtttaaggtaggctaggctaagctatgatattcggtgggttacatgtattaaatctattttgacttacggtattttcaatttacgatgtgtttatcgggcagtaaccccatctttaagttgaggaacatctgtaattgataagagtggttctcttttctagacaattaaaaatggttagaaggtttaatagtaattataatagcccatttttgtatagtgctttatattttacaacacatgctgataaatgtattttctcatttacattttcttaacaacccaccgaggtgaggagaataggtattactatcgccatctacctgataaggaaaatagggctcagagaagttaatgtttgtcccaggtcatagtaggtggcagcattgagaatggaactcacaccttgactttgacttgtccagctaactcaccaatatatttctccaattgtcctgttatacttgtgagaagttgtcaggaatataggttaaagaacagatcttagtacagggtctagatgctacaaagtaattttatgcttatttgaagacttctgacataggtttaatttgtcggaatgggatcggtggctaggagggctctgagaaaatacatataacacaatgaattcaattgatcattatatatctagagtcaaggcaaatatttactgaaaatctacacaagtgaccctatgcaagtgttatgagaacatatttaaaatataaaacatggttcctgacctcacaaagattcataagtggctgggcgtggtggctcacgcgtgtaatcccagctttgggaggccgaggtgggtggatcgcctgaggccaggagtttgaaaccagcctggccaacatggcataaccctgtctctattaaaaatataaaaaacagctgggcaaggtgacgcacacctgtaatcccagctactcgggaggctgaggcacaagaatcacttgaacctgggaggcggaggttgctgtgagccaagatattctgccactgcactctagcctgggcacctgagtgagactctgtctcaaaaaaaaaaaaaaattcacatgccctaaatagtgtataatgaagggttaaatatggtagtcacaacaataagtgctatggtggcatgggaaagagagaagtcagtgagggaaacattcatggaagaaatggaattaagcatttaaaggatggatagaatttaactggcggaggggaggaagaggatgattctagactaaagagtgagtaaagggtatgggaagagaacagcatgagctaaaccaaaggggcaggcatacatgaggttgcatatctgtgaggatactgatttgagtagagagcagtgggagaatgtcaagtagagccatgattcactctaagtgctcaaagggctgtctgcctttcataacattctgttcacttatgaataaaatgccattgaaggaagacataacaatggttaagagcttggcctttggagtcagacagacctgggtttgggtctcaggattaccacttacttgctgtattatcttgggttaattaattaacctcttggggcttagtttcctcttctgtaaaatgggcctgcaatgaagagcctatgataaaatcccaccaagtactgagcaaagtgctggcacatgaaagcactcattaaataggaaatgtaataaaggtgagccaatgaatgaaacttcatttttatacatttgttaagttttttcatatggaaaaactaaaaaaaaatttgatccaaccacttgctttaattttttattcaaattctgattcagaaaaccatgatggccatagctgtgggatggaataggagatgatgttgaacaagtaagttatggtttgatgctgcaggaccgtcatggttagtctgaggagactgccctgtggggaatatatatatgccttctgactaaggagaaggaaccacgggaatcagctcaagggcagttagcaaactgctggcaaaagtggcccaaggctgaaaactgctcatccttatctccatccacttgaccctctgagctcctttcattttctccctctaagaagcatttcttaaaggtatggtatgctggacacacttccctgccctcatatactttctgatggatgggaaattagcattttgttctgggtataatcgctttctaataagcaaagggtcagatacacggaggagtagtctaagaaacttcagggaaggaaaaccctggcttgagagaagtagaaggaaatatcagatgccaataacaataaacaacataatcccaggaaagagcaactgttacctgagcctggaaggtcatgaatgtggcgcatgctttcaaaataggagcccagggacatcgctgtaattaccaaccaaagagcctccccttagtaccagaaaaacagatggatacactaattaaagggggagagacggagaacaatgcaatctttgaatgtgagggactgaagagagtcaacctagctctgtttccgataaagaaaactgccctgttaactctgggtagctctaaccagccacagaaacctatgccaaatcaagtgttttcaaatagcattcaaatataattttcctttgtccagggtggactgcagtcttgcttttgaaataaatgaagcctgggaagccactctctatggccacatgtaccatttttcttatgtttaattcccctttctttttcagaggaaggggaaactcagattctaaaaacgacagcttgctgagcttgctggctgtcactgtttaaagaatggcttattaaacagatgatgtacaagcacttaaaaaagtaagtgctgaccagaaagccagtgtaagaacatgtctggtttggtacagataatttcctttttttttttttttttttttttttttttgtgaaagggctgctagaatgacatctttacagtgaatctttcacaactgccttataaaaaagatggagaaatgtagatcagaccagataataacttagctggattcctaactggttgaagaattgtactcaaagagtggtgatgaatggattgacaacaatttgaagggaggtctctaatagttgctacagggctctctacttgaccatgtcatgctcaatattttaatgtatgatttctggataaaggcataacaaacttgcttgctataactgtagataagacaaagttggagagtattcttaacttacttggtgatataattgggcttccaaaaaaatggtaccaccctttattgagtgtatttaaggcactactgtatataaactgtcccattgaaatcttaaagccaaataaactagggtttagagaggtttcaaatagcttatccaaagctacacagctagtaagtagcattgccaggacttaaacccaagtctgtctgttgtcaaagcccacactctttccaatacactacactgctagccactgctgtacactgtcttgacaaactagaccagaatatgctttctcctgaaaacaagacagaactgagcagaggctggaggctctgggaaacaagaaagaatcaaaccacatggattcaagagagctgactgtagctttcctgaaggattagagtagtgctagggtgacggtgaaaaccagcacttatactaataaactgctgagaatatttggagctagaagacagtgaatattgctacttcctggcattgttattatgtccagctttatttttatgagggaaagtggctggaatgatgggcccaaaactacgaaagcggaacataatataagaaaaaaaggtgggtgaccatagaagaatagaatgggggaaatatgacttcactatagttcatactagaaagagctaggagatttagtctgcaactttaacatgagccaacaacatgaaatgcctttcagaaaagtagatatacctcaggctgtattattagaagcactaagtggattccagagcctgagaagtaatagacacattgtcttctgctctggccaccattctgttgtgatgggcaaataacaacatttaacatcactagaggcttgaagtaactggggtgaagtgtttggaaactatttcctatgagggattttttttttttttttgagaaagagtctcactctgtcacccaggcaggggtacagtgatgcaatcttggctcattgcaatctctgcatcctgggttcaagtaattctcatgcctcagcctcccaagtaactgggattacaggcatctgccaccacacctggctaattttttttttttggtatttttagtagagatgggatttcaccatgttggccaggctggtcttgaactcctgacctcaagtgatctgcctgcctcggcctcccaaagtgctgggattacaggtgtgagccaccatgcccgacccctgtgagggaaattttgaagtaaatggaatatttagcttagagaggagaaaacttgtggaaactgtatttgaaggaccatcatgtggatgaaaagattagacttggtctgatgtgttttatattacaaagctaggacccagaaggcagcttatggttcaatataagaaagaaattcctaacaataagagtggtccaacatcgagtgataaggataataggttatatttaatgagtgtttcctaaatgcctagcactatggtccattgttgacatatcatttcatggaatccccataagaactctggaagggccatggacaggggaatggctacactgtaaagcagggatcttaatgtcacatggaatattcaaatacaggctagattaatagctgtcaggaatgtgtcatatgcaattgtgtattgggatgctggtggtggtaggagagttgaattagatggctctatgagttccctgtctgatataagactcagtaaatattctactttatctgttttcaactttataacattaaatattacgagctgatggtccaaagatagcattttgaactcttcgtaagattgctgctatgtgtctctgtttatacactcacacacacagagagagacacatttatttatttttaaatcatatatatgccagggtttgaaaaaagataaggatatcatttagatatgtggaagttttgaacaatttgaaatcctaacaatttttaatttattaattaaaccaatgcaacaacatgagaaaatagcatatgctgcatttatgataggcaggaattgaaatatacatcattttgttaaaaatatacaatgagaaaaatgtagaaaatgtaaatttcaaaaagctttcatttgaatgactggattacaggatgattctctggctctctgtggagtataaacataagaatttacagagctgtaacttcaactttctgtccatcactgtgctagaataggggttcccaacccctaggctgcagactggtaccggtccgtggcctgttaggaactgggccacacagcaggaggtgagcagcaggtgagtgagcattacagcctgagctccgtctcctgtcagagcagcaacaacattagattctcatagcagtgcgaaccctattgtgaattgtgcatgtgaaggatctagggtgtgtgttccttatgagaatctaaataatgcctgatgatctgaggtggaacagtttcatcccgagaccataccccccgactcagtctgtggaaaaattgtcttccacgaaaccggtccctggtgccaaaaaggttgcggacggctgtgctagaagattgaagagtattaccacatttaatctttgcaatgaccttataagtttggtatgaagatattatttccattttacagttgagaaaacagagtcttaagatagaaaagttaaacagcagtgccaagattcaaacacaggtatttctgcttcatactgtctactgtgctaaatcagtaccctcctcttttctttcctctgttaacggaaaacattttgaaaatatgctaaagtatagcacaaatgataatggttattattaataaacaactacaatgtccaatatccggattcatatgatgcttgtcttgaaaaaaaaatttactttgtaacagaaagcttggtctctttagcacagatagggacacatttggaggatcctggtttgttctataggcttgactttaggatcagaacaatgtgtttgaagagctattggagaataaaaaggcacagtaaaaagtgctcctcttctttccacaatctagattctaaagtgctgagagctgagaaaccaaacagtacatgtgataccacctactgcttattcactacatgcagaaccctgcaatggctatttatgaagacccagagaaagaagaccaacttctttccatgggagagctctcaatggaagagtgcccttaatgaaggttgtaaagcaatgcagtgaatttcctgaccagtctaagaactactgctgtatagatagtcgtctttttgatgaagcttcatgttcaccctcccttccctactagtataaaccattaaagtttagaaaaagtcctgcattcaactgattcttaagaatttaaataaggagagacaaaagatggcactgaagtactaaatactgccagaaaatatttggttggctagctccaactttaggcccttggtcggaatctatcatttgttctctgcagcctgtgatgaactataacctctgaatcaaagagagcatacgttctcacttccaagaagccatctatgctgtaaagaaaaattgctactgtgacaattcaagcaactggtgagaaaggtgagtgcatttcccagcatacacatttcttttaagcttcccgttaatgagcagcaatggacttcccagaagacactgtactcaccatttttcccatccagacaggacactccaggaacaattacaaaatcatgaacttcagtcacgtctgctgtctgacatagcttcatttccctagtggactaatgtgtacctgcttcactgccaacacaagagtcctcataaactcatagcttcatctttccttattttgggaccttgcttttggccttctcttatactttagttaagatgccctccttgttttagctattgaggatagtaagataacagctgcaaattagttcttggtgtctatcagaagtcagatttcttctgccttaattagtactgctttttaaatatcactgctatgatttccaacctgatatgtacctagggtccccattttcctccaacaagaatttcccactgccaaaactccctaccacaaaggaaagcagaacaaacaatcaagctagtctctaaccacaaatcaatcccatttccaactagctgatgaaaaatgtgagagtgacactagggtctaatcaagggaggatgggaagatgattacatttttgtctgttatcctaagccccaaaccaagctgggtggctgtgtctgtgtgtctgtctggcacagccagaaccagggctcccatgaggaccttctctctccatcataacaggacagctatgtgcaagtcagagatgagtaaacgtttggaggccagttaagaggctattagagtataacatgggttgctgacagtgaaaatataaaaggagaattatctgtgcttatctcctactcttaaatattaactgggatatgaaggagactggtgtcatggagttttcctaagttgtttgatggtgcaagctgcttttaggtttgggtggaagtgtgatttgaggcatttcccttggccagggaggcaggggagtcaagctatgaaaaatatttgtgaatcatggtttaaacaagtactctaaatgaagcccttaaacgtcacatgagatcttacattgtactctcctaaaagacagaacacaagtctactaagtttttgttttttttttcaactcacttaagacagcaattagcacttagcagaaagtctgaattcccccaaacctatttatatgagaaatggccttttaaatgaaaagtctgaataataaaaaaaatggaatcagttactcagcataagaccctttcaacaccaagggtttccacttattttcagaatttaattctcttgttcaactttgtaataatccatacagataaaagaaccccaagtacctcctggtttcagcagaatattgatcactacctctctgaatttgctttggagtttcaccccttggttgactcccagtactatatacagatgacctgttttaagacacaaagcagctctgagctgtgggcttcatgcccctgaagcagggttttcaaagagcttctctgctgagcaagctctttccacagtgcaattaggctcagccagaggacaaacagttcctcatcctatgtgtcttccattaataaagatttgcagcaatgtgtaccagacttggagcattactcagatctaccaagtccccagtttggggaagtggctctgattgattttggagtctctggtgtctttggacagatgtattcattcaacatgtggaggcctgcgggcaattcagattttagctgaggctgtagccaccattaaaacaggactgcagataatagcaaagattacaagcaaatgtagagttacatagttagaggaaaatactcattaggctcttgttttccccaaagttgtgaaaattcagaataaaaacaacaaagggcacagaaggttggtgtggcaaagtcagagtacatattaagtacactgcaacacattcagtacatcctgattttcaaagagaactgaaccaggaatcaagaagccataactctgtcatgtcacttcattttgagttaataagagctaacatattaagcacctatttattatgtgctagatactgtgggaagtatattactccttacttacattgtctcatttatttcttcacaaccactgtaggagtcttattaccttccccactacacagaaagcaaagagaagtgaaacacttcctgaagtaatacaggttacacagagcttaggtcagtttgatgcttaagcctgtgttcttaacctctttctatcactgcctgtcttctacattaagctccctacttagtagtctactctttttactaaattatattgactcccctctttaatttcttcacttactagactattacaaagttgaacaagagaattaaattctgaaaataagttgaaacccttggtattgaaagagccttaagctaaataattgattccattgggggacatttggatgggatgatcctagaaccaccttaattctaaaaatacagtaatttcataaagagtgaggaaaaaagctattttttctaggtgattgtggatatagttccagtagacacattccaacttggatcttaaaccctaggctgagtgactttttctcctgcgaatgttagttgcttgatgccctggagtactgaacttcctattcacctctctatgatggtggaatgacctctatgaagcaggctggggaattttctaagaaaccaggtcactgctgctgtcttagcaaagcacaaacagtgtagacctattctcattctctagttcccatggttctaggaggtaggctgagcctggtcctcagcatttaattcactttgcatagctttcttcttcagggcaggagctgggctaagatcatcttagagtctggcacaacaaaaaggccacctatggagtctactttcttatttatttgcatattttcatacagttggggcagcaaatattagatgcccatcataattaagaaaaagcccaaagtcccttgaagacatttaaagtgaaatgcctacaggaagaagagaggtttcctctagattttttattttaaaaaatgaaaataatgttaaacttcttggcactgcggctgaatattaagtagaaacatcttagggaaacttgcctgagagctatatgaattctaaactatgaaaacaagacactcagtagaaaactgtaaaggagaaaagcggtcagtttgctttatcaaagaaacaaagcattttcctccagggagaaaggaagcatgatgggaaatctgcaaacaatggacttctggaaggtttcatgtgtttgcttaaaaaccaaaataacaacaacccaaactccacagtactgacaggggacaagtgttctacctaatagcacatgggccatgggatatttccaaaaagcaatgatgttcagactcagtccccttgcgagcatgatttgaataatttttgccagacaccaccttcccccaagtctctaccatgatctagggacaatgctaaaatttctccctgttgtcactcatctaaggctcaaaaggaagagcatttgtagtagtgatggtggggcctttgacggtaagagtgagagggcacctctccatttattttgcaatttgtctctctgcttgcatttttgtctatgtcatagcacatctgtttttctgtctatttttctttctgtttctctgtccgtctctcagtccatccatcaattcctctctgcctgtgtctccttgtctgttttgacactctctctgtcttcctgcttcttgtcactgtatggttctctctctcaggttctgtctctttgttgctctttgtctgttgctcagtcagtgtctttctttcttctctctctctgttgctcccttcctccctctgcctgtctgcatctcactctgtctgtctatctgtctctgaccaacggcttctgacaatctatttacttttctctcattgtttaaatatccctgtttaagtgtccctgtctagttttcagtctgtctgtcttttggttggtctgcctggtgctctatgtctgccttcctgtctctgtcagtatctctgcctctctgtgcctctttgttcatttctttgtctcagtatctctgttaatactttgtctcttttgtctttctgtcagtctctgtatgtgtctctttttgtttctctgtctctgtgttacccatctgtctgtctgtactctggttatctgtccaatctgtctgcctgtttctccaccagcctgtctgtccacttgtttctctgggtgtctgcatgtatttatctcagtctttacttctatctctttgtctagctgactatctttctctataatttttttctctcaccctcttcctctctctcgggctgtcagccttgctgtgatcctctcagtttctctgtttcttgtcttttggcctataacacatggtatctgtccaactctttcagtctcccatctcggtcagtctctttgtcttggtttgtctgttgctctctcttcccaagtctgtctttctgtctcacagcctacgtttttctcttgtcaatctgtcttcccattcttctctgttggttttcatttctctttccctctgtatctgtctttctctgcctgtctgctgctctgtgcttcttgccacattagtccctctctctgtatctacctgttctgtctctttgtctccctgtcttttgactctattcgtacctctctgtttctatccatatctctctcattctataataagtgtccctctctctgcctgcctacctgtctgggtatctgtctgtctgtgtttattctttcctttagtagtttggctggctggctcactgtctctcaggctgttttcctctctctctttctgtcacaatgtcaccattttaaagtgaacaattcagtggaattaagtacattcacactgtgcatgcaagcactacttttatctagtccctgtccccaaatattctcatcactccaaaagaaaagcctgtactcattaaacagttgtcctcccttcctcccttcccctagccaccggcaaccaccaatctactttctgtctccatggatttacctattatagacatttcagagaaaaggaatcatacaacatgtgacattatgtgtccagcttctttctctcagaataatgttttctaggtttatctcccttgtagcatgtataattatttcattactttttatggttgaataatattctaccgtatggatatatcactatttgtttattcattcatccattgatggacattaggtttgtttccacctttttggctatcatgaatatagctgctatgaacatatgcagctatatatgcatgcatacatgcttgtctgagtacctgttttctatccttttggatatacccagcagtgaaattgctggttcatatggtaattctatgttttactttttgaggaaccaccaaagtgttttctaagtggctgaaccattttatactcctaccagaaatttagaagggtgccaatttctccacattcttgaaaacagttgatattttctgtcttttagattctagccatcttaatggatacaaagtggtatttaattatggttttgatttgcatttccctaatgactagtaatgttgaacatcttttcatgtgcttattggccatttgcatatatcttctttggagaaatgtctatttgagtccttagcctatgttttgattgagttgtttgtctttttgttgttgagttgtaagagtcctttatatgtcctggatactatacccttaccagatatatggtttgcaaatattttctcccagtatgttttctctcattttctctatgtctttctgatagattgaatctattacactgcctctttctgactacttctctgttggtgtctttgtatcaatatgtcccggacatgactctataaggctctacctgttccttctttcttcatctccctccttaacctttcttttttagtctgtctctttccttccttccctccctccccatctgtttcctctatttccctgcatgtgactccctctttttctcactatttctccctgccctcattcatctctcagtttgtctctctgtccatttagttggctctctatctctctactttctgtcttgctctctgtgtctttctgattctccctttattggttagtctatcagttgctttgtttatcaccctatctctctcccccagactctcttgggtctctctctctctccatctgcatctctctctgtattgccttttctcctatgcctcatggccctccctttctgtctctctaagtgtcttgtctcagtgtgtctctcaatcactgtctcagtgtctctctccggttctacctgattctcctgacactttttctgtgtctacctatctctctgcaacagtttctttttgcctctttctgtttctctctctccttgcctatttctctcgtcttcctgtttttctgcctgtctgtctcttagtctatcaggctttctttccatttgtctatctcctcatctctttctttctctttcctttgcctctcccatatagctccatctggccaactctctctgtctgagtgactttcactgactctctttctctcgctatctcactgtcttttctatcttgctgtctcttgtggtctctgcttctctctatgatgatctgtctctggctctgtatgtatctccctcacttctttctctgtcccttgctccttctgtgtgttctctctgctttgtctctgtctctgtcttcctgtatcacattctaactcttcatctctctgcaatacccgcaacaccccacttctctgtctatctctcagggtttgtctgtccatgtgagtgttatttgcttcttttctctttctgccaattttactctctctcttttcttcttgactttctttctcactcagtttctctctccttctgtctctctttagttctttagctttctctgcttctgggtctttctctctctaccctgttttctctctctctttgtgacctccccattctatctcttctgtttcagtgtgtccccatatctctctccttgttcctcactgctgtctctgttcctccttttctccatctttttctgtttgccagtctgccttcctttccacctgtctgcttctctttgtctgtccatctctctttgtatgcttccatctctctatattaaccagttgatctctatacctttatctatccatgtttgcctctgcctttctgtttttccatctgactggctctgtctctccttcttggtctatccttccctgtctgtctatccctgcctttatccacctctgtccattcctatctttatattcgcctgtctatctccctctggccatttgtctgtctgtctctgctcttctttgaaagcatgtggtatttatctttccatgcctgacttttatttccaggctgatccattttgctgccaaagacatgattccattcttttttatggctgaatagtattccattgtgtatatatgccacattttctttatccattcatctattgatacacggttagtttggttctatatcttagctattgtgaatagtgttgcaatgaacatggtggtgcaggcaactctttgatatactgatttctttttccttggataaatacccagtagaaggactgctggatcatatggaaaggggtggggagcatggggagaggttggttaatgaatatgaaattatagctagataggaggaatgagttctggtgttcttcagcaatgtaggatgaatatggttaaatatacttattatgtattttcaaaaagctagaaaagaacatttttgaatattattaacacaaataataaatgtttgaggtgatgagtatgctaattactctgcttagatcattacacattgcatacatggctcaaaatatcaatctgcatcctataaatatgtacaattattatgtgtcaactaaaaataaaaggaaaaatatggaaaaagacaaaaaagaagctgaagtataaaatttctttccaacctgtgccagttgaacacatgaatctcagagaatggacttatagtctttggcttgcgaaaaatgcatggattgtactgacttacgaaaaataagtctaacatgtctacctagtacttgaaaaacacaagtatacaccaactttggtatctttcaaacactgtcacttagttgtccactagtgaaaaacacaacaaaaatctatgtgctcagcaaagacatagaatcaacccaggtacctatcaatggtggattggataaagaaaatgtggtacatatacactgtggaatactatgcagccataaaaaagaacaaaataatatattttgcagcaacatggatgcagctggaggccattatcctaagacaattaatgcagaaatagaaaaccaaatactgcattttctcacttataagtgagagctaaacattgggtacacatggacacaaagatgagaacaatcaacacgggggattacaaaagggggaggggagagaggaagggaagcaagggttgaaaaactacctgttgggtaccatgttcattacttgggtaacaggatcattagaggcccaaacctctgcatcatgcagaatactcatgtaacaaacctgtacctgtacccttgaatctaacattttaaaaaactacatgctcagagcatgtcttgtaaacctttcatttggcttatattttaagtaagcttccagaactcaagaaatttgagaaactaggagttaagggacagactgcatcacataaaatatagagtctgaacagattgtttttgaaaattacatcaccactgaaacatacagtgatccagaattctgcagactaaattacatcagcacaatcacttgattttagtctaacaatctagtttggtaatcctatgatgtaagccctaataataaggaaatcattgaggcattatggaacaatgtcattaaacctctctgtgtctcagtttcctcatctataaaatgaggctaatgacagtaaatgaccttataaggttgttatcagaagtaaaggggataatccatgtatagttcttagaacagtgcctggtgcagtaggagctcaaaagaaaatgttagctgttattttttctattgttgttgttgcaattcttatcactgttattatcatataaacatctaaatagcactggaatcaggagagctatgtgactttggtaaagtctgctctctgggaagtttccttaactaaaaaatgaagatgtacctctaaaatttttatggttctatggtcctaggattccatgtgtttctgagtactaagcacatggggtcacatgtttttttaatttttaattttcatgggtacatagtaggtatatttatttatagggtacatgagacatttggatatagggatgcaatgcataataatcacatcatgaaaaatggggtatccatcccctcaggcacttatcctctgtgttacaagcaaccaaaccacacccttttagtaatttttaaatgtacaattaaattattttgactatagtcaccctgttgtactatcaaatactaggtcttattcattctttctatttttttgtacccattaatcctcccctccaccccaccaccactacccttcccagcctctggtaaccatccgtctactcactatcttcatgagcatgagttcaattgttttgatttttacatcatggggtcacatttttttatcaggctccatgatgtaatttttatcctcaaaagttgtcagacctatgttacaaaggaacaaaaaagccacaaggaaaatctgtttttcaaacatttctaaagctaacctgacatctgcaaacctctgctttctcactgacttatttagctcttacgggatcccacaacaaaaagcataaattcaggaatgacatccattctttctccaatgatgcccatatcagacagttggcgtaggtaacatttccacagatgtggacttcacccttgagagctagagtgccatatttttaaaagaggatattgtactttgcttcaaattgctgcctgcggatgttgtacccttcctgggaaggctatttatggctattgtatgttttttgtgaagactgtctaggatgtcatagctttcctggaaatagtctttgcatgttatatcttgcctcagaatggacgttgcttctttcttggaaatgctgctcatggatgttatcgtccctgggatgctgtctgtggttgctgtaactggcctctgaatactacctgtggatagtgtacttgacttttgatattcactgtggctaatttatcttctgacccgaggggccctccactgaagctgcttctccagtgcagtttctgagggagaactaagaatatgtttctggtacttgtgggtttgtaacttgattcattaacattttctccagactgaatggatctcatgccctaaactgtgttcaataaatataatctcttgccatactctgcccgttttctggatggataagctgcaggtgggaagctattgggaaagaggaagaatactaattggtaaattgactttgggtcttggacaacagcttgtagtacaaaaactctaacttattagctaaactaggcaattggcaatagttgcctctgaaaaagatgaaaactggaagcacaaagcatattcattcaggcaataatgtaccctgtactgtggtaaatgaatcttcacctttgtaagcacagtgctacataattgttcagaatatttcctgtgactaaagcataaaattttcatacgtcccataagaattctcaaatcttaattactcactcttctattttcttcatcttcaatattttccttaggatgaggatgtcaaattccctgtgggaatgtggcaacatatatttatcactaaaacctatcttgtctctgctcccctaatcctgccagcattagcatacctgtgctcattcatacacatgctcgttcccttacaaattcatgtctcccactcccatagacatgcacaatgcattttgtccaagctgtactggtgaaagaataaggtcatgtagctaaggaatattgatcttgaggggcagattcatagaatttacacaatgtagctccaagaaagatcctgattagttcctgcaccttcacattctctgcaaaaaggcatgacaggcagcagaaaataaccttttgtggttaaaatctttgtgctttaagatgaccagggaggaaagaggtatgatggggaagaggtcatcaattcaaaaatggcccttcccagttcttatgtttcaattcttttaccactgcttttcagaatggggatttagctgtacttaagtgtcctgtcccttaggtggtcattcacttgtcttaatattttctttttaattatacttttaattagaaataattatagattcatctgcaggcataaaaaataatacagagagatactacgcattctttttttttttgtaagacagggtctcactcggttgcccaagctggattgcagtggcacaatcacagctcactgcagcctcgacctcccaggcttaagcagtcttcttagctcagcctctcctgtaggtgggaccacaggcacacaccaccacccctggctaatttttattttgtttactttctgtagacatgaggtcttgctatgttgcccaagctggtctcaaactcctggtttccttgtctataaaatgaggcttatgacaataaatgactttatacagttgttatgagaagtaaagcagtcctcttgtcttggcctcccaaagtgctgggattataggcaaggcatgagtcacctgctcagccaatactatacattctttacccattttctcccaatggtagcatcttgcaaaattacagttcaatattacaaccaagatattgacattggtgtggtcaagacacagaacatttccatcaccacaaggatctctcatgttgcccaacttttatagtcataactacttctctctcccacatactatcttcttaacccctgacaaccaccagtctgttctccatttctataattttgtcatttcaagaatgttatataaatggaatcatacagcatgtaacctttcaggcttggcttttcactcagcataattctctggaaattcatcgatgttgttgcatgtgttgacactttgatcttcattatacttaattagtatttcaaggtacaaatataccacaatttaactactcacccattgaaggacatctgggttgttcgtactttttggctattataaataaaaagctataaacattcatgtatgaagtcttcatttctttgggatcaatgtgcaagagttcttaggcattttaagaaacagccaaactttctccccatggctataccattttacattcccatcagaaatgtatgagtgatctagtttctctgaatcctggccagaatttggtgctgtcattattttttgttttagccattctgaaaggtgatatctcattgtgactttaattttcatttccttaatggttcatgatattgaccatcttttaaaacacttatttgccgcctgcatatactttacatgaaatgtctgttcatgtcttttttcaattttctaattgaattatttattttttttaccgttgaatttgagagttctttatatatcctagatactaattctttgttggatatgtggtttacaaatgttttctcccattctgtttatcctcctaacacggtctttcccagaataaaaatgtaattttgataaagtctaatttatcaatttttttcttttatggactgtgtttttggtgtcaagtttaagaattatttgtctaaccttaggtcctgaaaattttcttctatttttttctctaaaagttttataattttatattttaaatgtaagtccatgatccattttgagtatatttttacaggagtaaggtttagattgaggttcattaattttacccatggatgtccaatttctccagtatcactgaaaaggtcagatgccctccactgaattgtttttgcacatttgaaaaattaattttgggaggccgaggcggttggaccagctgaggtcaggagtttgagaccagcctggccaacatggtgaaaccccgactctactaaaaatacaaaaattagccaggtgtagtggcgtgtgcctgcaatcccagctacccaggaggctggggcaggagaattgctggaaccagcaatgagcccagatagcgacactgcactccagcctgggtgacagagcgagactatgtaccaaaaaaaaaaaaaaaaaaaaaaaaaaagtcagttgggtgcatttatgtgggtagttttctctgttctctattctgttccattgatctgtatctgtccacaagcaccacacagtcttgattactgtagctatatagcaaaatttaatattgtgtagactgattcttcccactttatttttattttttttttgagattgatttagctcttataggacttgtgcctttctacataaatgttaggataatcttgcctttatttcagaaataccttgctaaaattttgatagagattgcattgaatctaaagattgatgtcatgagtaccgacatatttactatattgtgatttctacatgaacataatgtgttactccattcatttaggttttatttgatttctttcattagtgttttgtgattttcagtatacagctcctgtacacatttcagtaaatttatatttaattatttcattttatttggattacttcaaatggtattgtcttttgaatttcagtgtccgtgtgttcatttctaatatagataaatacaattgatttttgtatgcttatcatgtatcctgcaaccttaatggactcacttattagttctaggagcttttttgtttctttattccttttgtagatttcttgggattttctatgcaggtgatgtcatctgcaaataaggacattttcacttttctgatctgtaagccttttatttcatcttccctcatttttctgatctgtaagccttttatttcttcttcccaccttatttcattggctaaaactaacaacattatgttgaataagagtgtatatccttgccttgtttctgatcttaggggaaaagcaattcagtttttcacaggtacatacaatgttagctgtaggtgctttgtgaattctctatcaaattgaggaagtggctggacacggtgaggaagtggctcccagcactttaggaggctgaggcaggtggatcacgaggtcaggagttcgagaccatcctggccaatatggtgaaaccttgtctctactaaaaatacaaaaattagccaggcgtggtggtgggtgcctgtagtcccagctactcgggagcctgaggtggaagaatagcttgaacctgggaggtggaggttgcagtgagctgagatcatgccactgcactccagcctgggtgacagagcaagactccatctcaaaaaaaaaaaaaaaaaaaaaaaaaaaaaaaaaaaagaggaagttagcctccactcctatttctgagaggttttttttttttttaaatcatggatgatgtttaagtttttcaaattctttttctgcattgtttgacaaaattatgtgatttttaatctgtagcctgtgaatatggtagattacattgattgattttcaaatactgaaccacccttgtagccctggaataaaccctactttgccatgctgtgtaattctttcaatatattcctgaatttggcttactaatagtttgttaaggatttttacgtctgtattcatgaagaatactggtctgcacttttcactttgggctgcttttatctcatttttagtatttgtgtaatattagtctcatagaatcaattggaacttgttctctcctcttctatttcctggaagagattttatagaatttgtggtaattcttctttataagtttggtagtattctccagtgaaaccatctcgccccagagatttgattttgggagattttaaatgatgaattcaactttcttaatagttatatggctattcaaattatccatttaaacttggatgaattgtggtagtttatatttctcgaggaagtggttcatttcatgtatgttgtcaaatttatgtaggtagaattgttcatagtagtcccttagtatctgtgttaagtcattcttgtattgctataaataaatagctcagactggtaatttataaaggaaagaagtttaattgactcatcgtactgcaaactttacagaaagcatggtgctggcatctgctttgcctctggggaggccttagtgagcttttactcatggacaaaggcaaaatgggggacaggcatgtcacatggtgaaagcaggtacaagcaaagggctggggcagggggaggtgccacacactttaaaatggtcagatctcctaagaactcaccatcatgaggacagcactaagtcattcatgagggttctgcccccatgacccaatcacctcccaccaggccccacctccaacactggggattacatttcaacacaagatttgagtggggacaaatatacaaactatatcattattgatagtttgtactgatagcctctgtttcatttctcatattggtactgtacgtctttttttctctgtcagtcttgctaaaggactgtcaattttattgatatttttcaaagattcagttacttgtttctttgttttctgttttcaatttcattgatttctcttcttatctttagtatttcttcctccgtcttgattttagtttattttgttcttatttctctaaacttttaaggtgggaacttagattaattcatttgagactttgcttcttttctaatgtatatatttgcaactataaatttcctcctcagcactactttagctgcttcccataaattttgatatgttgtattttcattttcattcagttcaatgtgtttttaaaatttttatacttggttgggctcactcctgtaatctcagcactttgggaggccaaggtgggaggatcacttgaggccaggactttgagaccagcctgggtaggtaacatagcaagaccctgtcactacaaaaaaaaatttaaaaattagctgagtatggtggtgcatgcccatagtcccagctactggggagggtgaagtgggaggattccctgagcccaggaggtcgaggctgcaatgagttgtgatcatgccactgtactccaccctgggtgagagagcaagatgctgtctcataaaaattgcttgagacttttgctttgacccatggtttatctagcagtgtgttgtttagttttcaagtctttggagattttcctattacttttctgttactgaattctcgttttattccattgtggttggagggcatgctctatatgattcaaatttttaataattttttgaggtttgtttaatgacccacgatgtagtctatcttggtatgcattgtgtgtttaaaaagaatgtgtattttgctcttgttggatcctattctttgattattttgctgagtcctgatacccttgtggattttccatctagttgttatatcaattattgagagagggatgttgaagtacttaactatagttatggatttgtctaatcctcctttcagttatatcggtttttgtttcacacattttgcagtactttggtccatatgcatttagaattgctatgtgttcttggtgaattgatacttttatcactatataatcttcctctttatccctagaacttttctttgcaatgtagtctactttatcttatattaaaatagtcactcttgctttcttttgattgttttcccatagttttgcttattgtgttctttcttccttcctgatgtttcgaggtttcaggcaggggaggggggtgttattgcctcattattgccaaatggatgtagaagtccaggttccctactcaccttccagtgatatctgagggaggtagtctccttgttactgatgggcaggggtgggagttccagctccccagtagtctccaatgacactttgcaggagtggttttttatttctgggtgataaatacagtcgtgaatctcctggaggtctcctctgataccactttagtgggtaggagcaccttcataactgttaactgtcagagacaaacagaagtccaggctccccagatggcctttcctgttacagtgggataggagtgggttggatcattgtggccagtggggatgaaagttccagcttcagcctgggcatggcagctcacacctgtaatcctagcactttgggaggccgaggcaggaggatcacttgagctcaggagtttgagaccaacctggacaacatagtgagacctcatctctataaaaataaaattttaaaaaaagttccagcttggtactttgccttctctgatatgatcttggtggagacccctggcagaagtgttgatgtgcctcattaaagcttcatgaaggtagaaatctatgctccctacttggttgggagtgggtaggagtaggaccacaatttgtgtgtgtgtctggtgtctggctagagtagagagcttagctattgtctacaagttttccttgttactaggcttcctagtcctttggctaaagagcgtacgcttttgttggggcttttattttgtctgtacccattggtgtttctgagttaccagtttttttcaactccaagtacgagatatatgaggcaaaaccaaaatctccgagtatgagatatgaggcaaaaacaaaatccaaaaaacttgaggaatgtcacgcctcaagttctgatgtccctagacaatctgccttctctgcagctttcagccttcttaggattttttaaatatataatatccagggtttttagttgtacttagtgggaggaataggaaaaagcacatctaatccatccttctggaagtggaagtttcccgatttgtcttaaattttaagatgctcatggttaaagggacatatataacctaatttcttcatatgatttcatcttctgctagtcttttacattttttcccattacacattgaacccccaaccacaaaagaacactgagatccgataaccacctccaagtcattttttctccattgagacagtaaaacttgtttcctaaaaaggtatagtacagtttttttttttttttgatggtgggaaaagaagagtgtgtgtagcaaagaatgaagaaaaggtactaggtaaggtccaatcaatcaatccatcaatcaatcatagctaacagacttgcagatccaggctaagagcacaattttttctctaacaactgattcatcatacaccttagttttctagcacattgccctaattcagtaccatctgccactattagattaatatacaattatgattttgagtaccaaagtcataatatgcagagcttaaagcttttgttgttggtaacatcctaaaagtacatctatagagtaatttcataattaacaaaaaagtacaatttaatgaaagatgtttagtggatttataaaaggttgaaatttcagtaactattaaattttaaactagtttgcttagtcatttggggtgatctcatgcaaattaatatttctcagaattattaattatcagacacaataggaagataatgattgcttgacagaaagaaaaatgaggagtaggaggaataagtaatgctagcaatgacaactgtcatttacccagccttattttatattaaaagcattgggctacatactttatgaatttgtatttattttagggtctcaggtacattaaattggaccagtcatgacacttggttcatgacacactctcagcagtggtccgctagttatttagccagttattttaagtaatgtaataagcacctgtaaacctacaacccaaaataaaagctaagatcttgataataatctacatctaaatataagagttattcatccccatcctacctccctccctcctcctagccaaggtaaccatctcctaaatcctgtgttcattatccacttgcttttctttttatatagttttattatacctatatgtaatctcaaaattatatgttttaattttatatttaacttcataaaaatataacatgctctatgtaatcttttaggccttcctttttcacctaattttatattgctaagattaatccatattttgtgtgtggttgtagttcatttgttctgaatgctgtataatatgccactgcatgactataccacattttattaatctattaataatgctgatgagaatttaggttgtttctagatttttgtattgtgaattgtgctgctttaaatatgcttgcatgtgtctcctgttatccatgaatgaatcaaagattctcttgagtatttacctaggagtacaattttggggtcacagggtatatgtatgttcaactttcagagaaaatgccaaaattgcttgcagcaatttgtatatattcctacaaataacacataagaaatcatgtgcttctacatttctgggctttttattattctcaagaatttcatatgtctaacactttcctttcttagcatgggttcctcatctgaaccacagaacatagacaattatttgagtgtctatctatattctcaattctctaaaagatagtatatatctagtattattctaattacataagaaagaaatcaattatttatatgcaatagatgtcttaaggcattagtactttgttctttccaggaaccccaatttagaaggactgcttggtattgtcactttttattttttgtcaaccaactgggtataaaagatatcttatgtgatttgatttgcattttcctgattcataatgatgttttatctctgaacaagctaactggccaaatgtgtgtgtacaattttctgaaatgtctgttcatgtcctttgtccattttttctatgggactgcttatgttttcttaataatttttccaacttctttatgtattcttgatattatttctttgccagttgtattttaagaatattttctctcagtttgtaacttgtcttttctcattctctaacatgtattttgatgaaaaaagttttaaattttaatacagttaaatgtaccaatcttttattttatagtcgattctttttgtgccttaacacatctttcactatttcaaggttaggaagatattctatgatattttctattaaaagttttggaattctgttttgaaatgtatactcttgtaattgatcttgtatatatggtgggaggcaggttttattttcatttttcttcatatggataaccatttttccagctccatttgttagtctccaaatttcccactgatctgacatgctacctctgtcacacatcagacctccatatgcacatgggtctatttctgggttattatattctgaagaattttacattcattatttcatgtagtcttcacaataagtaatttgacattatttcatgtaatctgcaaaatcaccttatgaggtaggtgctattttctccattttacagatttagaaaatgaaagcttagagacactaattactggtaagatcacaaactaatctatggatgtcagctctaagccgaagtttccagagcccaagctttcaagccataatcaatactggctcttactctactacttcataagaatgttgcaaaagtcagtaaatatcacaggcagtaaactatatgtttagctctgtattagttactgggtggggtgaggtagggtcaaggatactgttgtgaaggaaagacaaaattgtagcctttgttcattttgtgtacccttaacttgctttattattattgctttttgaggtaattaagtaccagaacttatatatctatttgtttattatctgccccactcactagaatgctacacgagagcaggaacatatattgttttatttactgctgtatacctatcaactaaaacagtacctggcacagagtaggcatatgataagtatttgtggaatgaatgaatgtatgaatgaataaacatgataatgcttctgtcactggaatatggacaatctcacggaaaatattttgagttcaaaaaaatcctatgaaagtaggaaaaatttactcattcactcaatacatgtactgggtacctactatgcatgtagcactgtgatgagtactgatagaagagatacaaagatgagtaagacatgaaccttgacttcatgaacttacaagctagtagaatctacgtgtgcatataaattcctataatacacaagaaatagtaagtgctataagagaaaaatgctaatttgaacacaggagaatttaattcagactagaagatctgggtagccttaatggtagaagtcgccatgttggagcttggtcttgacaatgtttttccttcaaataagatgaaaactgtggaagtgcactgcatacttatttagccaaaagttactacttacagatatctttgcataaagtaacccacacagtggtaaaacattttcatttgggggagcatattggattttgcctggttaagaggaggaggatatttcaggtagagggaatggattgaaagcatagggcatgttttagcaaggagttgaatgttgctgtaactgggctcaagggagacagggtggctggcatttgaagtcaagggttcaggctatttgacacttttaagagactaagtgacagtggaggaggcaggcaggtcataacaggcagttattttcttttctcttctttctcccttgttatgttacttcctttctcttttctttttcccatagcagaatgcaatgaaaaagaagacaggatagggagtctgaagacacaaaatcaaggcatagttctgatactgaactgctgtatgtttggaaacttaattcaattaaagctgggggcagggagcagttttctaaaactacacaaatgcccttctccctgtaaatgttttttgttagctgctccaaaaggaatacctccttctagctgctatcaccctctcacaaggatcactgctatagtgtcagataaatacacccttaggcatgttggttgagaatcactgaacaaaatgatctctaagtgtcccctctttccaaccaccccagcctgctgtccaccaccttgccacattatctgattcttttcttattcccaactaagctttcagtctaacagtagacttgtatatggggattgcttggtctttctggaggtgcacagggctacaaattcttgtcctggaggaaaactaaccatgagtggccacagaaaactgaaagacttgagcacctgctccacaggcagggaaggggataaaattactgggctgccactaacttgcaaaaataactcgggggctatcctggatgcaaaagcagcctgatcctttcaaagaacaattgtgagaaatgatgtgtgttgtggggagggcagagaacagagtgacagaattctaaattatagagctatccttcaaggcctaattctttagaactttctcagatatagtttggatgggagtgacagggtagggtagagaggggaagaagatgatcggtctaagattcatagtcttttttttaagctgacttactcttaagaaagttttaaattgcacacaaaggaaaatgcaccctccgcatgacgctctatgaagcctaattattggagcaaatgtttactgaattaattttagaaatacaataccaatgctgcctgtttcataatctaggggaagtattttcttctcaagccatgttcagcctgcaacaggaagccaattatcaccccagaacatttctcagtgaaaaatatgtcattccttcttaggacaattaaggcttaagcaggcttaagcccccatctcacagtgttttcttatttttaccatctaaatacctatcaatccaaaccaagatcaattccatttacataacctaaagatgtcactaacatttggacaagggaaattttggaaaaggacaagatatcttttttgcttacttgaatgcccacattggcttttcctgaaatcagaggataataatggggctgctgagggaaaaatgcaggaaataggcagtggtactgattaaatgagagtaaattcagttttattactttcatgtaaactcagtaattctaactaagaactaacaaatgtagtccctttagaattcctaggaaagtgtttttcatcagtggaaggaaataatttctagttaccagatgtacgcactctgaagactggagctaggtcttactcaagtctcggtttctgctagaaattagcatattcatctacccttccatccaacatcacctgacacacagtaggcatccaatacatgtttgccgagtaaacatattggcatattatgtttgcaattgtctgctcttgagaatgcttccaaatggcttgcataaataggctaaatattgtcctgagagcatttttaaaaatgcgattagcaaactttttatttcttagagatgacaaatttttacagtcctaaataatatggatagaaatttaagatgttttccatgtgccaaaagaagaagacgttccatttccctttatagacatgagacagaactcttccagagctcattctgtgtaatcaaacactttcaagtggcaaccaaacattccaacgtgcctaagctatctgaatgtcatagcaaaagacagctggtgatacgatgttagaatgaccagaatttataccatattcacattccctttagcacataccagattccacagctctaagacaggtgtgttctgctaccctatttttccctcaaagagcacctggagcctgtctagaaaacagaccaagagctttactgccaaccactgtaggtgggatgactagattttctaattatagaattaggaaaacgtaatttgacatacgcacttgtacttttgggggcaatgggatagaacatgtgacactggggctgctctgaaaactccagaaagtgtggatttccatgcttaaaggaatgactagagaatctacaaaagggaagtaactttataaaacagacaatgtgaaagaacacagcacaaacagtgttaaaatacatgagaaaacatttataacacatttaacagagaaagcattaatttacatgacataaaaagaacccttacaagtccataatttaaaaaaaaagaaaaatgggcaaaggatatcacaaatgattgataaaagaaacacaaaggactagtaaacatttgaaaaatatgctcaaattcagtattcatcacaaaaatgcaaataaagcagtaaggagctatcattcctgacctgtcaaattggcaaaaatttataggattaatgatatcatgcactggcaagaagacaggaaatgactcaaataccagggttgagattctgacttggtgaagcctttgcagaagccattgtggtagtattcgtcatcaaaatgtacaaggcccttaacccttcaacccagcaaacttacttcttggagtctattctagagtaatacttgttcacgtgtacaaagcagcacgatcatggctgttcattgcagcactgtttgtggtggcagccaaaagacaggaataatttaagtatccatcaacaggaggatctcaatagtaaatttcccaacctctgatatggcccagcaggcacttattaaaaagagggagagaaagtaagggtagagattatctttgtggggaagtgactggaaaagggcacaggagtcttctgaggtgccagaaatctctgtgccatctttcaggtgcttgttatacgagtatgctgtttgtgaaagttcattggtgtacatatataatttgtgtacctttatgtgcttcaataataacatcttaaaataataaaacaaagatttgggagatcccatgtgttagtggaaagaggattatactaggaaggagttctgagtcccagctccttttggcctcaactagcttgggaccttggacaagtcacttaggctgaatcacagttgagatgactcacctgtaaaagtgggcataattataccctgcatagataagtgggccagatgattttaatatagtttttttcgtttctaggctccacaactcttcaagccctattagttccgaatgataaaccaccagtaagttttttggatctatctcctcttctccatccctatttccacaacactgactcaggtccatatatcacttccctgggctatttcaaaagtcttcaacctggtctccccagttctagttttgcctttttataatccatgataaccttctggttagagtatcttctgaaagtctagctcagatcaaatcacttccttcttcagaaatcttagaaagcagtggggcataatgcaaagtgcacaggtctcactgtcatttaaaaacctgcgtttgaagagcctactggctgtctcatcttgtgcaatccagtgagcctctgaacctcacttacctcatatgcaagatgagagtactaataggaccttcttcacagggttatggtgaaaagactttcacttactagtgtgccaagtcctaagttacagtaaacatcagttaggggcccagaaggaaggcagagtaaagttccttagctaccacttcttcacttgctccaatcaaggcagaaaatacttctgggcagtctgagctgcaagacaaagctttctactcgactgactggctgtttgacaggagggcaaaaagtgaaaggcatctcccgctttgtaggcaatgccactgagagtgtggtgctttgtagcaaaggatgacagtcttaactgatggcaagctgcagcctggaagatctgtagtcctctctgcacacctaatgtggtaataactgcttaacagagacctcacacaaaatcaagagaagctgaaagcttgtggttgccttgctaatgtaatttaggatgcattagtcaatgtttctcaggctgttcatcctagatcagggtaattatggaggggaataaaaaaggccagattagaaaacagcttgccagcagaaccactgtatttgtatgaggtgatatgtgaatcagcatctgaaaacggtatgtagttatgacttgttgcctgctcagactttatgtcaagctctgaagcaaattcagcacttagtgttcatctcagagaaaaagcctggtcactgtggtttgtcacacaagcctcttgccagataaaaaggccactcatgctgggaatgcctctcacattacaagatttacacaatctccaggaactaatcttgggcaaagatgggatgttttcaacttgatctcttatctttccaataaactacaccaagcatcttctacgttttacctcctccccacgaagcttccttgaccgaccagaagaaagcagatggcttctttagctgcaccctaatttcacataaaatttcatgaaaatgcctccactcttcatcccaattgtgcacttgcactcaatcttctacctggcatagtgcctagtacgtaaaagacactcagtaaatatttgctcttatttactgagtgttcactacgacctgtcactctttcatagcattcagcataattgcaaataattgttagcgtagttatttgcttaatgactgtcttctttactagactgttagcatctcaaggccagaattggattctgtctcattcacagcttattgtggtaacttaaagcctaccactatgcctcacacttattaagactaaataaatattcactgaataaaagaaaaccaggcactaagcactatttattcgttttctcactgaatcctaaaacaaccctgtgcacttggtattattacctctattttgtaggtaaagaaactaggcttcaagagctgcaataacttgcctaaagtcagggccaggattctgaacacgtgctcttaacaactgttactctgcctccctctttcaaatctgcttatactatttattagttgtcgcctggaaaaatttcctatgttttccaagcctcaggtttttaaaaaatctgtaaagaagtggggaatggtgtctatcttacagatttcttgggaagtttgcttgagtttatacatgtaaagcacttggtcatagcggttggcatacaatcaatatttaataaaagctactgctgctgttatagtttctattgaatcaaatatgcagaagaatgtggctggagatagggaatgccacctgctgaaacctgccccctctcccaaaattagtacactctgtttctgcagttgagtatctctctaatggttttgtgtaccactctcatcacctcaccatattctacaaaacagcttgaacactaaagatgcttttgcttaaaattcaaatgcagaataagcaaaatattttaaaattaattatattacacaagcaattgctcaatgtgaaatactacaatctacatgacttaaattgaatagctcacattatggaggatatggaagattggaaaaaaatcaagactgtccccttagcacacaaaaagagggaatttcatcattatggatttttatttctgtagataatcaatggacatcaggaaatagagcagagaaagcagagaaagagaaaattgcaaattaggtggtctcttctttctgtgttgagatacctagagaggtcaacatttacacaaccactttaccatcttttggtctactctgttactgtcacttctgtcatttcagttcctaatagaggactctggacacactgtgtcacagaatactacaaatgtccagcattctgaatcacagtggcctaggtacatgtataatagtcctttgatacagtataattagctgcactgcttctcaagtgtggctgcatattggaatcctctggggtgctctgaaatagcatagacacctggccccattttcattttgatttaattgattccagacactgattttggagctatattgcctgggtttgaatctcacctcctctacttactattgggacacattactatttggacaaattagtatctgtgtttgtttccttatctgtaaagtgaggataataactgtgcttacctgatagggttgctgtgaaaatcaaataatatatttgaaatacatagtgtcaggcacacagtaggtgttccataggtattagctattagtagtagtagtaaaacggtattttaattgttatactttggtgttgtggaagagaagggaaagcttgtagagtttgcaaccacatgtgacaatgctgaaatggcagcagaagtattctgtgtttcaaatttataaaaatgaaatctcttcattgtaaggtactacttcaacaatagaggatatgagtttgattccatttggaatgtctcaattttgtacatgaagaagtaaaatataaatgtaacacatgtgtactagaacaaccctatttacctataccacacaatggactgtcattgccagtttcccctggtataaaaaaatcctaaggaaaagactttgaaaaatcaaaatcatgctaatcttaaacagtgatattggggattgtaggggtttggttcttgtccccacttgttgccattctgtggcgaagaagaaatttccattgtgtttgtggagggggacacagagtaccataaaaacttctctgggctttcacccctgcttgttctttggcacaggagcaagattgacttatctgattatcatgcctgtaatcccagcactttgggaggacaaggcgcgtggatggcttgagctaggagttccagaccaggctgggcaacctggcgaaaccccgtctctacaaaaaatacaaaaattagccaggcatagaggcatggcctgtagtcccagctacttggggtgctggggcaggagggttgcttgagacctggagttcaaggctgcagtgacctgagacagcaccactgcactccagcctgggtgacagagggagaccctgtctcaaaaaaaaaaatactaatattataaaaaaataaaaataagtacttattcatggcctatcctgtgcattctggctctcaggtctaaatgccctccaactcttttatgagtgagtagagcctagtcagggcacaggcaccatcttctagaggtagacctacaggcccattttgctcttcatttctagcttccactgaagtgtgacacaggccatcactctcaagggcgctgggacggtaaatggtctgctctgaaggctcactcatctccacaggtgagtatcaaggaatacatttgaagctagaggtggtaggaagtctcattaggccttagacacaagccatgttcttcaacataattttatctataataaagtcgatgccatattttgttcctcctgaggtgttttgtgttttttttttctcagtttgattcagaactggaaaaagaaaaccagtgtggttatttcatgctcttacaccataacaagcagagcagtaaccataaaagtattatctgactgcttttaagttgctttccccattaaacaaatttggaaactgaggcttagaaatggcttctgtggtccacctaaggccaaaagtctaataataagtgtcaaattcagtactaaaagcacagacttcagtatagttttcactacatgtctgagtgtgctcctttcccttattaaggctagcgaggaccttacaggtcccaaggacaaaaatgacatttgctttctgcactttactaagctaggaggagatgaaaacaacctctcaaaatgcaagaatcctcttactctgaaattcagttttactcacctaaaactgattttttttccagacaaatctttgcccaataatcacgaaattgaaagagattctctagacgaagttatacaacaaagtttaaatcactgatatagtttaggtatttgttcctgcccaaatctcatgctgaattataatccccaatgttggaggtggggcctggtgagaggtgttttggtcatgggggaagatccctcatggcttgatgctgtccttgtgatagtgagttcttatgaaatctggttgttgtaaagtgtggcgtctccccctccactctctctcttgctcctgctttcgccatgtgacatgcctgcttcccctttgagttctgccatgagtaaaagcttcctaaggcctccccagaagctgagcagatgccagtaccatgcttcctataaagtctgccgaaccgtgagacaattaaacctcttttctttataaattacccagtctcaggtatttctttatagcaatgaaagaatggcctaacacaaccacagacaaaacataagtataaaatgttttcctgcttgaatggagtggccttaagggtaggctgggatggaggacacaaactgtcccttaccaagtaatcaggtgtcacaaaaagattcttctgtaatttgctgagttgcccgagttctgctctaagaaagcaattccttcataggtatttcccagtctcaaactcttttctgtcttgagaacaaagtgccttcccctgtgcagcagccaaaacagatacggggcctcccataccaccaggtgagcttgtgacaaatcacgtagtactattagcatgagagaagttagcatttccaggttacagatacactttcacagtaaaaatgaatcaattacatgccacagtcctagccaatttgaaatgattatatgggtctggtaataactagttctcattctgccatgaattaaccatgtgaccttagataaatcccttctctgggtctcagtttcttcatttataaaaatgatggagtttggccaggcatgatggctcatgcctgtaatctcagcactttgggaggctgaggcgggtggatcttttgagcccaggagttcgagaccagcctgggcaacgtggagaaaccctgtctctattaaaaataccaaaattatccaggtgtggtggtgcacatttgtagttccagctactcggggggagctgaggcaagagaatcacctgaggcttgggaggtgagctgtgatagagccactgcactccagcctgggtgacagagtgagactctctctctctcaaaaaaaaaaaaaaaatgctggagttagttgaggttgtctccaactctaaaacactagacttaaacatctaccactagcctctatattaccaacgtatcaggctacttacacttcatgtctgctgagagaattcctaatgacttaagtacaatgaagtcacaaaatcattccaaagctatttcaatgattcgggcaacttaagagagatgtatttccatttttctatcctgcctcttttgtgccaccctgtctgccctcccctggacagtccttgaaaatgaaaacttcacactggatttcttctatcagacctgagaaagaaagtaggcttacttttttgatcctccagttttcaagataatggttttatttcttgaagctgtaatcagatgaaaatgtccaaaggactaaagaaactgagtagggctattagtctaccctttttcttattttaattctatctgagggaacaataggctcttcttgcctttggcaagataataattcagctgacatgctagaaataccacacaccaagatataaaatggtggcattttctctctttaaaaacaatcaacgctttcatctgtggacttcaaagtacacatgaaataaaaagtctcagtcctgtgagtctgaggtaaatcaaaaggctataagtgtcatagaaaagtttcctggttcgtagccctcctttcaggtaagaaaggaaacaaaagtactctcaagcagatgagtgttcatctcctttttatatttctcttccaagtgagcctgaacaagttttctgataacccattctgataatagttcttctttatggctgaccaaatttcttcttgctgctctacaggcccactttctcctattaatctagccttgtagtgctgtaattgttcactgtctttatattgtcaagtatcattttgatttccagaatttctaaaggaaagctgagaatggagttgggaggtctatgatcaagactggatactctctggaggtccttatttaattataacactcctggtgatgctagtctaccttagataaagttatttctcttctctagtgattagcacctcatgtgtaaaacgcaatgagtatgagaatacattaagagaaagaaacaatcaccataccaatacaaattattattgattttgaagggtctttctggagatcttgaacttttgtgattaaataattattgcaaatgaaaactggctgaagatccctcttttcacactgagtcattcgttattcacatgaacttcggcaatactacttttgacgcatttaaggacaaatctatctttcaacccaggcttatagagaaaagacaatggaaataggactctgcccacacctggatgctcactttggtattgtaattattcctgggtagtttcccactcttccagagagctgacaccttctttgaatattattgtaccatgatgttgcttaaaacaatgcattcgattttagtcatcatccagttggccttgttgactcatggttttttccactttagtggaagtatttcatgaaagagttggtatttctgcttctacaaatccagatggctctcaaaccaggaggcagttggcaactttgagaaacgaacttggcattgtgattttacatgggtttaacaatcttctactcttttgctatagagtaccatctgaataaatggatttgctgccatcttagacaatttgtacagctacagcatcaccaaggaaacatttccatggggaaaaggtaaaatttaagaggaaacacactctgaagaattctgagctcatcttataaaagctacaaagcaaccagatccacaaagaaagattatgtggtcaaatatggcagtaatgtctaatcctgattactggtctacttcatagttgaggcaggacatttaaactctacctatcagtttcccttgggcacttaagaaatctcagctgtaataaggcaaggattccattagggccaggtatttttttttttcacaagcacccagatttgatttgtgcctgttctaaggatgtaatctcacaaatgtctgagtagcctttagggacaagtgaagctgtcagttggtcaaattcagatacaaaggcagagtttcgtgcaaagctctatcctgaaaataacaagaaaataatagggaatataaaggcatagagaaagcaattattcaatcaaatatgtgatcaagcaacaaatatttctggagcatctattttgtgtaagacaccatatctctgctaagagagttggggcccttccaacaggggagttataactgagttgaaaagctaaggcatatatatatatacacaaactcataagcaatagttcaaggtggtccacaatcagtgtcaagtgattgatatgaatttaatgaccgatatatttcagaggtacaagagaacatttctaattaagatgatccagaaggcttcttatagagggtaggacttgtactaggcactgacagttggataagactttgacaagtgaaagaagaaggggagcatgctgggaaagggaaatgaatggtatgagcacggtggtgaggtaggtaagcacagtgtcttcagagaaaagtagtggatcggtgtggctgaaatagaagacttgttttggggagtagcagaaaaaaaagaaagctgaaaagaggaaccatgagatctgagtttgaagggatcctcaagattatcatatccaaggcctgctcctcttattcttacctatttatttccacataaacacagctttccctagtctgcaccaatgttttacatacattttagtggtggttctagattcctaataactttagacacagtaacttcagcatagtagttagaaatagactttggagttagaggcctgggtaaaccacttgctagacattcaactttgggtaagtttatcctttatttcttcatctagaaatgtgggtaatagtatacttacagtcgagggatgaagaaaatgagaaagaaggcttgaaggagacagtaaaggaagaatctgcaaagtgtattaccaaggaaagcaaaagtagagaaaatacaaagaagggggcattgttaatagcatcaaatgaaacaaagagttcaaggtggttgcgacctgccaaaaggccactgactttgacaatctgaaggtcacaggtgacctttaagaaatcagttttagtacaaaaggaaagaggcagtttgtagaaaatggaagaggtaggagggttgggaaagggaggaaaaaagattgtgtagtgtggaactggatctgcaagcaaatatccctccctcgtttgcagggaaggagagggagagagatggctttgactcagtggagttacagggccgagtgatgcaatgactggacatgcagcttggaaatgaaatggtcggtagctcctttgggaacttccaactctagctttcctccttgccacagtgcagggaatgatgacaaaggaagagggaagttgctactcatgaaatatcttccctcttccttttgtctagtactgcagaggaacaaaataatattataaagctgtctgcctatttacaatatcacaagattgctgctgaacaattataaaattgttcaagtataaattatacaattataaaagactccttgtatagtaaaatctcattaatttggactacactaatttggaatttgtggtaatttaacctgggttggagttacctttgtcctactaacaaagaaaaggttctctaagcaaatattgaacaagatttcaagggagctaatttagcctgccaggggcttatttcacttattttaaagaacatactgttttttaagaacttcagcatattcattatttgaatgcaaattgttctgctaattatagattagcataatctactgttaaaatcctatatgtgcaagttactttgctctcactgaatgtgctcattagaaataaaactgcaattctttaaagttaattcacaattcagattaatacatacttcctttccccaccctcatgagttaactgcagttcaggaggtattaccctaaactcacacatcacttaacatcacttaacatgaatacaatggaaaaactagtaggtgatcataaaagtctcagagccagaagagatgtcttaaagttgatgccctaaattctgtgcactctatccgtggcaggttccacttagagctgatttaacttttacttatactaatctggcacatcagcttggagagatggctgggttttgttgttgttgttgttgttgttgttcttaattcagtagaaggagaaaaacggctgctacatgaagggacgatgagaggaataaaaagtgactgtaggcagcagaaaggagacaggacatgtgtaaaatgtggctataataactaaaagaccaccgcagcgtagaacaatttagtgtagaggtaaaaaacctatactttttagtaaacccttaaaaatttaaaagtattagagtgccgtacaataactaatgactggaattacgcccctaaatgatcaagcaaagtttaaattatattgaatacatgtctttaaaagacagatgagtttatacacatacacacatatggtttatactcataatgcttaacctaaaaatgtgaaacacgttgatgatttaaaacatgaaatttataatatcatataataatgctaataaaatagtaacgtttattaagtgattactgtatgcagacaccatgctaagcactttacctacatcatttcaactaactgtcataacaaatcctaagacataggctttagtatcacttttactttacagctgaagaaagtgactctcagagaggttaagcaaataactccaggccacagaaagagataaaaccaggattagaactcaggccagttccttggctatacaccatgcctttccatgctccagaaaacagagctctctaagaatcactcatttcttgagggttccatgtaactaatgttttactgtattttcattttccaaactcatatttaacaaatatcttgatttataagcagagatctatgatctaagagtcagatatgatacatttgtaaacatgttccatttcacaagctgaaagtaaaaagtaataataaaaaacaaaacaaagaaaaaatgatgaacatgtctgttatgcccatccccgaatctcagatcagtttctatatactacagattctacttccaaatgaataaccatgcaacaaagacataaaattgtaaaatatcaaatgatcagttaagatgtggctctcctatggttttctcactccttttggaaaaaaaaaaaaagaaacattaagatgagaataggccaatgggacatgagggattggggtaggagaaattgcaagggaggctaaaagctccattgggctgttatagagggtttagaagaatctgtttgccaactgttctaagagaattataagggcataaaacatatgtaggcatagtgggtattgaggggaacaggggtagaggtggggagatgcaaatatatgcagctatctgtattagaagtaaaagtgaggatggcctgccacatgtacatacaaagacaaatgcacagtgaaaccattcactcatgcaattccttctacctaaatcgatgctctttactcatctcttgtctcaagcctacccattcttcaaggatcagctaaaaatggcacttctgccatgaagtgttctataatccctaaggcagaattaaactcttcctcatttgtgctctcatcggtttttcaccctttacacacttgccacagcactgatgatactctatctaattatcacagttattcgtgtatgtgcttttccctccttcaatcccataatgagttccatgaggacaggggactctttctcatttatttagttcctacaagctctagcatagtatgtgacctgccacatactaggctctgggaaaatgttgactctggtactggcttaagacagtgcattatcacctagcttacctgaaggagtatttgttctctttcttttcttgcttgattcccctccattctcaatgaggccttctgtgaccagagggccactggcactaccaaactgcaggggctcgttgttgttagcagggtcaaagggcagctggttcaatcctaaagaagaaaaagaaagccaaagtccagactccattaaggactgggattgtctccagattttattatatgagccactagtggaaaaccttttaaatcttaaaagcctaggagaaacaggtgaattccttaaagacagttgccttctgtaatttttacagatcttttcggtaagtacaaaattaaaatataagactgtggctctgtcatttgtaagatccctcctgtttctgcggcaacttaacatttttagtcataagctagcaactgataggtccctcattaaatgtggctatggttggacccactgttccttgtaaaaagtttggctttgcattccttggattatctcctgacattttaccattctttcattacaaggtatgttgatctcatgcagatataatcatcagactatcctgtgtcaaagtcacttccaatagtaatataggggtctctaaaatcagaaaaccataactccatggcaaatgagaaaaggaaacaaatatatagaaattgcaagggggttatttagtagctggagcaatggggaattatgacctagatttcggtaatgttaatctcattctcttcaaataatattagaagcatggtcactttactcgtcactgctgcaccatataaaatggcaaaaggtattttctactctccaagtcttacatggttcaatcaggggcaagcagagacagagacagttcttactcctctggcagcagcacctggaatttcaagtgtttcaattaaacttcatgaaatgtgaaatcaaaagcttttttaaagcccaaagttaagacatctcctgtaagccttttctccactggttctctaatcctatcaaagggggggaaatcaggttggcctgatatagctcactctttttttttttttttttttgagatggtcccttgctctgttgcccaggttggagtgcagcagcatgatcttggctcactgcaacccccacctcccgggttcaagcgatcctcctgcctcagcccccctagtagctgggattataggcatgcaccaccatgcctggctaatttttgtatttttagtagagatgaggttttgccatgttggccaggctggtctcaaactccttacctcaggtgatccaccagcctcggcctcccaaagtgctgggattacaagcttgagccacggtgcgcagcccatagctcattctttaactcccaaattttctatggcccatagctgtacaattcttgaggtaatgttgtaaattgtcagttaaaaaaaaaaaaaccttgaaatccagtcagctaaaggtcaatcaagtttcaataaaatgaatgctaagattctaatgggctggcatggtggcttacacctgtaatctcagcactttgggaggccgaggcaggcagatcacctgaggtcaggagttcgagaccagcctgaccaacatggagaaaccccgtctgtactaaaaatacaaaataagccgggcgtggtggcacatgcctgtaatcccagctacttgggaggctgaggcaggagaatcgcttgcacccggtaggcagaggttgcagtgagccgagatcgtgccattgcactccagcctgggcaacaagagtgaaactccatctcaaaaaaaaaaaaaaaaagaaatgactttaaattattatttataataaagagtatcctcttgctaatgttttcagcccacataacaagtactgtttttcagcaatcagattccacttggatcacctccattaaatgtcttctggaacttgtcaaacattcttccttacatcatgtgagtaactaagtgaaagagtaaaacttgcttctggatcttaagcgaactgttcactgcatcatatacatgttctactaaatccctaccatgactagaactaaagaaacaaacatcaattgctatgtactaaaaaaaaattgagatcatgaccaagactatttaaaaagaagactagatgtttattccatttacaaatgaagattgttctcgtacctgattagtcccagagtcaaatatgattaatatactagtccaaaacttttcttggaatttctttctgaaatatactgatcaaaacaagttccatggaagacagaatggcatagtggaaagatcccgacagaccgggattcaaatcctggttatcctttactagctgataccttttggcaagtcatgtggtctctcttagtcttggtttcataatgtgtaaaagagagtgataacacacctaaggctgtggcaaagataaacacatacatatttatgagaattacattattctaagtaaattaaaacaaactttccccctataaacttgaaagctctcctaaaaaggaaacttccctctctccctccctcccacaattatattcttggtgcctagcaccataccttgagcgcccaaatgaattaatccttaattggatgggggtagatgactcattcttttaacccatgtaatgaaagacctgacagctgataatcaagaattaatgccacagcttaaaagttctgatgctgattatatcaacattacttaaaataattagattctaagtgcatctccatcatttgagtactatactacagaatggtaaaatgctgatgaaaaggaatgttcagggattaggaggttctgattaatgacggtgaaacagaaaaactttttttttttcttttattattattattattatactttaagttttagggtacatgtgcacattgtgcaggttagttacatatgtatacatgtgccatgctggtgcgctgcacccactaacgtgtcatctagcattaggtatatctcccaatgctatccctcccccctccccccaccccaccacagtccccagagtgtgatgttccccttcctgtgttcatgtgatctcattgttcaattcccacctatgagtgagaatatgcggtgtttggttttttgttcttgagatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcaagatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgaaacagaaaaactttttatttttgttttgcatttgataattttacagaataacatattagtccatttccctgacttattaagtagatgactgaggattttccggaggtttggagccacaatttgcaaaaggacattaataagagtacctaactcacaagactgctaaaaatattaaatgagattatatatgtagaacattcagcataacatctggcacatagtagatgttcaataagtattaactactactattataacattgaatttccatttttaatttctagttactgatgtgcaatgtgaggagattgttctgaatctgccctgatccaaggatgtaccctgctttcctcattgaaccttttcattcctgtttgtacctttttctaaaagttgaaggaatccaggggaaaaaaaaatctaatgagttaaaggtgttcagttatagacattttattataattatgcttgccctttctttaggcccatatggtaaccttagggatatagttattttattaattacatggatgtacagatttttggcaccaaattaagactgagatttcaagtactttctgtgtatccacctcatatatgatccagatatgtgaaaatcatgacaattcagtacaacatttcaggcctaattttttttatagagaaagatctcatatggaggggggacatctcactcagtaagctgactcgctgaacacaaacccatattttatatcatccaatacccaatacagtctccaaagatttgtagttcaagaggaaggatgaaagagacagcaaaatcctatgacaccagtgcttcctagctacttttactgttttgtttcattccttccataagacaggaccaaacaaaccaataaatcagtaaatcaataggtatttaaagggtgttttttgtgtcatgtatatgtgacccaggtcaaatgctattttaagtaaactagtcccattaaaatgattaaatactaaaaaagaaaaccaccactttaattccaagaattcttattgctgaaatttcaattatgacataaatataaaaatattggcaattaccatattgtaatcctcacccaaactacagaatttatctttaaatctcttatggaagcaatttctaccattttttctagacatgatgaaactgaaaaatattagatttggaagaaagttttgaggttatctagtttattcttctatttctatagaaattttatctatagaattcctgacaggcctaaatccaggggcactgcttcgcctgggactcattccttgctgggctcccaggcattcagcttgcttttaaaaactaccacctactctattttgggagttccttttatttccctaaaacagcttcttgcttatcttacctaaaatgaagacataggatgtataacttttaaaagtttctactgataatcactgtaagaaaaacaaatgacagagtaacagataactaacaaagtcagaaattgtccaaagtcttacgcattcctcacagtccttgcccttttattcctaagaataaatttaataaaacctcatacttcgttcatttgtttccctcacatctcatctcctccctccagcccacaaaatttacagtttgtccaaagggaagtacaaattattaaaataaagacaaatagataataaacactggtgttacagatttctactatttctgtatctcatgttcacaataaacaaatccatgtggtaacgtaatctcatctaaaaccaagttgactggtgtagacagctgaccagctgttatttcatgtcatgttgaaatgcagattatctgactccataacacgtatgaggctgctttagaaagtatgtatattgggaaagggtgggggtggggttccttgtagaatgacatttctcatctaatggaactagggggttaaacatctcagaatgaagtgtgatgctcagtgaatactccaatctgcaggtcaaggagttcacaagcaatgttatgtctgccatacagatgcaaatgattcgtgggctttgaggaaagcactaaagaattttcatgattcttgtgtgagaagatcaataatctctttgtgcccagctgctttaacagttactgtcacaattcactttacatagctgtccactatcaggtcaaattaggaccaaccttcatgatgcaatctaacacttttaatgattgccccaggttgtaataccaaaatgtgaccctgtgagtgaatgccactttttatctgcagctgtggctcagagactgtataaccctagcgaaaagaaacacaatgccaccctggattagttagctttaaaagaaaatggctaaaatcttgagaaatctgataaattcaaattaaggcaacaatctcaacacataaattaatgttgaaaaaatatcagtacttggcaataagaacagtctagctaatttgtctgtaaaacaagtttctataacctaattcttattttccaaatgacttcaatttaaaatcagatatgagattccatgttgggagatgagggtctccaaatttgttttcaattcaaaacttttggaaaaataagggattaagataatggccaggcccttaatgttctggcaggtgctgttgaaggatttatccatctctggagggccctcctcactttcattcacccctcctgcttcctcattctaggcctcaaaaccatatttgtagctctcactacccaaccattccacctgctacttctgagggaatatttacaatgtccaaaagagttggaccgcaatattactcttcagccacagggcttagcagccaagacaattgaacatttctcagtgccaggtcttaactgatgtcaaacaaatgaaacctactttgtcaatttcatgagttcaatattctaactggtttagctgaagcaagggtaattgtatgagttacaaataatgggtaagtaaaggtaatgaagaagaagtgagaaagaaaacggaaaagtccttttcggaagcactaaggggcttgcttgaatggtggtagacaaactttcagagcctaatttatctttaagtcaccattttcaaggtgggatacaggtcatagaccaattttcattggcagtgatccttcagcaacttttaatgactccccaaactacttggtcaagtcactaaagtctctcataaaaaggccgcatccatttcaggccttgtctcccactatgccccagcttatgctctaccctaatacttctcaaactttttaatgtggacatgtgttccctgaggatcttgtaaaaatgcagattctaatttagtaaatctgagttgtggtctgcttttataagttcccagatgatgctaatcctgctggtgtgggaatcacattttgagtcaaaagggctggcactccagcaaaatggaactacagcattcactgaatccatccagtactttcctacctccacacctttggctcacactgctcctccacctgcttcttaattttcaatgttcaaaatatcatccttcctttagggcttatctcagatgctatttccttcatggtgtctttccttattcacctctacccaaaccaatacatacacagcaacagagagaggggaactacccatcagggaaactactattcattggttgtttaggatgtgcttgtttacaaacattatccctttattttattttctaattattattcttattttacaacaaggaatgagaaacttacagagttgaagtaaatttcccaaggtcacacaaggaattcaggctttttgtttttcctttttgtggtgagcagggtctcactatgttgcccaggcaggtaactcctgggctcaagctatccttctgcctctgtctccctaagtgctgggattacaggcatgagtcgccgtacctggcctcaggatttttttattataaaatactattctggctgtccttgaatgttagcctatacttttcctgagccttttagagcatgccttgtgttacagttctttgggtattctgtcttagcctaccttcccttctgccttaccccactcccacttagtggtaaactccttgaggacagactttatgcctcagtcattttttagtctctcctcccccaagacgtggcgcagtgccttgtattatattgtaagcactccagaaatgagtattgaactgaactcagctacaatttgggatacagcatggatagtatctgacttacaatggttcaacttacgatttttcaactttatgatgtaaaagtgatagacattcagtagaaaccatacttctcttaccacgctgggcagcagtggtcagctgcggctctcagtgagtcacaaatttttgacttatgatattttcaattttcaacgcgcttatcagattgtaactacatcataagtcaaggtgtatctgtagttgtgtttcccatcccaggcaccagctgacctgctgctggagttgtcatgaaaggaagaaggaagtaaggtttatgggttccttcagcattcctggtatcttctgcatcttaggattcctgaagcctggggagtgatggtagacaatcacacactccactcctaatgtatctgcataatttcattctctctttctgaagggcaaaacagtccttccattgaccaagaccgttacctgagagaatactataaaagagatcccatatatggatcttctgttaatcgttctatgtacatcaggttacatgtcccatttacaaactacagttaagaaaaggcagtctctatccagtctaccattgatgggcatttaggttcattccatgtctttgatatgtggtacatatacaccatggaatactatgcagccataaaaaagaatgagatcatctcctttgcaggaacatggatggaggtagaggccattatccttagcaaactcacacaggaacagaaaaccaaatactgtatgttctcacttataagtggaagctaaatgatgagaacacatggacacacagaggggaacaacagatactggagcttacttgagggtggagggtggaaggagggagaggatcaagacaaataactaaagggtactatgcttaatacctgggtaatgaaataatctgtacaacaaaatcccatgacatgagtttacccctataacaaacctgcacatgtaccgctaaacttaaaagtttttaaaaaagaaaaggcaatctctggagatgtgctatgcaatacagtagccactagccatatgtagctctttaaattaattaaaatggaataaaatgaaaagttcaggccgggcacagtggctcacgcctgtaatcccagcactttgggaggccgaggtgggtggatcacgaggtcgggagttcgagaccagcctgaccaacatggtgaaaccccgtctctactaaaaatacaaaaatcagctgggcatggtggcacgcgcctgtaatcccagctactcaggaggctgaggcaggagaatcacttgaacccgggtggcggaggttgcagtgggctgagatcacaccactgcactctagcctgggctgacagagcaaggctccatctaaaaaaacaaaaaacaaaaaacaaaaccagaaagaaagaaaaaaagtgaaaagttcagttgctcagttgcactaatcacatttcaagtgctcaatagttacatgtagctagtggctgctgttttggacagcatatttatataacatttcaatcatcccagaaacttctgctggacagtgctgctctagagtcagatctgcattcaaagccacatctgcaacttactaggtgtgccacttactaagtgtgccacttacaaggtgtataaaacaggtcacttgatctctctcagactgtttctgcattgtaaaatggggatgataatgccccccttacagcaaagtgaggaaaattaaataagagattgtatgtttaaggtgtagcacatgttggacactaaacaaatgtcaatgcccttctaacccaatggggggtttatataaatttgtctcaaaaatggaataagaacatttgagtagtgtggctccttcggcctccaggctacagtctatttacagcttggaagatgttagctttgcattcctcttctaacctactttttcttaataacacaaagccattaaagtaaatcatgaataaataatgcgggagtagtcagtgattgctctttgcttggattctgtttaggagaccatattcatcactaccttgaactgtccaacatgaaagaatcacattttcccctaacaatggaaatgtctcctcccaaatctttcaggaatgctctgttccatctgggtgctgtactatcagaacactgctagcagtgatactacagctggactagagagagtatcatttctctctaaatccatattttcgtacactcataatgttctctgtgttttttctgtggggctgacatctcccaggcctggtaaagggtgaattattcgagaaaagtctgaactaaatctgttaaggtgtttgtgttccgtgagcagaaaagcaaaatacatatttccaacttcaagaagaagaacacttcaggacttttttcccttgtccaatttaaggcttgggaaacacagcaaaatcacattcctcattgaaaacaaagttcaaaaaaatgttgatttgatagaacagttcaaagtgacagatggtagatgggtgatctatcattttccttagaataaagtctgtctggcagtcttcagaggaactgagaagagaaagccttattttgttgtagtttagccctgggaacagttacagcagctaccctttctctccacatcttttggggtaggggattggaaagatggtgattcatcagtgtctgctttgagctggctctaggccatgctgtaattcctgttgaccaattttccacctgagtgacaggaaaagggcaggttcctagcacactgaccattaggttatctgttgagtacttccctgagaatgtgcccagaggtactctattatggttgtctctgtctaaataaaataaataattgcagatttcagagcctgaggacagagagttgttctagtattgaaattggagtctatcttgtcagatctgtaatgaggtcttcccttcaggctgattgatttcataaaactgaggcaattatcaaaagcaagcacagttctccctgcagaaaccacttcactggttttgaaaactagcttgtcagccagatctggtcaggagcctaggctgagccagctctttaagtaggaacagttactacacacagagaacaccaatttctgctaatagattattaagatgccagtaaataagttgtaaacaaggttcagcaaaataatttcacatgctgtgagtgaatgaaaattgaagttgctgtcaaataaatctgcatttcagtgtaagatgttttgaaggagaaagtgagagctggtcttttggtctttggagagttaattttatcagttaatgctagaaggatactggtatcctttaagactgatgcaccgcatgaataacatttgtatctttgctttgcccaaaatgtacacaccaatttcaccagatttcctttctttgtttattcagccttcattaactatttatccaatcactatgctacaattttaattatcttctaattaaccaatgatgagtttgtggtttagcattccctaaagatagaaccacataaatatggtcaatcttcatttacatattcaaaatttttatcctccctcctggctcccaccctattaattttgctatactgcgtcactaatgttctggaattatgctttctgcattcctaatcttttagccccatttgggctagtttttcaagaatgtatgagaaataaccctcgctgttggctatgaaattaaacacacaggagaaaacagagcttcctgtaatatgctaatgcatccttaaagatccatacttttcctataacaatttctcctaggagtatcaatacaaggtgttgacaactgattaactcctttagagaagtccctgcctaagctgaagtcaaacctaccactaggaaaaccagaatctgctccttgagaagacagcatgactgtaaagtaaaaagcctgcaaaaaaatcactaatctgtgtctgaaacaactcctaccattgctgttgtataaaaaaaaagtaggatcttaattttgctacagtctggattttaattgaggtattcaatacatatgggaataaacaaaccaataaattaatattgactgatagtctctctctttatttgtccaattcattcaaacaattctgggtgccttgacagtatgtaaggcttgagaattttaggatttaatatgatagttttttttcctcaagaagacaacaaaagaaagaaaggcagatacatacaaagaaaatctggcccaaattactgtaccagcttcatctcttgccaattcccctaagtaccctttgcttcattcatgccaaaattctcaaaattcctcaaacatgctaagccctgtcatgtctatgtgcttctgcacataccatctcctctgcttgacatataacttttcctttttccacctggagaacttttattcatccttcaaaactcggctcaaatgtcacctcttcagtgaagttttacctaacccccaaaagctctctccacaggagtacacagagccttatcagacgacttattgtaggatcttagagttcattctaatatgtgtgtgtgtgtgtatgtgtgtgttctgggtggggggctgtcaccatctgatttgtgccttagaaagaccactcctatggcatgatgaaggatgcactgaaggtgagaagacaccagaggcagagagaccagttagaagaaaaccataatgatacaatggagagatgacagtcgcatgaactcagacagtggcagtgggatgaaaaaaaatgaatggatttcagagatattcaggaaatataatcatctggatttcatgtataattggatctgggagttgaggagaagagaggagtctgagatgactccatgaaaaaattcttaagccacagtcctgaaaatcctgcaacatttgtgggtttcagtatgagaaaaagcacagtccaatagaagcatatccataaatccatgctcaaaaataaaactgcttccaatctctatttaccatggcataaaggctgccaggaaacagcagtaaatggcttacacttgacctttactaggtattcttaacaaagcttgtcaaaagatattaattcattcagaaaaaaagtataattgtctaagaggcagaataacatagtattgggataaagatggggaaaagcattttcataataggtctcagacttggtttattttgtctatagcattcactgacaaaagacaaaagtatttttgaaggtcagaaacacttaatagattcctttgctttctcctttcatccttctcccttccctcctcccaaacaactccttaaaattttattagaaaatcttaacattttaataacagtattctttttgttattatagtctgttggattaagttaacaattctccctttaacaatactcaaagaaagcctggaaaaattaatgctatgttgtttttctccctgccaaagaatatagcaatgtaattgtctcctggagaagaagcactctaatcatctttaactttaaagtaaattcatttcaggaagatgctctgtgacaaacaattgacagagcaaatcagggctcctagaagattgcaaagtgatggattgagttgaagagagtgccacagctgaattcatgaacattttcaacttaagagtgtctctgcaacaaaacagcactgtatgagagttaaaatcatgttacattacattgtgggaggtaggacttaaacactgcacagattcttaacacctaagagttctaggcactccagaggcaggaaaagtataagccaatttctctgattaaaaaatagagaaaccattgtaccaggcaaagtcagactgtaaaagcatagtaactttccaaaaaatgccttaaagaagttgagatcagaaaagaccaaaacactctctcaatccaattgatgtcactaggatcttggaatgggtctcaatgccaaggtattactcttatttggaagatcatttccactttcattcccttcctaattgaatctgtctccatcttccattgtgtttgttccattattattttttagaccctcccgccccgccctgacattaggcttggggaaacttatcctttggagaagatttggattagtaaatttacaggcttgacaaatttacaggctcagaatttcctggaaattggccacttgcctgagatgatgggggaaggagaaaatggaagagcaggtgaactaaggctcttgaaaacttgaccgagcagcttggcctcctgagcagatgcaatgatgaccatatagcagcagtgcagaaaagcaattctacttaaaggtcctttctttgggcttttaaaaggcaattgttttctttggcacacatgtgacccaaatctggttttctccaaagtaaacagaggcaaaaaaagggctcccatgttctgtgtgtgtgtgttgttgttgttgttttttaatcagcctacttgcttgccccaacccagggcccaacataatatatttgtcaggagtggccctggaggagatcaagactttaaggcagtgtgtcttatccctggctacatattaaattcaactggagcactgagaaaaaaaaagacaaaaacaaaacaaacagaaaacaatgcctggactctaccaccagaaattctcattaaattggtcagggtggaacctaagcatctagtttttaaaagccaccaggtggccaggcatggtggctcacgcctgtgataccagcactttgggaagccacagcaagatgatcccttgagtccaggacttccagactggcctgggcaacatagcaagacgtccatctctacaaaaagtaaaaaacaaacaaacaaaaatttaaaaagctaccaggtgattctaatgtgcagccagaattgagaaacacagttctaaatagttttctaatttaaagccagaaaatgagtattcgctgtccaaagtttatttttattttttaaagttcaaaccaggtaacacttagaaggtaagttaattaactctgtacctacaatctgtagggaaaggtattggttgtgtggtataagtacgttagacttaaacttgtccaatttatgatacttttatgaaaaatgagattctcttttggaaagaaagattagaagggttactggaaaaacaaaaagaactgaaatattggaaacaaatttagacaaagtataattacaggattaagttccttaccttagttctagaagaaccagataaaatacttcagaaatattgtgtctgttttcttattaatttccaggagaaaggttccaaactgcccttggggactggctttgaatctcataacccttgggactccaggccactcacccctgtcctcaagtaatcattcatttataccaatatgtgtacaatgtcatgaagaataccggaaagcactgcaactataacaccattggataaaaatcacactgaatgtggtttgccgatgtcacctgtcacctcagtaattccattgaactttagaaaggatctggtaaaatataaaaaatgcaaaggcacagttaagtgctgtgatggttaatattgagtgtcaacttgaatagattgaaggatacaaagtattgttcctgggtgtgtctgtaagggcgatgccaaaggagattaacatttgagttagtggactgggagaggcagacccacccttgatcttggtgggtgccatctaatcagctgctagtgcacctagaattaagcaggcaaaagaacatggaaggactagactggctgagtcttctggtctttatctttctcctgtactggatgcttcctgtccttgaacatcagactccaagttcttcagcttttaaactcttggacttatatcagtggtttgccaggagctctcaggcctttggccacagactgaaggctgcactgttgacttccctaacttttgaggttttgggactcagagtggcttccctgctcctcagcttgcagacggcccattgtgggacttcaccttgtaatcatgtgagtccatactccttaataaactcccctttatatatacatctaccctattagttctgtccctttagagaaccctgactaatacaagtgtagtggaagaacaggccataaagatgcaggctgtggtctctgctcttccatcaactcatagggtaaccttgggtgagtaattctttgtcagtttcctcagctgaaaaatgagttgaaacatgtgatctgccagctctgaatttaagataaagaaagaaaagcttagatggaagacatccataaaagcatgaaataaaactcagtaattaataggggcagaaaaggagagcagggagaacagggagagccctggaaggatgctttcctagtaccacctacacaaaacttatttagcaggcagtaaatgatttaatagtagtacagttaaggcacccccccaaaaaattaaagtacttctgatgctgctcaaaaaaaaagcctttttaagaattttgctaattataaaccagaacatgtaaggaagcacagaacagtttttttttaatgatgtttaaataccaatatatcttctaagtaacttgccatcaattaatattatttacggaacaagcattatgaaactcagaagaagagtctaacgctgaaatgctaaaagtatgcccagtatggtaggaataaattaccctaattgaccaaagctacgctcacatgtgagacatttcaaaacacactgacataatgacaaaaattcctgtctctctctgccaatgttataggaattgttattaaagccaagcatggtagttgtgtacacataaaagcaagcaaaaattataatctagaggtttttaaatttaatcttttttatttattagtattgttatacagcaatgagtagtcaaaaaaaaaaaaaaaactaatcagcgtgcattatgcaacaatcagagaaaatactcctaatcctctgtcattctttttccttggcccctgggtactcattaaaggttaatttatttaaatctcttcaacattcatttcaatctactttaataaactaatgaatctttggaactttgcctaatcagcttatgttttctattttaatacatctacaaaatgtctttttttttaagctccttcttaataattgtcttcccttttggagatagaattgtgcttcagtgacaacctgatttgtacatttggtgacacatttacaacctcatccagcacacagggaatagctgtggcttgcttattgttcttaaacatagttacattttagaggatagtgaattgatttgtgtttagtaggataataatcctccaaattgaaatggtcattttacaatttagtaagagtgacaattacagtaaagcaaagcttctaataactttggtgcttgtcaaatgctatgagggtctatcaatgaaacaactccattctggttattgtaaaccagagcaatgtatagtatataccatttggattggcaaatataagtgaagtctggagatgtcttcaaatgaatagtacaatcaaaatggcgtataaaatggttccttacaatctatccaatcactatgttcaacacattttgtttaatggcaactttgaggaatctttcacataactatctttaagttgaatattcttacggtggtggccaatggtcagggactgcacgccaccctctacaccagaatgccagaaaccaaagtcttggcgtgctagcacattatttctaactactgccttaacaatatctgacatcatcctagaataacacggcttagcaagtgcttccacaatatccttatggtgggggaagggggaaggtattaatgttgttggcttgtaaataaggaaattgcagctcagagaagcttctgtatttccaaaaggttataatgtcaatatgtggaggagctggaatccagatttttgggctacaaatctttcctcctgtaccatgttgcctgcagagttgtgttcggataaatgtttttactgatccatggctcaccactgattaaagaaaaagtgtaaatgttacctttaagatgtcctgatgaggaacaaataaaattaattaaaaatatattatgacaaattattcaatataacataacttcataataccgtaattcatttggagcataactttacacaaaagagatgaaattcttaattttcagttttattttctatacaaattaataaaaataataaacttattcctcacccatgatctgaatttcgggtaaatttctaatggaagtagatacattgtcaaatgttttcaagttatcacctccgattttccaaatagaaactccaagaattacctttcagatttcattgttcattcattacacatctctctacccattcattcattcattcatccaatcatccaaatgacatttacggaatgtctactttgaggcaagcaaaaagtcaaaggtagactctacctgaagctcttgctgctgctttacttccctagactatgaactccttgaagacaggggatcctgttattctacacagaatataatcagttctatttgcagaaaatcacttaaatacttttttgacagtgagatttctggctccccctgccgcccacatgcccctccagacatatgggagttagaggaagaaatagcagagtctgcttatcaagtctgacctttggataatgactatagttctcccatctgagcttgctgctgttctgccttgtggtcaacaaaatgatttggctcaaaatggcaattcatctgttgctgcttcccagatatcctctagcaagccacattattttttttaaaatggttgcttctgcccttcggcatagaggtgaactgtatcaccaaatatattgtcttgcttgatacagtgagaagctggggtttacagaaaagatgcagataaacatgaagcagccgcgaaagaagaaacattcgtttagtgctatgactaaacaaatgcttgactttattattttaacaacaataatttatattcagagactgctattatcctttcaactttgcttcacatccacctcacagctactttgtgaggtgaccagagaaggcattattacaaagttaaaatacggaattctaaagctcagagacgctaaagtgacttgtttaaagttccacagcaagccagtggcagagtttggtctcccaactaacactccagggatcaggcttctctattaggggtcctagtcaacaggagagttgcatttttaataattactaggagccatgaagaactaatccattgtttcagtttgtactattgcctagttaattatttagaaatgatttattaaaaacaagaagtgaggaaaccatcatgctaagcaggcaattctggacaagagacttctttcaagcaaactgaacattgattaagctcaaaaagttagtatttaaataaacaaaggcaatggtaaaaatattttgtctgtattagaattccttgtagttatgcaaggatgaagcccgttatgccatgatacattttttattcacaaataatgaaggcatgaatgagtattacttatggaacatttctgcagtttctagactccttctaaaatgtaagaatatgggctttatgcatatttggtgcaaaatatttgttggatcatgtaatatttttaaaagtgaataatttataaaatcatagagggtcttctgatttttattatcatttaatatttaattctacaaaacagaattaaatactttgttttgaaaatagtttattaaacacagttgcatttcttcatctttctaggcctcatcttcaagattatgtgggattttattaactgatttttctaagcctctggcttctttcttcctcactgtaagtgaaccacaggctatattacacacatatattttgttaaaatacatgttacttccattgcttcctggaccaccacaaaagagagcccttagtgatccaagtcaattcacccatatttaaaaccttttacatttcaaaaacatgtattataacatgattagatctgtactttacaaataagccagaaagtgacatatgtggcttaattaccaaccccaaataattagtgttggagcaagaaaatgaattaaatggaacacagcccagtcatcctagcaaaagggattacagataggagctggaataactttgggagaagccaaacatatataagaaggttaatgaattaaaaagttgttataggtaattcaaaagaaaaagaaaaatgctgactactaccaaaaaattccacagcatattactgaaactgccacatcaaatactttaacatacccctccctagggacggatagaagtttgcttggtatagtgtattttctagcataacattgtgataaaaggatctgaaaataaaaagaaatgaattgtatttttttccaaaagctatacaatgaattcaccttttcacagaggatagagatcatgaagaaaagtgaaattcatatggaccccaaacctctcattttggcccatagtttctgcctccttccccatcagaatctccaccagagcactaacaggtagcaaaattggctgatagaagcatcattctcctattccttccctgcccaccctctggtaaaagaattaatgagcagtaaaattaccaaaagtgaggcagcagaatggagaataaagaataccaagggtatggataacctacaaaccagataatgagctcctgaataatcaagacttgacttaaacctcaaacctctaaccttctggcttagacccatcattctatacttatatttagtgtcttaaacacagaactgccacagaattgcagtttgtctctaagtccttgtttataggaaatggggggcaagaagtgatgtctaaactttggcactttgaacactgttagtagcctctcttgacactccattatttccctcgtcttgggcacccaaagatgttattaacctttgtaggagtcctgaacattataagaggtagttgacaattgcactagtatctcttcttccctctcaatgcagataccagccttcagctgttccatcacattcacctaaaaggcttctctttggtttttctttaaaactttcttccttctcttccttcccattacttaatgtagtggggccactgcacaaaaatactctttgtcccctaccactaaaaaggtgatcctacttttagaattcacgtcaatttttcacaagcttcctgttataactattttatccagatccagatacatttctcaactcaattttctgaatcctggtatcttccttggtgcataagccattaatatctcaattcgcagagatctcacacttcctggtaaaactttgcccattccacttaactatggtctgaatgcttgtgttccctgttacccaaaattcataggttgaaacctaatccccaagggtgatgttagtaagacatggggtgtttgaggggtgattaggttgacatcccacatgaatgggattagtgtccttatgaaaggggcctgagggagtttgtcccttccaccatatgaggacacatacaaggtaccatacatgaggcagaaagccctcaccagatgccagatctgctggcactttcatcttggacttctcagcttctaaactgtatgcaataaatttctgtttataaactactcagtattttgttatagcagcccgaacagactaaaacaccatcacagtgatggtttcaaggcagcttttggacttcaaaactgcttttccatattttcagaaatgttctttcaacaaataatgccaagaataaaggaaaaagggttaccaagtccggaagaacatttaagctgaatgtcgtggaacggcagggaataacagtccaggattcttaaattagagaaataaattcctagggaaaatgtctgagacagtatcagtaacaaagtattccttgtgaccatgccacactggctgcccattctacgctctgcctgtgttcctttttgttttaaaaattgctttcgagccatgtgtaagtacagtttctttttcctaagctaatggcatcttgtctgctcaacactcaccctcacccctggcacaatcatgggtacacatgcacatttacacaccaccatatgtcatatccatagacactcaatacatgctgggacacattttacaatggtcctctcgctaccttgccctggtatcaactcgatctctttctatcacttattctcacttcattagaggcatggaactgaggcagacatagtgaatggagttactgtctcctttatttaggaaaaaatgtcaatgtcagaagcaaagtttgactctgtgatggcaatgattgttcctgctcgcagctgaagaggatgagaggaaacccagattggaagtatttattcccaaggctttactataaggaaacaagtaattttatcagaaacaagtaatccataatttgctgtacctcaactgcagtggtatgctcaactagtagagttcacatagaaatacttggatctgtttgcaggagattgcttctaccagactgggcaaggtgtggtctcagagtgcattatcatttaaacaaaggatgctatgaatcacagatgacagaaccagaaaaacgcttgctctagtgtacaaagtttggctgatacttaacctttgctaggggaaaaggaaaaaattgcaggctgctacaccggcagcctagaacacctttttaactacattcaagccttttactgttacagaacattattactgttaatactgccatgtgtgactgagaatttgtaccactgacttactgaaaaagcatcttctacttaacaaattcaaataaatttaattctatgtactagcagaagtaattaaaagcaaatgaataaggactgcataactgcataaatatttccataaattcttgcacaaaagaaggataatgagtggacaatagaatgctaaaatattaacaatgcatcataagaatttaaaaaaaaatttttttccaaatcagcaagatgtactaaaatgtaacttttatcattattagagcttaagttctccttctagaattaccactgactcactaagggctttgtgctaatcattcaatcagatttcacattcatgatatttattctgaaacagcctaatggggctcaaggactaaaataacctcattaattagattccctcacatggagtccaagatgaaaactatcaacaccaaatagcactctacagttacaaagatgtttcatatcatttcatatttacaaaggtatttcatatcatttcatgtttaatttttataactctgggggttaaagtaggtattattattactttcttaaaaaatgagaaaactgaggtttaaaaaggttaattggcctgatagagttcattaagtgttaaactggtctcaggactccaattttagtgttctagcacatagtacagtgcctaacacatatgggtattcaattagcatttgttgaattgagtgaatgaatatagcatgctacttctcctaactacacttgacctaattttactcatttgcaaacagccctatagttgcattccaaagtagttgataaggtcatttactttccaataaggaagcaaaatgccactgtgaaaataaatttagccatctattttggtgacataaggcccatgagctgaaagaataagatattcaatgtccagctgttataaagtttggaaaaaagttggtaaaaatattcgtatggttgctttaaaatgatgaactgattatcactattattttgttggggagggacctttcagtaaggttgcatggaaaagcagattaaaattgggaaaggcatttgagttcccaacatgaaaatcaacaatgcctcttgttatgcctttcattcacagacagagaaaaagaagtttcagagttggcagggaccttggcagtcacctagtctaactgctgtctcttcctcccctccactgctgccattttactagaagtcacagctaattaatggcagatccagcactagaccccagtcttcttactggcaggactcctcatggaagcagttggggacttatattctctctataggtgccatctaaaattattcattttagtctaaagtccttccttaaccaaggtgagtaccatatagccctgcttgaaaatataggattcccttacagtacagcttaagtggcaataggttgtgttatggttaaatgcttctctggccttttcaaacaaccagaatagtagactaagaagggctctggagtcaaactgtctagcatgacaatcctgccctgccacttactgactgtgcagctttggaagaaaattaactcctcgaacattgatttctttgtccgtaaatgaggatattatctacttcacagagctttgtggaacttatatgaaacaattcaagcaaagcatagtcaacagataacctgatacatagcaaaaatactcagtaaaaatgagttgacttttactcattcttccttacttgtagttgccctagatacctgagcttaaactgatcaaataaaccttggatgactttccttttattcaattaacatttattgagcaattactacatgctaggttcttgaaatacagcagtgaacaaaacagacaaaaatccaggccttcatggagctcacattctagtagcagacacagaaaataaacaaaataaataggtaaaatatatagtatgttggtgattaagtgctttgtccaaatacaggaagtacattaggtatgttagcaaaagctgtgacctcattttctaggaaacatttggtgtctcttaccttcctcacctgtttttttttagagctaagacaacaaaaactaagacttctttacatagccccttctaatcttgggatataaaggtaaatggcataaaatatggataggtgagttgtgtatgtgaatgggttagaaggtattactggtaattgaattattcagaaagcaagttccaatatttagccataaaactggaattaaaaatgtgtacaaaaataccaccaattaggttaaaaggagggcatatgcagcgttggaaagaaatttcaaaatctgtaacatctgtaaagctggcagagattgttactgattgtagcaggaaggggtagatcccaaactctggcaaacgtgatttgggtgggatagcaaatagcctagcaagactaaaaaatcgttttgagaataaccctatatcataaggacctctccttaatttatgttctccaagcactttcagtctctatcatcttattgagctatgaaatgtatagatgttcatttcgtatattgtctctcacttcacagaactagagagactaaactactaattttatatctttcttagtatatcatagaatgcacatttatggtaggctactaattgaccttgtatgtgatataaagaccaatacatttttagttatttttaattacaaagtctggtcaatattttcttcaagatcctctggcctggaagtgagtttctgttatgttcctattgagcaacaagaaatagtgacaaaggtgacaaatgcaacaaatgacaatgttcatgagagttttattaagtttattaacagagacatactgctttacttacctgaagatatcagaaaattacaatttgtttcatctttgttggtagctgcactagctgttccattacagaggaggagttgatttatgtgcagctgttgaaaacacaatgaaccagtcaccacaattttaacaagtgttaatgctggcatatccacttcagatagcatttataacactgtcatgaagaaagtttacagtatactacctaaagtaatgatgctagttccacatttgccaaatttggtgtcactactatagtactggattctactgggatgacaataaaaattcactctttcatggtcctttaaacaaggccaaagcatatgtccaagatcgatgtttttttattctccccaaagtaagctttataacacttggactgggaaaaaacaaagtttgttttattatccacaattaagtccctccttagatttgtctccctcttctcattctttatgtattaaaattgtgagtagaacaatttagtcatagttacaattaggaaaggggtacatttttactacaagttaaagttaagtcttcacccccaagaaagttacaaaatgtgtgtcgtgtgtgtgtgtgtgtatgtgtgcatgtgcgtgtgtgtatctgcagaaaagaggtagacaaggagcaataatacaatgtgatacatacttaaaaagcaccaaaaaatggagcgagatgattgaaagtggaaagacctgagctaaatggtggactagagcttcttgcactcctctccccacagaaacatcaatttgaacaactacctacacacaaaaatacctacccaagagtgaaggaaaccaggtgagagatgacagcactttggtggagctcagaaataagaaatgatacacggaagagtgtaagacagacagttttatactacccacgtcaatccctctcccaaccccatgcagcacagtatggaaagataccctctgcttggtagaagaggagggaagtgagcaccagacgttaccttggaccccaacaccaggctgcctcagtaaatcccactgctgggcaggctcccatggacccagactttaggctggtactcacagactgaacctctaagcccaccatggcatcaggatagctcccacagactcaatatccagccacgacatgtagactcagtctccaggtccaccgcagggctaggccagcctcagtagccccagacttcagactgcccccagcaccaggctggccatgatggccctaggcttcaggcccaccatagcaccaggtcagcccccacagtcctattcatcaggccaacactcctggatatagcctctaggactgcccagtgccaggccagctcctgaagcctcagactccaggcctattccaggcttcagactaacccacagctaagtaggcccatgtagtcttaggtttcatgcctgccccaatgtcaggtcagcaccctgacctcaggcactaggctagaccccatgaacataggtttcaggcctgcccagtgccaggccaagtccctgtgggcccaccatccaggcctgtccctgtggcccactgcttcttcagcaaacccatggtccaggcctgccccaacagacgaagggtccaggcctatcccagtagacccaagcactgggccagccctgacagacccaggcgtcaggccagccccacagtcccacgttgcaaaccatctccactagctccaggaaccaggctggcccctgcacacctaagctctatgactgccccagcatcagactagcctcaggttcaaggctagtctctgttacccaaggcttcagcggccttagggaccaggcctgcttcagaaaacccagggtactgcccaccccagtagaccctggttccaggacagcccccaatggaccaaggctctagaatcacccctgcagactcaggctctaggccagtccctgtgaattcaggctatctgcctacatgagtggtcgcaggtactaggctcaccacagtgccagaccagccctcaaggactcaggcttcaggctcatcccagtggacccagatgccaggcccatcccagcatctggctagcccctgcagactcaggtgcaaggcccagcccagcaccaagccagcccctgggactcaggctttaggccagcctccaaggatacagtttccagtcctaccctaatggacttaggctccaggtttattcaagtagactcaatcaacagatacgccacagtgaatccagactccaggctcaaccccaaccagccaggcactaggtccatccacctgctgacccaggcaccaggccagcctgctcaaagactccaagagcaagcctgcctgtggatcacaccaaatggtcttcccagaatctctaaatggactgactagtgaagggcttttggagacgaagccagtttacaaaactagaataagcccatacttttttaaatgtgcagataccaatccaaaaatatcaataatgatcaaggaaatacaatcccaccaaaagaacaaaataaagctccagtagccaactctaaagatataaagatttataatatgtctgacaaataagtcaaattgttttaagaaagcttagcaaacttacaaaacatacagagaaacaattcattgaaataaaaaaacaataaatgaccaaaatgagaaactaaaacatttaacagagattgaaattattaaacaaacaaacaaacaaacaaattctggagctgaaaaatacaatgaattaaatgaaaaatgcaatacagagagtcaacagcaggcttgatcaggcaggagaatgtgtgaacttgaaggcaggttatttgaaaatatacagtaagaggaaaaaaaagaatgaaaataaaggatgcgagctcacaggatttatggggtagcatcaatagagcaaacattagttatagaaattaaagtagaagagaaagatgacaaaggggtataaagcttattgcttaaataaaatagtagaaaactttccaaatctgggaaaagatataaataaccaggtaaaagaagatcaaaagtctcaaatcagattcaatccaaaaaagactatactcagacatataatcaaactgtcaaaaagccaagacaaacagggcatcctgaaagcaataagagaaaagaggcaaatcacatataagggaaattcagtaaggctagcagtggatttctcagcagaaacgttacaggccaggagagagcagcataatatatttaaagagttaaagaaaaaagaaacctagcaactaagaataaactttacacagcaaagctgtccttcaaaaatgagattcaaagcataccactaaaggaaatcacttcatcacaaaagaagatggcaagagaggaagaaaggaataacggatctgcaaaacaaccagaagacaatgaacaaaatggcagtagttaattcttacttatcaataattaccatgaatgtaaatgaaagaaatgaacaagaaacaaataaatggaaagatatcccatgtttgtggattaaaataattaacattcttaaaatgttcatattaccaaggcaatctacagagtaaatgcaatccctatcaaaatttcacagacattttttacaaaaatcgaaaaatcaatcctgaaatttgtgcggaaccacaaaagaccccaaataaagcatcctgagcaaaaagaacaaagttaggggcagcacactacctgacttcaaaatgtactacaaagctatagtaactaaaagagcataggttgagtatccctaatctgaaattctgaaatctaaaacactccaaaatccaaaattttttgagcagtgacatgacgctaaaagaaaatgctcattggagtatttcagatttcagatttttgaattacgaacgcttaaccagtaggtataatgcaaatattccaaaatctgaaaaatccccaaatctgaaacacttctggtcccaagcattttagataagggatactcaacctacactggcataacaacagatacatataccaatggaacaaaatagagagcttagaaataaatccattcctttaaagtcaattgattttcaacaaacgtgccaagaacacgcaaggagaaaggacagtctcttcaataaatggtgctgggaaaaccgtatatgcacattcagaagaatgacattaaaccttatcttacacatatacaaaaatcaatgcaatatggattagggacttgaatgtaagacctaaagctataacatcactataagaaaatgaagaaagggggtggctggaaagatggctgaataggaacagctctggtctgcagctcccagcaagatcaatgcagaaggtgggtgatttcttcatttccaactgaggtatctggctcatctcactgggactggttagacagtgggcacagcccaagaaaggtgggctgaagcagggtggggcatcacctcacgcgggaagctcaaggggtcagggaaccccctcccctagccaagggaagccatgagggactgtgccataaaacggtgaattccgacccagatactatgcttttcccacggtcttcacaacccgcagacaaaaagattccctcaggtgcctataccaccagggcccaggatttcaagcataaaagtgggcggccgtttgggcagacaccgaactagctgcagttttgttttcataccccagtggcgcctggaacgccagcaagacagaaccgtttgctcccctggaaaggaggttgaagctagggagccaagtggtctagctcagtggatcccacccccatggagccaagctaagatccactggcttgaaattctcgctgctagcacagcagtctgaagttgaccttggatgctcgagcttggtggggagagggacatctgcaattactgagacttgagtaggtggtttccccctcacactgtaaacaaagccaccaggaggttcgaagggggtggagcccatggcagctcagcaaagccactgtagccaggctgcctctctagcttcctcctctctgggaaaggcatctctgaaagaaaggcagcagccccagtcaggggattatagataaaactcccatctccccgggacagagcacctgcaggaaggggcagctatgggcgcagcttcagcagacttaaatgttcctgcctgctggctctgaagacagcagcagatctcccagcacagctctcgagctctgctaagagacagactgcctcctcaagtgggtccctgacctccttgcctcctgactgggagatacctcccagcagtggtcgacagacacttcatacaggagagctccggctggcatctggtgggtgaccctctggggtgaagcttcaaaaggaaaaaagaggcagcaatctttgctgttctgtagcctctgctggtgatactcaggcaaaaagggtctcgagtggacctccagcaaactccagcagacctgcagcagaggttcctgactgttagaaggaaaactaacaaacagaaaggaatagcatcaacatcaacaaaaaggacctccacacagaaaccccatctgatggtcaccaacatcaaagatcaaaggtagataaatccacgaagatgaggaaaaaccagtgcaaaaagtctgaaaattccaaaaaccagaacgcctcttttccttcaaaggatcacaactccttgccagcagagaacaaaactggacagggaatgagtttgatgaattgacagaagtaggcttcagaaggtgggtaataacaaactcctccgagctaaaggagcatgttctaacccaatgcaaggaagctaagaaccttgaaaaaaaggtttgaggaattgctaactagaataaccagtttagagaagaacataaatgacctgatggagctgaaaaacacagcacgagaacttcgtgaagcatacacaagtatcaatagccgagtcgatcaagaggaagaaaggacatcagagatcaaagatcaacttaatgaaataaagcatgaagacagattagagaaaaaagaatgaaaaggaatgaataaagcttccaagaaatatgggactatgtgaaaaagaccaaacctatgtttgattggtgtacctgaaagtgacaggaacaatggaaccaagttgcaaaacactcttcaggatattatccaggagaacttctccaacctagcaagacaggccaacacttaaattcaggaaatacagagaacaccacaaagatactcctcgagaagagcaaccctaagacatataatcatcagattcaccaaggctgaaatgaaggaaaaaatgttaagggtagccagagagaaacgtcaggttacccaaaaagggaagcccatcagactaacagcagatctctgcagaagctctataagccagaagagagtgaggggcaatattcaacatttttaaacaaaagaattttcatcccagaatttcatatccatcgaaactaagcttcataagtgaaggagaaataaaatcctttaaagacaagcaaatactgagaggtttggtcaccaccaggcctgccttacaagagctcctgaaggaagcactaaatatgcaaaggaaaaacaggtaccagccactgcaaaaacatacctaatcgtaaagaccatcaacactatgaagacactgcatcaactaatgggcaaaataaccagctagcatcatcatgacaggatcaaattcacacataacaatattaaccttaaatataaatgggctaaatgtcccaattagcaaattgggactggcaaattggatagagtcaagacccatcggtgtgctgtaatcaggagacccatctcatgtgcaaagacacacacaggctcaaaataaagggatggaggaatatttaccaagcaaatggaaagcaaaacaaaaacaaacaaacaaacaaaaaaagcaggggttgcaatcctattctctgataaaacagactttaaaccaacaaagaccaaaaaagacaacgaagagcattacagtatggtaaagggatcaatgcaacaagaagagctaactatcctaaatatatatgcacccaattcaggagcacccagattcataaagcaagttcttagatacctacaaagagacttagactcccacacaataatagtgggagattttaacaccccactgtcaatattagagagatcaatgagacagaaaattaataaggatatccaggacttgaactcagctctggaccaagcagccctattagacatctacagaactctccagcccaaatcaacagaatatacattcttctcagcaccacatcatacttattctaaaactgaccacataattggaagtaaaacactcctcagcaaatgcaaaagaacagaaatcataacagtctctcagacaacaatgcaatcaaattagaactcaggataaagaaactcacacaaaaccgcacatttacatggaaactgaacaacctgctcctgaaagactactgggtaaataacgaaattaaggcagaaataaatacgttctttgacaccagtgagaacaaagacacaatgtactagaatctctgggacacagctaaagcagtgtttagagagaaatttagacactaaatacccacaggagaaagtgggaaagatgtagaatcgaaaccctaacatcacaattaaaagaactaaagcagcaagagcaaacaaattcaaaagctagcagaagacaagaaataactaagatcagagcagaactgaaggagatagagacacaaaaaaacccttcaaaaagaaaatcaatgaatccaggagctgattttttgaaaagattaacaaaatagatagactactatccaggctaataaagaagaaaggagaaaagaatcaaacagacacaataaaactgataaagcggagatcaccactgatcccacagaaatacaaactaccatcagagaatagtataaacacctctacgtaaataaattggaaaatctggaacaaatggataaattgctgaacacataaactctcccaagactaaaccaggaagaagtcaaatccctgaatagaccaataacaagttctgaaattgaggcagtaattaatagcctaccaaccaaaaaaagcccagaaccagatggattcacagccaaattctaccaaaggtacaaagaggagctggtaccattccttctgtaactattccaaacaacagaaagaaagggactcctccctaactcattttatgaggccagtatcatcctgataccaaaacctggcagagacacaacaaaaaaagaaaatttcaggccaatatccctgatgaacattgatgcaaaaatcctcaataaaatactgaccaaccgaatccagcagcacatcaaaaagcttacctaccacgatcaagttggcttcatccttgggatgcaaggctgattcaatacacgcaaatcaataaatgtaatccatcacataaacggaaccaatgacaaaaaccacgattatctcaatagatgcagaaaaggtcttccatgaaattcaacaccacttcatgccaaaaattatcaataaactaggtattgatggaacatatttcaaaatagtaagagctatttatgacaaaaccacagccaatatcatactgaatgggcagaagctggaagcattccctttgaaaactggcacaagacaaggatgccctctctcaccacttctattcaacatagtattggaagttctggccagggcaatcaggcaagagaaagaaataaagggtattcaaataggaagacaggaagtcaaattgtctctgtttgcagatgacatgattgtatatttagaaaaccccatcgtctcagcccaaaatctccttaagctgataagcaacttccgcaaggtctcaggatacaaaattaatgtgcaaaaatcacaagcattcctatacaccaattatagacagccaaatcatgagtgaactcccattcacaattgctacaaagagaataaaatacctaggaatacaacttacaagggactcttcaaggagaactacaaaccactgctcaagcaaataagagaggacataaagaaatggaaaaacatcccgtgctcatggataggaggaatcaatatcatgaaaatggccacactgcccaaagtaatttacagatttaatattatccccatcaagctaccattgactttctgcatggaattagaaaaaactacttaaaatttcatatggaacaaaaaagagcccatatagccaagacaatcctaagcaaaaagaacaaagctggaggcatcacgctacctgacttcaaactatactacaaggctacggtaaccaaaacagcatggtactggtaccaaaacagatatacagaccaatggaacagaacagagacctcagaaataatgccacatatctacaaccatctgattgttgacaaacctgacaaaaacaagcaatggggaaaggattccctatttaataaatggtattggaaaaactggctagccatatgcagaaaaccgaaactggactccttccttacacctaatacaaaaattaactcaagatggattaaagacttaaacgtaagacctaaaaccataaaaaccctagaagaaaacctaggcaataccattcatgactaaaacactaaaaacaatggcaacaaaagccaaaattgacaaatgagatctgattaaactaaagagcttctgcatagcaaaagaaactaccatcagagtgaacaggcaacctacagaatgggagaaaaattttgcaatctatccatctgacaaagggctaatatccagaatctacaaggaacttaaacaaatttacaagaatgaaaacaaacaactccatcaaaaagtgggcaaaggatatgaacaggcacttctcaaaagaagacatttatgtggccaacaaacatatgaaaaaaagctcatcatcaccagtcattagagaaatgcaaatcaaaaccacaatgagataccatttcacaccagttagaatggcgatcattaaaaagtcaggaaacgaaagatgctggggaggatgtggagaaacaggaacgctttcacactgctggtgagtatgtaaattagttcacctattgtggaagacagtgtggcaattcctcgaggacccaggaccagaaataccatttgacccggcaatctcattactgggtatatacccaaaggattataaatcattctaatataaaacacacgcacacgtatgtttattgcagcactattgacaatagcaaagacttggaaccaatccaaatgcccatcaatgatagactggataaagaaaatgtggcaaataaatatcatggaatactatgcagccataaaaaaggatgagttcatgtcttttgcagggacatggatgaagctggaaagcatccttctccgcaaactaacacaggaacagaaaaccaaacactgcatgttctcactcataagtgggagttgaacaatgagaacacatggacacagggaggggaacatcacacactggggcctgtcagcgggtgggagggtagaggaggagaaatacctaatgcagatgacaggttgatgggtgcagcaaaccaccatggcacgtgtatacctatataacaaacctgcatgttctgcacatgtatcccagaacttaaagtataattaaaaaagaaaaacaaaacaaagaaaaaaggcaccatgacattggtctgggcaatgattttagggataggaccccaaaagcacacaacaaaaacaaaaatagacaaataggatacacatcaatctaaaaagcttctgcatagcaaaggaaacaatagactgaagggacaacctacagaatgggagaaaacattcgcaaaccatttatctgataaggaattactatccaaaatatgtaaggaattcaattcaatagcaggaaaataacccgattttaaaaatggacaaaggacctgaatagacatttctcaaaagaagacattctgatagccaacaggtatgtgaaaagatgctcaatgttactaattatcagggaaatgcagataaaaccacaatgagttatcaccccacacctgacagaatggctattatcaaaaagatgaaagataacatgtgttagtgagaatctggagaaaagggagtgcttgcacattgttggtggtaatataaattagtatagccattatggaaaagagtatggaggttcctcataaaattaaaaatagaactaccatatgacctagcaatcccacttttaggtgtccatccaaaggaaataaattcagtatgtccaaacaggtatctacacttccatgttcattgcagcactattcattatagccaagatgtggaatcaacctaagtttccatcaacagatgaataaagaaaataaggaaaatatatacaaaagaattctattcagcatttaaaaggaaagaaatcttgtcatttgccaacgacatggatgaaagtggagaacattacgttaagtgaaataagccaggcacagaaagacaaataccacatgatctcacttatatgtggaatctacaaaaattaaactcacagaagcagagtagaatggtggttaccaggaagtggttgggggatgaggagttgaggatattatggtcaaagggtgcaaaatttcagttagaaaggaggactaaattcaagagatctattgtaaaacatggtgactacagttaataataatgtattcttgaaaatcactaagagagtacattttaagtgttctcaccacaaaatatgttaagtatgtgatgtaacacatatgttaattagctcaatttagttattccacaatttatgcatatttcaaaacatcatgtcattaaatatatacaacttttatttgttaattaaaaataaaattttttttaaaaaagaaaagaaatgactaattctctggggaggggtgacctcttcagtaagttatgtttgagctcattcttaaagaataactgggtatatacccaaatgactataaatcatgctgctataaagacacatgcacacgtatgtttactgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacaaggacacaggaaggggaatatcacactctggggacggtggtggggtcgggggaggggggagggatagcagtgggagatatacctaatgctagatgacgagttagtgggtgcagcacaccagcatggcacatgtatacatatgtaactaacctgcacaatgtgcacatgtaccctaaaacttaaagtataataaaaaaaaaaattaaaaaaaaaataaataaataaaaataaataaataaattaaaaaaaaaaaaaaaaaaaaaaaaaaagaataagtagggcaggccaggcgcagtggctactgcaggtaatcccagcactttgggaggccgaggcaggtggatcacttaagtccaggggtttgaggccagcctgggcaaaatggcaaaaccccgtttctacaaaaaacaaaaaaaattagacaggcttagtggcaagcatctgtagtcccagctactcaggcagctgaggcaggaggaattgcttgagctcaggaggcagaggttgcagtgagccgagatcgcaccactgcactccagcctgggtgacagagtgagactccgtctcaaaaaaaaaaaaaaaaaaaaaaaagagagagaataagtagaacacagaggagaggaagtgaaacgagagcagagcatttcaggccagacggactgctggagcaaaggcacaaagtgcacagaatgcaaaagtaaattcaaggaaaagttaatgttcctgtaaggcttgaatgtacagatggtccttgacatatgatggtttgacttatgatttttcaacttcacaatagtgcgaaagcaacatcgttcaatagaaatactacttcaaattttgaattttgatattttccgaggctagcaatatgtggtacaatactttcttgacatgccaggcagcagcaaaaagccattctgtttttcactttcaatacagtgttcaataaattgcataagatattcaataatttgtagggacatggatgaagctggaaaccatcattctcagcaaactatcccaaggacaaaaaaccaaacaccgcatgttctcactcctaggtgggaactgaacaatgagaacacatggacacaggaaggggaacatcacacactggggactgttgtggggtagggggagggggaagggatagcattaggagatatacctaatgctaaatgatgagttaatgggtgcagcacaccaacatggcacatgtatacatatgtaacaaacctgcacgttgtgcacatgtaccctaaaacttaaagtataataataataaaaaaagaaaaaaaaagatattcaatactttattataaaatgggttttgtgttaggtgattttgcccaactgtaggctaatataagtgttctgagcacatttaaagtagtaggctagactaagctgtgatgtttgctagattaggtatattaaatgcatttttaacttacaatattttcaacttataatgtgtttattgggatgtaaccccattgtaagtcaaggagcatctgtaatgtaaaagggtgctgacgggtagagtgaccatgcctatccttttattttactatgagacttggatgctaactgtcttctttcatagtttaatcagcatcacctggaagtctaacagaagaacacccacactaaactcctctaacaaaaccaggctactggcagatatatagaggggcagaaaatctgcaaaataaaagataatcaggaaaaataaatgggacaatgaaaagtatagaaatgatttttaaaggatgctcacctcaaacacacctgagagagtgttggtgagtggcagcagaccttaggggataggatggctgtttctgataaggattcgagccgagaataccagaagcacagtcttatatgaaaaaaatctaaaaaaatcttctagtagtggctttcactgcaaaatcagagctttcacatggaggcagcatgcaaaagacagccatttgccaatagagatcaaaagtcatgatacagatcatctttaaatgcaaagggcaataatttataagtcagatgctgctgatgtatgcatttgaccaagagtcacatatttgccagcccacatccacatattagaccttctgttctttattaaaataatatatttttctgactttttggaacacaggtcaccaactttggtgttacagaatggtcttggagcttcctctccaaatatacttcactatcctcactccctcttccctctctgatcttttacaacttatctttcttcttcattattttttcttctcttagcttatgtcttccgagagcatctatgggaattatctggggcactaccaatgacactcaagggttgaaagagactacagatgtgtacgaaaagccctccaagagatattagtagaattccttaaaaaatctgcatgatctggaattggaaaaattcttaatgaacatttgaaatcattagaatacatttaactcattatttctcatgccataaaactattagagctggagtggccttagagactataaaacaatttcttcactttatatttgggaaaaatgagaagagaggtgaaattatttatccaaggcaaatagctgttgataaaggaactgacagatttcttaggaaatggcttttttccaggttgaaagaaatataccgaattatttacctagcttcctttttattgcagaaaaaaacacaaataacatgatatctaccctcttaacaaaattttaaatgtacaatagagtattgctaactacctgtacattgttgtacagcagatgtctagatctttttcatcttccataactttagttagttttcttcaagggtctactgaagttacatttttagtgatagcaactctcgtacatttgcaggtaacttccaaagcttattttatgtgaagtcatatcaatataatctggtgtcttacttcaagttgcttcattttaatttaatgagaagtattccaggttgtgtgagaatgatactctcttttacacagttttatatttaaagaataggaccttgatatattttattccagtaaaattaaaagggcttgttcagcaaaggcagtaagtaaagttaaaagacaagctgcaggctgggaaaggatatttacaaagcatgagggattagtatccttcaaatcaataacaaaaagactaacaaccaaatagaataacgagcaaatgatatgaataggcaattctcagaaaaggaaacccacatggccaataaacacatggaaagctaataaacctcactaataaatgggaaaatgcacattaaaacacagtgagacattatttcatacctatgaaattgatgaaatatttaagactgacaatactgagggctggagatgtggaacccccatgaactatctgtggaagtataaagtggtacaacaactttggagaacaatttggcaatatctagtaaagttgaagatgcataccttccgcaacccagcaacaccactttaaggtgaaaaatatctcacacacatgcacaaaatgacatgaaaaaatgatgtgtataggaatgcttttcgtaatagtaaaaaatgagaagcaatctgagacatccatcaacaaggaaattgacaaatacattaagaaatagtcattcataaaatgaaatattctacagctgttaaaatgaatggatatgtatagtaatatagataaatctcaaaaatatagagtgaaaaaagcaagttactttatgatacatacagtattatacaaattttacaaacatttaaactatgccaaatactgttcctaaattcatacatgtgtacaaacacatggctggtaaagggccacaccaacttcgggggggtacttcctctgggtatgaagggagggaaatttcattagggaagggcacaaagtaaacttcaactggtatatggtatatctgtattcttaagtggctggaaacaaatacagaaaatattaatgtttggtaaatctgtatggtgagtataactgtacggtagttctcccttaactgcagttttgctttccacagtttcagttatctgtggtcaagcacagtctggaaatattaaatggaaaattccagaaataaacaattcctaagttttaaattgtacaccattctgagtagcacaattgaatctcactcattctactccatttcatctgaggcatggatgatttacggcctcattcagagtagccatgctgtatacactacctacccattagtcacttagtagacctctcagttatcatgtcaatagattacaagaggaagaaggctgagtacaatgcataagatattatgagagagagaaaaagagagagagggaggaagaggaggaccatattaatataacttattacagtatattgttatagttgttctattttattattggttattgttgttaatctcttactgtacctaatttatatattaagctttatcataggtaggtataggaaaaaatatagcattatataaggttcagtaccatccatggttttaggtttccactgggaatctgggaacatattccctgcagaaaaaaaggactactgtataccatgttttctctatatttaaaatttttcataatacgatgttttatgaaagaatagagaagtgtgttttctttacaactatcaatagtcacattcaaaaactaaagttaaccatgtggtagacattatgtcaactctgaaccctgctttgtcagccatcaacttacacagtccaaacagacagagttgggctttggtgccctttttgtaaataaataaataaaagtcccacaaagagataagcatatgtaattacacattatagtcgttcaccatatgtattgtcaagtgcataccaggatcacatttaaaaccattcattttctgtgcctcagaagtgctagcatctgcagacattagatccatattcaagccagtgagatgagttaccatggccctctgttaattatacacaacattctctactttccttgtgaagagtgctgtgcttggcttgggtccagacatcaatttgtggggtaaagtgtttttaggtttaagaaaaaacaaggcagtggtttgttgctttgtaaatggtgtaggaaaatttttaaaagtgaacaagagataattcaaacatatacaactgaaagcttgttagtagctagagctcagtgaaggaagaaaatcctagaaagtctgggaaggaaatgacttcaactaattttagaaagtgatttatatggtcttaaaatggtttaaaaataaatggtcattattcaaatcacatagaccagtggtttctgagtctatgttaatatcaggaaattatactcacttattggggcttggatagataaaacagcctgtgtgttgatggacacaactctactaaatagagtaactaacccagccaaaatgcagaaacttgttaaaagcatctaaattcatggtcagtgcaaatacacaattatctgcagtcgggataaccaaaataaacaacactcagaaccataagaaggttctaaaaaacattcaagattgagaacttgacttttatgagttagaaaagtaatcaacgagcaaaagcagttcatgctaggccagggtttcatccattcagtgtattcagggacaaagccaacaattcacaaggtctgaaaagccatgcagtttctccaagtttaggcagaggcacagctacctgtaaatgggttgatatctaagtgtagatagatatacacaccaaattactgcacaactttgcagtgattctgccccctctgactggaatgctcttccccacttctctttgctaggttgcaattactcattctctaaaagcctcagcatgaacattacttctgtgggaagcatttctaccttttctaccctctacatctaaggttctgctaggtactctactatgctctgacaatcccccattacagtacttaaactttttaaagagtctgttgtcttccttatttggccataagctcatgagccaagagtcattcctgtcttgattattatatttttcccccagcatattacagtatctggcatatagtagaacttaataaatatctgttgactatattaatgaataaataaatagatacatagccagataaaagtatattaatgtccatccaattctacacagttcaaagtaaccattttttaaaagccaatgaggaaaaaaagtatgtttgaaaacatgaggatttatgtgtgcatgtctctttaagtttgatgatgatggtgaagtgtgcatgtgtttatgggtaagggaggggctttctaaatacacaaatactggtatacataaataattcctgaagagtcataattcctcggatttatgtatttatgctcaaactgtttccatccatgtttcatttattcttacaacctccaagcaaaagagataaggacagatattatcattgtcatttttccgaagaggaaatggattgagaagtgatgtgaacctgctcaactgcaaatggtatcccaatatccgagttgatgctccagccactagaacggtgtaacctggtaagatcacaattattaccacaatctttttagagcaagaaaaatagatatgagcaaatatctgaggcagaaagcaagcccataattcatactaactaatctgctttgtggtctctagtaaaggtaatttagcttctgggttcaaattacttaactagcacatacaaggggaaattaggggtacaatacaagtttactttccgttttcagttgataaaactttgcattaatattagtcagtcagcttaacagaagaaattaacaggctaataagatgaaatacatttaacaagaaagactaagattttagctaggataattaaatctaatatttttcttaaatgaaattgataggaaaacaaaaacttctggtctaatttatgtttgtaattaataccatacggaaagtaacattgggattaaaacatctatattcattgagctcttttttagccctatatgatccattttgattgttacacaaaatcatttaaatgaggggctctcccccatatttcctttctgtaaaataaaataataatcaatacaactcagtaggaagttttcaaatccaggaagcaaaataggtgctgctcccaaaggagttctgagggtcagttataaatgaaattatattacatttttcagcctcatatgatgccttttcatcaaggagctcaaagatttcccaggaatggccaacgtcctgggatcagtagaattaagccgtgaatggcgtctttgtctagaagtgaaaggcaatggtgaccttcctagactgagaactgagtagatcagccttatgattgtctctggttctattaacccactatcactggcatggcattcaactcaaaaggaagatttcactgttaaaagtaatctatgtgtttttagtgtttattgtaacatataacaaatgtgcacttctttatttagcccttctagcctcaccccatcttcaatgtactggctgatcctgctcctactttcagatctttctctctgatgggctacttgttgctcttcggtgctccatgagaataagaagcaataagaacaaaagtcacctattcctcaatagctggcataagaagtcatatattagggcaggatactataacagcaataactgctgttattaaatgcccattacatgccaagccctatatggtcaggtattttacatgcactatctcatttaattttatccacaaactatcagataaatattactgcttacttattttgtagaaggggaatttgaatatcaactggctaatttatttaccctaggtctcacagctaagtaaatggcagactcaggattcaaaccaaggttcgtctggttccaaaatacattttctatgccacactatcaccctgaagcaaaatgaggtgctctaaatagggtgttaggggtatgcatgcctgtaagcataaggaattccaaactttcagacattttctggcccaagaaatgatacagaactttgggtaacaataatggctaacattttttgagggtacagtacatgccagaaactgttctaggagctttacacacattgactcattcaatccttacaataaccctcttaaggtatatgctactatgacgcccatggcaatgatgaagcaactctggcattaaaaggtgaaatgacttactcaagattgcacagcttagaactggtggagctagaattcaaatttcagcagtctggcttcagagtctacatatttaacaaaaacattttattaatgagaaattggttgagatcaagaattgtcacaagaggaaaaagaaaataatcacagagttttagagttaagaagaaccttaaagattatttagtccaatcttcttatgttcctaatgagaaaagagaggcagagcaatattaagcaacttgcctaaggtcacatggcttgtaattagctgagcttgcatcacagcccaggccttctgacccctagtcatgtgctcattctattatatcatattatattctccctgatgcactcatgtaacaaaatgtgagttgaattcaattaaattgcctttctggacctgcacctgagctactaaacttgaatggggaaaaatgcacatagctgagcaaatgggcttcacgttcatttaaagcattcatgatcacaagcctcaactgagcactcatctctgctcaacaatgctacttctgtattaaacttgctttcccactctttaaagtgacaatatcttcattgttatcttcaatcctcctatattttcccccactccactccacttcctgccattaactaatgatatgcctcatacttcatggagaagaaaaaggtatcagaagaagtagctctttcatcttcctaccaccaaatctgcaaacctgtctatgtctctatctatattctgtgttgttaaaatggaacaagtgtcgctaaatcccatcctttcttgctgcttagactgcagatgttcctctttcttcttctgcatcatcatttctgtctttctactggaagttggccttggctcctactctttcaacattccatatattccaaccatcggttaaatcttatcttttgattataattctaaaatacatcttgaatctgtacatttttcatcaccattgctaacatcatccaagtcaccatgttctcttatctaggctcctgcagtaagtaaatagcctcctaactggctgtgtcatgcttccactcttgcccatctttaactcattctctgctgagcagctatctctagtacattttctgttgctataccagaataacacaaactgggtaatttataaagaaaagaagtttatttggcctatggttctgaaggctgggaagaccaatattaaggggctacatctggcaagggccttcatgctacatcataacacggctgaagggcagaagggcaagcaagcacacaaaacagagggaatgggggccaaacttctatctttttatcagaagtccactcctgcaataactaatccagtcctgtggcactaactcattcatgaggacagagccctcatgacctaatcatctcttacgggtaccatttcccaatactgttaacattggcaatgacctaatcatctcttacaggtcccatctcccaatactgttaacattggcaattaaattttaacatgagttttggaggagacattcaaaccacggttgcagtcaaagtagtcttttaaaaagtgtaaaacaattcattatcactcctgtgcttaaaatctttctatggattctcactgctcttagaataaaaatccaaacttgtttggacctataagcccagtatgatgtttacctctcccaacttcatctcatgctacattccctctcattcaactatactggccttccctgtgttcccgcaatacaaccactcatctcttgcctcagagacctgtgcttgctgttcctcaggctctttgcatgacaggtacttcctcaattatcaggtctcagcctaaaattcactttctcatagaaaccttttttccatgatatcaaagtaggtcctctcatatttttactcatccatagctatcttagcacttcctatagttgataagtattttatgcatatatttatgtatttccatgtttatttgtctgttgtaaagctcaatgagggcagcgacctttgtatatattttttcactgttgtttttacaatatctagcagagtatctagtaccaaaaaggtgctcaataaatttttgctgaactaaaaagttaattcctggattgctctgaataatatctgggacaatgctatttaataaggatactctaagtaggggaaaataattcttacttctttaggaaaagaatctggttgctttcatgatcccaaaccttttgccaacctttaatcagcaggttctaatctttttgtggtgatctctgtctgaattaaaaaaaaaaatctacaaaattaaaccagatgagggacaggaccctgaaggtgacagccgtttaatgctctctttgtcaaatatgctccgtctcactatacatgcttggacagaaagagagacacattttacttggttatttttttcctcaagccatttattcctctgctaagtagtttatcgattcttcaacatcaatttagagctggagcttacagcactcccatcagaaatcttacagtgctcaaaataaatgacttgcccaaagaataccatgtcagttgttaaagaagtaactctggaaacaaatacacctaaaggcagatactaaatatagatattcccttacacacacacacacacacacatacacacacacacacacacacacacacacaccccacttgggaactgacttttctaagaacaaaaagcaaaaataaaacagaaaaaaatctataacatatgaaaagttcagtagtatggcagtctaatacaaaaaatgttaaaattcactatagcctaccacctcccactgatgttccataatggttattttagacaggaagcacaaggttgccaaatgttcttgttctaaatttcctgtactagtttcacatcctacacatctagccctagtattaaaaatactgtccatgatattttacttcctggctttgagagcaggggtctcctaggcctgtctataaacctttagggactcaaattccaactttcatcctgtagaaagcatatctgccttcacacaccacccccttttagcaaaatgttggttatgctcaaatgctttgggattaggtgtgaggaaatcttgaattacatacctaaatataactccctaactggtgggccagataaacataagaaagacacatatgttttaataacgtcatctgaagtataagtattcatgtataatcacacacacacacacacacacacacacacacacacacacacacaaacagcactgaattttcttttcaccctagaatgaaagcaggtactaaactttcttgagtcttagcattgcacatttaaaataactgctttacatgttgatttggagttgcaactcatctgagatacggaggggattttccaaagtgcactggaatctgggcacacatgaaattgcaattactttccattccttttcttcaatttccccataattgctcttcctgatatatctctatcttctttgggggactatggaaaggggaccaacaaaacaggtagtctttcaaactgtgagaccagacagggtcgtttcattcaataaatatttattgagtacttgctaggtgccaggcactgttctaggagctggcatgacgagcccacacagaggttacacaggttcaaattagcttaagagagtaacaaggggggaagaatttctgatgtgtgaggctgtttttttgaatcaagcaatggaacagcaactgccataggctgtcagtagcaggtgaaatgtcaaatagggagtcttgtctttggggatgcctgactttagcttcccttctaatgccagcatagtacatctaaggattcagggaaaggatatccgaaaaatgaaggcgattttgctgccaactaagatgaatggaacactttctaaaggcagccctcaaaccattcttgccctgagccaggtttccactgttactttgatttacatcttgggtttaaggtccttctttaccttttactcctcatcactccaaagcagcaattagaggcagttcagggaaacaaattaactttattttataggaggaaacctcatagtaaacttctatcattcactaattcaacaaatgttcactgagcacctactatggccagaaattgctcttggtgctggagatatatatattagtatcagtaaacaaacagacaataagccctcatctcatggagcttacattttaaatgggggttgctaagttacaggcaattttgtaataaccacattacttagtactagtttaagtgataaaacaatcccttcttgttcctccattctctaacttccactatagagcccaacctttcagcccatgtcttcttgttgcttttgaagtttctatactactcctagacataacctttatattctctttcaactgactctgcctcctctcaggtactcaggcacatcccctttagttgggattagccctaatgaatggcactctccttacaatggaactccatctctttcagatcctgttgacagcaatttgactgaaatccccagggcactgggctccggtttctggtcttgggcatttacaaattcttgtttttcttaactgctctttaacctttacttcctgcttactttgttcctcttttttttcccctgataaacatttttcaaccatgttgagaaaggaggatagctgggaatataacaaagcaggatccaatttaaagaaatctatttgtcttttttttttttaatctcgattgtcaaagatgatttgaaaaagaaagcttctgggaccaggtaccgtgtcttcataaaactctgatctcatatatacattgttgcttcctgcagaatttctgcaagctgttctttaaaataattatgctgtgtgtttctgggttcttatgggattttaacattttgaaactgcaggggcaaacaggaaaatcttcaaatgtgattacttggtagtcaaataaaatgttataagaaatttctccatttttcacaccctccaatttttccaccccatctgaaatagaaaacaagttgaaaatacatcagtccaaagggtaattttatgaaaaagataagcacctaggaacagaggcttataatgaaagtgtctcctccaccatagagaaacactaatataattcaatatagtttataaaaccatccctgccaatcaaaatatagaaaagacaatttcctgtttgtggaaatagatgtgatactaaacagaaccaaatcaggctgcaattaacttagaaaaaaaacagatacactagactcagtctagctagaagaatgttgcattacaacacatttgcatgctagcttaataaaattaagatttccaagggaattctcatcctggggaggggaggcggtggggggtggaactgaatgagctatatagaaaaaagttaaatagtaaaaatagctatcattcacagagagtttactatgcacaaggcagtttacaaagtactttacatgcattttcttatttcattctcataattttaacaggtgagtgagtactcttattgtctcagttttacagatgaggcaactgaggctcagagattaagttagatgtatacattcacaccagtattaaggggtagaattcagatctatgtctgctcttaactgctaggttatgttgccaccaatagaatacataacatacatatctgtctatttaatatttatttacatgtaatatgtatgtatattatgataggtaaattctacacgaattagctaggcagaaagcagcataacatattagaaaaaaacacttgattaggagtcccgaggcctgggtttgtactctaggctctgacactaactagtttgtatggcttcaggtgagtaatttaacacctctgtgcctcagtttccccatctataaaacaagaatatcaagcagaagcttccataacatcccctttagctctaccattctattactctactgaaataagttatgtcacataaattaccatgaatgttttgcctttgcagataacttacaccgaaagcaactcaaggaataaattctgctaaaaagcacacccttgacacagcagatctgctagaaagagggagatgatttcaaaaggagaaacttcctgtgatagcaaatggagctgccagcgtagtctttgaactctccttcaccatcagccaacgaaagacttcagttattcttcactaaaaatgacagtctgcaagtattttggacctccaggtcgaggctaagttggcaagaactaaatggagagaaaaccattttacagggtcactgctaaatccagaatcacgggatttctgaagaaactgtatatgggtgactaaatcaaaggcttctgttaggtcaataaaaatgtttctaataataaaagtctcagactttgtttctgaaatatcactggtgctttaagttgaattgagagaaaggctagatatgaaacataactagaccactgttagagaattcccttctctagggactgagcatctgggaaaaatgtcacgtaaccttagcaagacacatggaatcacaatcaatgtaggcagactctgatttttgatcctttgtacaatgcacaataccaaattgatcagtgagtctccagaaaaaaaaaaatgagcacattcaaagactcgactggccttctacagggggttttcagcagtctgaggagcaactgattgaagagtcttaagcttttatgtttgtatttctccagagcagttcttggctagcttctctctgctctgctgccttcccaggtgactaacagctgttatctctgacccaggaagtagtgataagctacgttcctagctgcctttccaaagctctcaagagtgggtaaaagaggttactgatagtgtcttctcacttttactactgacagtgatggaattcctagagagctaatttttctcatgaaatattttattttataaaggtagccaaagaaaggcaaagaaaggctgggggagaggaagagagtaagctatttagctttatctgtgggttattttcctcatggcatagtactttgtgtttttaaattcaatgaaaccttttatcctctaggtgagcattttatatgaacccacagatggcttttttagttggccaatattagaaatacaaaggtgtctgaatgaatagataactgacattatcacagggttggaaagggaagaagcatatggcaggttgatactaggaattattaagataaaattgaaagtgttggaatttgaaagtgggtactaaattcatttggattacaaattattacaatgagaaaccagaaccttacagactaatcaattttcattaatggatttcttttgaccttgtccagtggtttctaaattggttcttgcaacagacccttggaatggcttctctccatttggtggcccagtgcattaacttatacttctcctgtgccaacagctcatctacagtaacagaagtgaagcctttctactatgagctctgagtacccaactaagtccacaaatggactagaaaggtcatagctgctcactaaccagtagacatgtcaaatcagatttgtataattttagagttgaaatggtcctttgaggttatcttacttttaaccttgatcccagtaaaagaatctcattcacagcatgcctaacagtggcatctagacatacttaaacatgttcaggactggaaaagtccttgcttcataagaacacccattccaccgccagacagtttgaatagaaaggttttcccctatatgctaggcgaaaatctgaattcctatggctacctgggttcatatccaggttccctcatttatatgatcttgggtagatcacttaatctctgtgtttcagtttctttatatgtaaaaatggagataacaatagtacctacctcataggattgcaattaaacaagttaacacaaatcaagtacttagcacagtccctggtacaaaataagtgctcagtaaatatcagctcttgatcttactgctaatattactgctacatttacaactgctactatcactactaaggataccctctggagtgacacatatcaatcttcaatcctcttgttcatatcagctcttcaaatatttgaagactcctatccaaagcatgagcttcaaaggtatgcatctctctgctttatattaactctgtattaggcaagttatctgataccttcaaatcagacactttgaaagcagataacacctactatcctggcatgatggctcatgcctgtaaccccagcactttgggaggctgaagtgggcggatcacttgaggtaaggagttatgagaccagcctggccaacatggtaaaaccccgtctctgctaaaaatacaaacattagccgggcatagtggtgcatgcctgtaatcccagctacttgggaggctgaggcaggagaatcgcttgatccaaggagacagaggttgcagtgagccgagatcgcgccactgcattccggcctgggggacaagagcgaaactctgtctcaaaaaacaaacaaaaaagaaaccaacaacaacaaaaaagaagataactcctactgtacagggtggctgtgagaataagaagagataatatacgcaaagtgcctggcacaaaagaggtacttaaaaatatgtcagttcccttccccttctccattcctaagttttttcttttctagacactaaaagcccaatatctaacctttctttacatggtagtgttttccagcccctggccatctttgtttcattctagtctgtcaagtatctttcttaagaagtagttcccagaatgatagaaagcatgattttaggtatggcccaagtatgccatgcagagtagactgttccttaatctcgagaagataaagctcaactcaaggcacatgtggtcaaggtaggggtcacatatagtctcttatcactatgatattttttgttcattgatttccttttttcctggcccataggctaatgagtgataaattccatcagaaattcaagttacttactgaatcagaggagttgcactggcctgctcctgtagctctttcctaggactctgctttcttagcagttgggatacatacacaatgcagtgaatctaattcctgccacacacactaaggggcattgccgccaaagtgtctcttgcaatccattttatgtggttgctttccaaggcaacttactgaattaaaaagataataaatttaatcttgttggttactactgattaagcatctcaagtcatgtaaagaggtagagttcatgctttggaagtgtaatattggagttcagttttcacctttctgattttctggaggcagtaaagaatactgagaagatcactaattgagtcaaggaacttgagatcaagccctatctatgccactaacctacctagtgtttgaacatggatcagtcatttaacctatttggatcacggtttcctcattcataaaatgagggtgttggactacttaagttttaatatctcttctgggtccaataatgtatagttctattctgtagccttatggttaaggtattatatcttcccacaccatacttaattgctttttaaatcaggttattgctgaggaatagcccgggaaaaatgggagttttaaacaacttttataattttaatagagaactgaaatagttgaatatttctcttcctaacctcttgcttaaataattttaaaacagttaattaaattatgctttacaaagattatcattatatatccaagctgaaggggaaagttcaacatttacaattgagttacaacagagggctgtattgagcaagaccatttataatgtattaactataagaaatggaacctgaactttagtagacaaccatactcctcacagctcaagacctagtaatatgttgtaaaaaagtctgagaactatattgcccatgactttggatcagcaatcatacaataaatatgtttaaaatttttgttattaatttaaatcttaatgtagtcatcaaaactactgtcaggtaatgcctttttgcctctagtgcatgtaaaactatcggtttatgagagaatttcaatgtatgggctgacatcttggataggctctactcttttttacaatcctctcagaaaacagtctatatttcatcctacctctgtctctccatttctataaaatggaggaatttttctctcaaaatcacagtaagcattaaataaggtgaaatgtattttaaatgccctataaattaaaaatatcctggtcatcttattatcttgtaactatttaacttatgttttaagtagcacagatttatagagagcatatcaccaatgaagtattactgtgcaagtgaattttagatgaagtacagatacattttttaagaaaaatatacagattatttacatttgagctataacaccattatgccttatgttcaaattattagaaaattataggccaaaaatactgttgaaattaaaatgcattctatatactctatggttaaacaactcacaaccaattaaatcaacgtgaagaaaccaataataattattaaaagctagagtaggagcaacaaaaagcaacaaccaactcaatgcacacttataatacaagattttctctcttttaaaaaataaataaataaataaataaataaataaataaataaataaaacagtctattaaaacccttggccgggcatggtggctcattcctgtaatcccagcactttgagagggcaaggcatgtggattccttgagtctaggggttcaagaccagcctgagcaatatggtgaaaacttgtctctaaaaaaaatacaaaaattagtcaggcttggcagtgcatgcctgtagtctcagctacttggaaagctgaggtagaaggattgcttgagcccaggaagttgaggctgtggtgagctgtaatcacaccactgcactctagcctgggtgacagtgcaagaccccatctcaaaaaacaaacaaacaacttcttactttgctcaatgagacctacagatacacagcccaactgaaatcttaagaatcaacactggttattcttattaataaaaactgttctataagacagtgatagaatctgtttcgttttggcttctaattggagaaacaccatactgagtcatgggccatgttctggattctgacagtggcatcactggattgttttagaggagaacacggtccttttcctctatgaatatgctcttgaatgttaagaatatttagtaaaacacacaaacacacacacacatttgcagggtgggagttactgtattattttgcagagtgtattgtatttgctatcatctacttctctaatggactaaaaaggtagcaaatatgaaaataagaaaaccacaaagaagccccatttttctacattctggcattcttcagttagattcagcagtggctaaaagataacacagtggaggagggggaaaccttggattaccacagcatcatttatactgatatttccaaaggtcataagaatttaggaccaggctcgcttcccacccttagttcactccaacatggccattgcttccatgatgacatgatttcccaataatcctttacagggctagagaggaataaacagcagaatttccaaaggcctatgttattactttgctttccccaggtgggatccttgttgctgtccctcaactgtgactgagagccactacacagcagatggttaagaaaagaggactaaagtttaaattaacaaccatcaccaaccaacattaagcctccctttgaaacaacaggaactgtgaaatctgagtctacatttctgttgaagggcaacaaagcagggccttctatgggagacagcatttactgtctttttaacataaatacatcaagctagaatacatcaagaagaagataatagtgcatcactaattcagtaattgtcacaggactctttccttctcctcaattaaacagttaacagggagctgggattcacacaaaaaaagaaattcgctcctcctcccctcttttccaatttgatttatgcatagcccctggagacacaaattaatgtcttcatagaccaaaagccccagctgttttgaaaaatctatgacaaagcttaactaaggttcacacatgcaaacataaagcccccataattactaagttgggtattacaaagctggctcctcaaccaagggtctaaagccagccgtaatgccgtgctcaccccagccaggctggccttaatacacctatagtgctaatttagtactgcctgaggcattgtggattctgggtagatagacactttaagcaaagctgaggaaaagatatagaactatagggacttaaaaccacaattcatcatttattaatatcagacagaagcactgaaaatatgcaagacttcatttcttatgtagctgattcctttggcttatttattctttttatgataagaaatcagaaaatgagatgattaattcaaagaaaataccaaaagaaactcttaatgccctatccatccttaaacgaaccaaaggcaccccactcagctactctacccccttggaagaatgtggcctgcatttgctcttccacttcctctcctctcatccactccttaatcaatgcattctgaattctgtccacagtattttacaacaaccctttcaaaggtcactgagactctttgttgctaaagccaatgatcacttttcagtccttatcttattcgttctctctgcagcactaaactctgctaattattcctactttcttgaaactctctcttcccttgccttctgtgataccccctaactcttgggtttatctttctcagttttttttcatgaacttctcctttacccatttcttaagtgccagtgttttctagcattccatctttatgcctcatttattctttctctaaaatcagggactcttaatctgtacatcatgagagttcatggatacacctcaagaggtctgtggaccttcctaaaattgtatgcagaatagcagaatagtgtacgtaaattttatgggggagagggtctatagttttcagatttctaaaggagttttaggcaaagtcaagtctaagggcaactaatcctcagattagctctaggtggccccgcaacttcaaatcatatcactatatatgctgataactttcaaatctatatttctaatccagatttttctcagtgtgggcatcccataaatacgtttactcaacaatcctgatcttcctctcgtgttctccaagtcagtaaatggctcacaccccacctagctgcccaagccagaaacctgggagttatccatattcttccctctctcccattctccatatccagtaaccgagccctacggactctacctcctatctcacatgtgaaccttctctcaataacaaacataataatctcagtccaggaagattattgcaataactgcctcacatgtcttcctgcctccaaccaactctctagttgcagacagagtaatccttccaaaagacaaatatgatcatgtcactcactgacctaaaaactttccggtgacttctttattgttcatagactgcagaacttcaaacttcctggcatggtaaataaggtcctttacgacttggttcctgcatatctctacagtctcgtccatactctattgctcaacaacccctttaacctcacccccaccctggcccaatccttgactactttataatctctagtcatacaaaactatttttcagttctagcctcagggatttcatacactttaacatcacatcagcctggaatacttgtaccaccttggcctgggcaacttctgccagaaagctatctctagccacctaaaagagagttagggggtacctcatatatgctccgatagcatcctacatgtgtaatcacatatccttctgtatgtgattctctatttctctgcttctctatttcccactagagtttgatgaataaactataagttccttgaggtcagggaccatttggtgtccgtggcacttagcacagtgtctggtacatcatagttggttaataaatatatgttgataaactgaatgaattaatgggaagaaaaaattttcagaattttgacccagtactgttaatccccacaatctttgccttcagcctggcataggaaacaaaacagtggactccagagaggtcagctgccttagacattaactctatgagcctcactttccacactgtacaactaagaaaaagttctgtataatctcttatggcttggcaattctgtaatttgctgcttccttaacatatctatttctcatctcccaaacctcacttagtccctccacccgcttccctactccccccttgcctgtcatccagatggcactgtgatgatctggttgaggcatttggagactggttgggtaaaggccactatattttgtgcatgtatcgtgttcatgagagagagaaagggaaagagaaagagaaggaggaagggagggaagaaagagagattgaggcaatcatctttcccttcccatttctatccttcgtaaagaatacagttggtcttagaggtccaatttcaaaatgttcatgatgttaaatcgttacacgataaaaaattcctaaaattgtttaagatcactcagaacagaaaaaaaagtaagataaaagttaaggataaccaagtagacacaaattatcttgaaaaagctgaatcgcagtaacttgacacagttttttggaataaggcttactaaacattgaaaaggaagggagatatgttatttgaaaggaaatacagcctgaacttccctggtcaagagaggtggaggaatcgtggctccagaagcatctgaagttactgcaaagctatggaaacatgtaacaataataaccagcactaagaatataataatgcaaggaccaattgtctgctggtccctgggggaggaaccagatggcataaaagaccaattctcatctcttaatttctttgattgataagaaggatacgcttccatttagttctcataaacagtgaccccttttctcctctgtggacaaagttgatgcactatcacttttgcttccagatattaaactcatatttaatgatatgtgtgcttggtaatgcatatgtccaaaaactttcactgacaaaaatggccctgcatgcatctatttgtctttcagttgctgcacacaaatgcagcagggaagtggggaatttaaatgcacagcaggcagccaatgtatttttccataaactagtctacatatcatggtaagagtagaagcaaagaaagcctcagatgcattctttcccataaagaggcaaatgaagccaaaggacagggtagtaagaaagaaaatcaaaggctaaaatgagattactagtacatacccttttaaaaacaaatcagaagaaccattatccttgccaacattgaagatgggttaagctctttcagtgcaaagaagagtgtattcttcctattgtaaacaaatccaatagttttgtttgtttgtttgttggtttgtttttcgagacagagtttcactcctgttgcccaggctggagtgcaatggcgtgatcttggctcaccgcaacctctgcctcctgggctcaagcaattctcctgcctcagcctcctgagtagctgggattacaggcatgtgccaccacacccggctaattttgtatttttagtagagacagggtttctccatgttggtcaggctggtctcgaactcccgaccttaggcaatctgcccaccttggcctcccaaagtgctgggattacaggcatgagccactgcacctggccaaccaatactatttttaacatggttagatagatgtcatttcacttcagaagtggttatgcttcggtaatggatagagttagtatatcatgtaaaaggttaagaagcaaaacaagaatatttaaaataagtagtaatgtacagaaaaaaagaaaactttcacaacgtgcattgtgcttgctggtcttgaatatcataaaactttgatagaaaaacacatatatttgtagggctcctatacaaattcctgctatatctcacttataaatacacaaatatatcattatattttcatatagtataacatatgatagccaggcagagatcaggggtcaggaaagctcacctgagtcactagactaatgaagtaggaagaaaccacaagagactacggaagatcaggttgagaaatcagggtctaacaaaggggtcagtctttgaaattaaaaactttatatgggaatacagactataggtgtgccctactttaagaaaatccactgtttccttatccaatccacaaaccagaaaagcaagagtgcttatgtgtattacagaagcactccatgtggcaatttttttttttttttttgagacgaagtttccttcttgttgcccaggctggagtgcaatggcatgatctcggctcaccgcaacctctgcctcccggattcaagcgattctcctgcctctgcctcctgagtagctgggattacaggcatgtgccaccacgcccgcctaattttgtatttttagtagagacggggtttttccatgttgatcaggctggtctcgaactcctgacctcaggtgatctgctcgcatcagcctcccaaagtgctgggattacaggcatgagccactgcgcccagccggcaatcttttacaatgctaagctaacattgtacatgcaagtaagatttgtttctacaaatatggaatttatatgttcagtttatcagaagcacattttcggtacaaagtgaggtatccatgtaccatcaaccttcatgtggacttgcttttgatttttcttttataaatctgaattttagcatactgtctccttaaaagttagaatgcctgtactgtgggaaataggcagagagaaaaaatccatacttcataagcagaaagctgaaactatgtccaaccagtccctattgaggaagtagagtttttcccacaaaagtgaatggggaaacattcttgaaacatcttaaagccctaaggccaaattcaggaggctgtaataaatgagaagtaggaagtccccagaaatctcctgaaaaggttgaattgtattatttatatttgtaacgaaatgtgttttcacgtttgtgttaaagatgaatctctggggtgagttcagcctgaggtaagcattgaggtctagtttaatggaggatgaagtgttttttttttttacactatatttaagcattggtcagatatacttaagacctatgaataaataaatataaataggattgctttaaggaactcctgagactgtctgtggttgtctattcatattaatatataagcataatttctagttgtgctactagtggcatccatctgtacattatatttctagaaaaatgttacaagtttgtaaaaatatattattctactgcatagagcacctagttattaatttcacttgtgattgatgttgccttgaatccaattataaaaaacaattaagctgctatattagcagagtggtatctattaggtgacctctaaggaaaaaaggccagatgacaaaggatccatagaaaaatcaggactaaaacctagacagttgtctattcttctgcctaacccagacacatatcataaagaagaatctatgtacatcaacagtataaaactttcactcagtaacagaacaaatttaaaccagctgttgtgaaactaatatctgcactcctacggtgaatgattaaagtcaataaatgtttgttgactgaccatgatacaaactattgttgtacattatataatgttcaatgattctattgtgttaaagataaaagtcactctaagtatgtaaatcctagttccagtattattctaggctaggagatcagctttcagtctaataacttcagacaagttttagttacagtctcatgaccacaaattatctaataaccccagtttcaaagctctctaaaaatagcctggtcatctactatctggaaaatgatgaaactggtcttggtttctccaaacctctagggtttttttgttgttgtttttgtttttgtttttgttttgagatggagtctcgctctgtcgcccaggctggagtgcagtggcgcgatctcggctcactgcacaaacccctaggttttaaaaataactgtacaataaatatgattacatatagttagaagatcttatgcatataaagagccatcgttcaatttatcaatgtcattaaataaagatgaacacctgaaaagattgaattacagattctcagtacataatgccaaaatctacaccacaataaatacactactcaagaaaaagtcatctatgagggaaaaaaaaagcagagagtaaaagaaaactgtgcaagtacccttaaatcaaatattgtaaatctagcatgaacttttaaaaagtggaggtcctatttttttaccaaatggagaatggatttctacctttgagttctaaactctctttgtaatacttttctctattaataaggtgctaataagacagaagtaaaatcaacccaaagcaaaaataaaccagaaaaacaaacaaaatctaattctatctggccacaaagccaattttctccctcccattgcactggcaacagcagtagcagcagtggctgatggcagcagacccttcctaaagcaatcttatatttgcaccagagagaacattctggccaaattggtcctagaagatgtgtctgcaagatgtaaaaaactgcaatcccagtgaaccaagattgtgccactgtactccagcctgggcgacagagtgagactgtcaaaaacaaaacaaagcaaaacaaaacaaacaaaaaaaaaccaaaaaaaaactgcaatcctaaatgatctctccttgaggaaagatgaaaatctttgtcagtaatattaggtaacctgggctggagaagatgtccaactgcaaaacagtgagtaggcaacaggtgaggaaaaggaaaaggaaaccaactaagcccaaagaaaccatagcaagaagctgaaagcactagttaaaatgaaactcgcatctgtagagaagcagtgagaaggataaatcaactaatggctcaattatacttttaaagccatcagtcaaacaaacaaaaaacccaactgaacttttaaaaccatttttagtacaacttatatttcacagttatttattttcttaatcttaacaataaacaactgttgttacataattaaagatacaaggtaaagggatttaagtggcagcttaagctagctagttaagttagttaagctgtaagttagaactacctatatatgttccagttttcacactcagtccatcccaaggactgtagtcagagactaaagacaagaaagatgtttgaagggatggtggggtggaggggagactatgagaatagaataaaaggattagagtgctttaatctggaaagataaacaatcaatcaagaataaccaccaccatacaaccatcaccattaagcacctactgtgtgacagtcactttgctaagtgccgagatattgaattatgtccaagaagagaagaagtgttgtcaaagtggattttaacattctttctttcagttatgctctctgtgtcaagcattgggctggtcatggaacagttgtgaagcaggaaacagcagaatgtcgtggaaagaaccccagattggaaattagaagatttaggttttagttctaagagcattattaactatatgtatgaccttgaacaaatcactcaacctttttaggcctatcttatgatagagatgttggacctgtcagcggattccaacttttttttagcagccaaccctttattcaaaagacaacttacaggaatatcctacacataaaagagctgaaagtagaaatcttatgcttgaagcacagggaaggtcataacaggctcataagccttctcctgggcctctccttctccctgaaccagtcttacatgcatctatacagatgccttcatggatcctgtgaacacagtttgaaaatctatgggctaaatcatctttaacaattccctctagatctaatatcctatgactgtgaaattttcctcacctacatcttcaatagcctttattcaattcagtccaacatgttgaatatctagaatcatagaaagcacatgacaggatttctaccatagaagagctcaccatctttttggggaaaacaaaataaataaaatgggaatgcacttgaggggaaggggggctttaagcagcaggacaccatcaagggcccattggaatagaaagtccacttctgtatcttttttatgagtgtatcatcagtgcctggggcaacagacattcaaataaacattgaataaataaataatgaatttatggatggatgggtgaagttattattaatcatgttcactgaaattcagcaaaaaggtataaagtactttccatattttatagaatttttttcttatatgtacagggttataagaaaagccatcaaatttctccattattcattctattatttactacccacaattacaaatggtgatattagaataaaaacaaagcaaaaaagtacacccattaagttagcatcctccttgaatcagcagaacaaataaaggcaaaattctactcaaccatatgaaataaaattttgtgggagcaaatcatcagactgaattttgctttgccaggaaatttttctttcaacgaacacgttttatatgtttacattcacatgctgcaagtaaggaagtctccaaagtaggtaaatcaagttaaaaacaaaggctattttctctgccccctattccactactagtgggaagagagcagggagatcaagaaggcagcagctgctttcctttttccccccaaacttaaattccatccaataagatatgttttgtctttttgcactcaaagtcagccagcaggcacttaagtgaaattaagaacaactgcaccaatggcagataatttgatggagagcttattggagacagctcatttgagtaaaagctttgcctgttcaagaaacaatataatttctgaaggaaatctttctggaaagggccaggtggctctgtaattttatggctcaggtgatatcagttatccaggacaagtgttgtacatgactaatattctcaaaccagaattgtatttccccagaaagctattacatttaaaaagacattaaggtgaacttaaattccatttttgttttagcctagccctaatttttattatgatatactatatactattccttttttgaatatgccttataaatggatatatattttttgggttcaagtgattctcctgcctcagcctcccaagtagctgggactacaggcagatgtcaccatgcctggctaatttttgtattttttgtagagatgaggtttcaccacgttgcccaggctgggataaatggatgtattttttttttcttttttttccttttttttttattatactttaagtaaatggatgtatttttataaaacagctttcttttttcaatctatggtgcctgatacctgagttgcttagagagatatcgaactaatagatgaaatgagaaacatcttatccctttctagtcttcctccaagatacaatgacatcttagggaaaaggtagcatccttttctctgttctaacaaatgtagacagcccagtcaatgtgtggctccacagatagctacaacaaaagtcatactgaggaggataatacggcagggttctgaccacacagtatgacatcactgctttcttctattcattttagctattcccctgtaaaatctggattcaattcaatgtcttcagtttcatttggaagatctacatttggaatcgatccagttagtccaggggccacatgaattttaatgcacctggggcagctggccaaactgtcatttgcttctatcatctaagcaaaatgtggaaatttctagtcaagacttttccaattttcaatttaccaccttctcatcagagggctacaactgctgttttcagaaagaccttgcccctatcctaggacaagaaatatgacttagatgagaaaaaaaagaagaagcaaagaaagaaaacagaagttattttcttcctttcacacattttggcctaagtttggtgtatatatctaatctaatgttattgtctagtagcatatgagttggttaaaattctttacactaagtacccagaattttctattctttcttctctcttccacccaaatctcttgtgacgtatttattcattcaattggccaaaatatttatttagagcctactatatgccaatgacttttctaggcaatgggaatacaaaagtgaacaaaacacagcccatgcacttatagagctctgacactttccaaggagagagacagtgaacaaatccatagatacaaaatagagaatcattagtcatatgaaaaataaaatatcacatagtgataagtgatataaagaaaataaagcagggcaaacatatccagaatggtcataaaggccattctgaagaggtgaaatttgagcatggctttaaatgaaatgaagacttgtcttgatttttctttgtattcaaaggaaacccaggaagaggtcactaaaattactgtgtcctgagttggaagtaaaaacagtcatggagttgagacatttgaaaaataccatcaagatattcaaggatgtcataatcaagctgaagatcatctactaacgtcaactaaatgattgaagggatgaaaaatggctgagaagggacataattgaaatataccatttcaatgaccattatgaacattatgtacgggagatcataataggacaactccctatttaaagtggtgaattacaacaaaaaaaatatatctgagtctctagtttcaagacaagacagcatagttgcacatctctctatttctcccattaagtacagctaaaaacttggacattatatataagacaaacataagaacattttcaaaggtggagaaaaaaagtagacttactagggactttgagacccagggaatgacaaagtggtgaattccctgggtattttttttttactatatatatcccagaccaggtattggtaaaaccagcaacctagaaatgccaatgggcagagggaaaaaaaaagcctcaagaaagccagcttttggccgggcgcggtggctcacgcctgtaatcccagcactttgggaggccgaggcgggcggatcacgaggtcaggagatgagaccaaggtgaaaccccgtctctactaaaaatacaaaaagttagccgggcgtagtggcgggcgcctgtagtcccagctactcgggaggctgaggcaggagaatggcgtgaacccgggaggcagaggttgcagtgagccgagatcgcgccactgcactccagcctgggtgacagagcgagactccgtctcaaaaaaaaaaaaaaaaaaaaaaagaaagaaagccagctttctctagtcaaaggaccaagaagggggagtacagcaagacagaaaacttaaacaatagccaaacaacacaagaaactgcacccctaacctcatccctatgagcaagcactgagtgaggaaaccggacttccaccttctccaggatctaatgaggtgtcccaaccaacctacgggggtggtgtatcaaagaaggccaagtagagagctgggtttttttaaatccccaatcagcaatgtcataggaatcaagtgctcctctctatcaaccagggtgatgtcagcaaaggcctaaaggggagcttcaacttccacttccaacaagcagtaatgaagttcccccacccccatttcctagagtttcaatggaggctgagtggagagtctgtatttctacttccacatggcagtaataaggtaatgaccacttcccctgccagcatgatgtcagaagaaaccaagtaaaacagaagatttaaataagatccagagtcttataatacccaaaatgtcaagaattaaataaaaatcacttatatcaaaaaccagggaaatatcaatttaacagaggacacaaacaccaagatgacacagacgttgaaattatctgacaagtattttaggccagctgttacaaaaatgctttaatgagcaactatgaacatacttaaatttaaaaatagaaagtttcagtaaaaataaaagatgtaaagaaaaaccaaatgaaaaaattaacactaaaaatacaataaacaaaaatttaaaaatcctggatggactcaatagtagaatacagacagatgacagaggaaagaatcagtggacttgaagatagaacaatagaaattacctaatatgaacaataaagagaaaatagagtgaaaaatagtaaacagagcctcaaggacgtgtagcacaataacaacagatctaacgtttgtatgactgaattctcagaacaagaggagaagaatgggtattcaaagaaataatgggtaaaaagttcagaaattttaccaaagacataaacctacagaatccaaaagctgaactaaccccaaataggacacacacacacaaatctgcaccaatgcaaataattaaactactgaaaactaaagacagtgaaaaaatattgagagcagcaagagagaaacaacacatttacctataagaaaaaaaaaattagaatgatagcagatatataagaataatcatacatcatgtccaattgaggcttattacagggatgcaaggctggatcaatattcaaaaaatcaatcaatggaattcaccacattagcagaataaagaaaaattgcattatattaattgatacagaaaggcatttaaaaattcagcagtgattcacaataaaatgtctcggaaaacttatgaatagagggggaacttcctcaacttggttaaaagcatctacaaaaaaaatctatagctaacatcttggtgaaagactgaatactctttcctattattggtaataaggcaaagacatatcctgtcaccattcttattcaatacagtactgggagttctagccagtgcactaagacaagaaaaggaaacaaaaggcatacaaattggaaaggaagaaataaagttcactctatttgcaggtgacatgagggtctatgtaaaaaatctcctagaactaatttggaattcagcaaggtgagaggctataattaataccaactacaaaaatcaattatatttctatatattagcaatgaatatgtggacaccgaaattaaaaataacataccatttacaattgttcaaaaaagagaaatatgtaggtataaatcttaggtacttaagtataaatcttcggtataaatacttaggtataaatctaacgaaatgtgtacataatttatatgttgaaaactacaataacgatgaaaaataaaagaagacatcaataaacggagacacatactgcactcaaggattggaagacagaacataggaaagatggcagttctccctcaaaatgacgtattggttaaatgcaatatccatcaaaatcccagcaagattttttttcagatagagacaagcttattctaaaatgtatatgctagacaagcttattctgaaatgtatgtgcctaatcaaagaaagaaaaatctttgggatctagggcttgctctagacatgacaccaaagtacaatccataaaagaaaaaaaacaatacattattattcatcaaagttttaaacttttgctctgtcagagactattaagtagatgaaaagacaagccacagattggcaaaaatatatttgtaaagcacatatctgaccaaaaaactcatatacctagattatataaaaagctctcagaactgaacagtaaaaatataaccaattagaaagaaaggtcaaaggacataaagagatatttcataaggatgatatacagatggcacataaacagatgaaaagatactcaacatcactagccctcagggaaatgcaaattaagatcacaatgagatatcacgctcacctatcacagtactaaagtaaaaacagtgacaccaccatatcctgccaagaatgctgagaaactatcatttatattactggtgggaatgtaaaatgtctcagctactctagaagtagtttgtcagtatcatttaaaaaagtacagaatgccttatccaccatgatggtattacacgtagcaccatttttgatcaagaaagtcatttcacagcaaatgaagaatggtaatgagcctttgctcgtggaattcactagtcttgccatgtttcccatcatgctgaagaagcgggtttactacaatggtggaatggctttttgaagattgagctacagtaccaggtaggtgacaatgtcttccagaggtaatgtctttcaggatgctctaaaataatgtccaacatatggtgttatttctccaacagccaggattcatggattctgtaataagtattagaggtaaaaatgggagtggcttgattcactattactcctagtgattcacaagcaaattttgtgctttctgtcactatgaccttaggctctactggtccaaaaggaactaagttcttttggaacttagtggttccaacgttgaatatataatttcaacgtctatatatattcttatatatcttttggaacaaactaaggaactcttatttccaaaaggaactaaggttacagtccctggaacattcttcatgatagactctattcaagtccataaaacaagtcacagtaaatttgaaactatttaaatcatatagaacatcttctttggcacaatggaattaaataataagtcaataacaaagaagtatctaaaaaatataaataatatttgggtcaaagaagaaaccccacaggatatgtaaaagtactcagctgaattaacatgacaacaggctatatctaaatttgtgagatggggcaaagcagtgcgtagagtggaatatatagcaataagggcttatatgttcatagcagacttattcataatacagagaaaaattggaaaaagcacaaatgtgtattaactggtaaatggataagccaactgtagttaattcatataatggcacattactcaaaaataaaaatgaacatactactgataacgctcaacaacatgggttaatctaaaaaataaaaatgctaagggaaaaaagtcagagaccagaaagcatagagtgtatgatcccatgtatttgaaacttagtaacagacaactaatttatagtgatagaagtcaaaagagtggttgcctatgcagactggagattgactggaaacagtcatatagagaaactttctggtgagatgaaaatagtttatgttttcattatggtgttaactacaaaggtgtatgcatttgtttaaagtcatctctaaagtagtcaaactcacagaagcagaggatggaatgccaagggttctaagggctgtgaggaaagtgaaacggagaagtattagtcaaagggtataaagtttcatttatacaagtcctagagatctactgtacaacatagcacctacagttaacaatactcattgtatgctttaaatattcctaagagggtagatcttatgttaagctcttatccccacatacacacaaataataaataagagaacaggaggaaattttggaggtaatggacagacttatgacatagatagaggatggtttcatggtgcatataattatctccaaactcatcaagttatatatattaattatgtatagttttatgtatgtcaaaaatattaagtaaaaaagaatgctgaattcaataaaagtattcctttaaacagcaaaatgtaattagaaaactcttttgtctcaaatatagaatttttttaattacaaatgaacaaatttaaaaatatgttagataaaatcactgacaatagatccatagggactactgaaagaaattagaatgtttttcctcccagaaatactactacgcatttgaggttggtattagtgggacatatgatgatttcctaataaagtcttctcagaaacagaatgctggattggctagatgacaggtatacctaatcatgggctttttcctttttttttttttttttttagacggagtcttgctctgtcgcccaggctggagtgcaatggcgcaatttcggctcactgcaacctctgcctccccgggttcaagcgattctcctgcctcagcctcccaagtagctgagattacagatgcatgccagcacacctggctaatttttgtattttctgtagagatggggattcgccatgctttggccaggctggttttgaactcctgacctcaggtgatccgcccgcctccgcctcccaaagtgctgagattacagatgtgagccacagcgcccggccaatcatgggcatttttacatttctacctatgaaataaagcacaccgggaaaaaaagtcaagctttattcttttagattatgataaatgtgcattaaatacctttttaaaggtccaggatgacactatcttctttctccccaaagatacaagcaaacatgagtcttcccataagaacttattttacatggtattggtatcctagagaggtaaatgcagtaacctaacaaattcaacttgtgagtattggctgtattacagtaactcagatgtatattgattacactgagagatacaatatttgagtgctatcaaacccacaccatattgttattctgcatgcttctcctgcatctgagatgcaaatcagttattctgtcccataactagttatattagaattttaaattgaagaattggaaacaattcaaagttgtagagaaaaatttataaccctctaaactgaaactgacatacccagagcaaggagaaaaagtgacccctcatttattcattcattcattcattaaacacttatttactgcctactatgtgtcagaccctatgttaggtgccaaacatttaaagatgggcaagatacgatcactgtcctttaagaaataacagcctggctgggcacggtggctcacgcctgtaatcccagcacgttgggaggccaaggtggatcatgaggtcagcagtttgagaccagcctgaccaacatggtgaaacccagttctctactaaaaatacaaaaattagccaggtatggtggtgtgcacctgtaatccaagctactcaggaggctgacacaggagaattgcttgaattgcttgaacccgggaggcggaggttgcagcaagctgagatcgtgccattgcactccagcctgggtgatagagcaagactctgtctcaaaaacaaaaacaaaacaaaacaaaacaaaaaaacaaaaaaaatcctaaatgggataaacagataaacataaaatgatttttaaaaatgtttaaggcaaaaataaaaatatgcataaggcaaactgaagtccagaggaaaaatcaaggaagacttcctgaatgagatagtacctgaattgagtcttgcagagtaagtaggagttcacctggtgatgagaaatgtagagggtatacttcaggcacaatggactacacaagcaaaggcaaagccatggaagacaaaagcagcagagtgtgtataaactataaatagattaagtgttttgagcaagggagtgacagaatccaacttgtgtttgaaacataaatgtctgacagggtgggggatgcattagaggaaataagggaggcaagaagacaattaagacaccattgcagtttagacaagtaatgatgtggtgcttaactagggataaggcaatggcaatagagaggacagaagagactgtggtcagtggtcaatttacttaattttaagataccacattcttttgattttcctcctactcctgctcactggccattctttctcagttttctttgccggttccttgtcttctccgaaactattttttttttttttgatggagtctcgctctgtcacccaggctggagtgcagtggcacgatctcggctcactgcaacctctgcctcctgggatcaagcgattctgttgtgtcagcctcctgagtagctgggattacaggggcaagccaccacacctggcctaatttttgtatttttagtagagactgggtttcgccatgttggccaggctgctctcgaactcctgacctcaggtgatccacccgccttggcctcccaaaatgctgagattacaggcatgagccactgtgcccagcttctctccaactttttaacattggattaatccagggctcagttcttagatctcttctctgtcttcactcccacggatttctttggatttaaaatactatgtatgtgctgaacactcctaaatgcatagctctagttcagacctgtcctctgtgctccaggtttgttttctcacctaactgcttgacatttccacttcgatgtctagtaagcatctcaaaccatcaagtctaaaactgaactcttacatgccaagcttactctacctacagtccttcccatctcagtaaatgtaacctccttcctcagaaggaaaaaacttgggttcatccttgacttccccctttcacacaccatatccaatctattagcatatcctgtttgttgtaccctcataatgtatctgaatctaaccactcctttccattgaacagtttccaccctgcttccatctaccaccatctcttgcttagattactgaagcaacttcctatctggtctccctgcttccaccttgctcatacacctgtaatctctttttaagatagccacagcttctgcacagagaaggaaacaaaatgaaaaggcaacctacagaatggaagaaaatatttacaagccatctatttgataaaaggttattatcacaaataaataaggaactcctacaatgcaatagcaaaaaataataataataagtgagcaaagtacctaaacagacatctataaaaatgaccaggaggtatgtgaaaaggtacccaacatcactcatcatcagagaaatgcaaatcaaaaccacaatgaggtatcacctcacacctgcttgggtgaccatttatcaaaacaacaacaataaaaacaaaagataaatgtaggcaaggatgtggaaaaaatgcaactcttgtacactgttagtgaaaatgtatattgaaacacaatacggaggtttcttaaaaaattaaaaatataactaccatatgatccagcaatctcacttctgggtataaatccaaaggatctgaaatcattatcttgaagagatatctacactcccatgttcactgcagcataattcttaatagccaagcaatctaaatgtccatttatagatgaatgggtaaagaaaaggtggtgtacatacacacacacacacaaccaaccacaccctagaacaattatctagtcttaaaaagaagggaatcccggcatttgcagcaacatggatgaacctggagaatgtcaagctaagtgacataatgaaataagccagacacagaaggaaaaatactacatgatagcactatatgatgaatataaagtagtcaaactcatagaagcagaaagtagaataccagggtttccagggcctgggaggagagtgaaatgggaaggtattagtcaaagggtacaaagttttggtcgcaccagatgagtaaggcctacatctattgtacagcatagtgcctataagttaacaatactgtatggtgtattttaaaaattgctaagggggtagatcttatgttaagtgttcttgtcatatacacaaataataataaataagagggtgggaggacagttttggaggtgattgataggttaatgacatagattaaggtgatggttttgtggtgtatacttatctccaaacttatcaagttgtacacatgaaatacatatagcttttttatgtcaatcatataccagtaaagtggtttataccaataaagtggtttaaacaacaaaaaagacagtagccagcataatccttttaaaaaccacattatatcactcttctgctcaaaaccctccaaggactcctcattttactcaaagtaaagccaaggtatttacaaggtaaattacaatggcaattacaaggtatttacttaggagcctacaagatctgctccctccctctgttatactcttgtgaattaatctcctagtactccccttgttcattcactctgctctagtcacactagctccttaaaccctagttccttgaacaatccagacactctctcgtctgaaggtctttgtgctggttctttttctctgcttgaatgctcttcccccagatagccgctttcctccaaattcctccaaataattgcttaaatgtcccttctcaatgaggttacactgagcatcccatttaaaattgcaaccttttttcccaccaatgctttcaattctcctaaacctgccctatttcttccatatcactaattgcctatatatgtatacatacatacatacataatcacttatcaccttccagctatataaaatcacttaagactctgagtatgtgtgtgagaggggtgggtgtatgtgggtgggtgtgtaacatttgcctatctcccccttttagaacctaagcaataggaaagggatgttttttgttctcagatgtatttctagcacctaaaacttacttagcacatagtaggcactcaataagtatttgataaataaatgaatgagtatgaaacagaatctgtggtggatgagaaaatagggagcagccaccttagtttaaccttaagaagaataagagaatttgagaacaaaagcctatttgaaaggaataactgaggggcacagggaaggctaatcacagcttccttcttactctgaccaattcctgagctacagagaatacaaaagtggtttatgtctgtaaagcaattatctacatttcctggtaggacacaaaagactgaataaggtatacctcctattgcaaggtacacagcactaccctctcccattacctctaagccaagataccatgaaaactcacccacaccacaaacacaaacacatttggtttgcctcttataaagcttaggctaaaatgaagtttagggatgatctacaggttttaattatgcatgttttctcattctccttaacaaaaataagatttatacctccaatgtctaatctaaacatggactcagaatgttaaagctaggtgggacctcagacataagctaatccaaactcttcctttttcacttattagtttcctttttgagcacacagatgtctgtctttccaaatgagaaatgactatttcagaagtgtatcccttttgaaatgtacatacacacataaactccttctaaatattatacatatcttctccttcctcagtttcaaataggcatcttgtgttgttatgatgaataaaacacttttctctcttgccttaatcctttcttactctctgtagacaagacagggttatatcttttattttgagtaaatgagatatggtttatgaatctaaatgaatacctataatttttggatttagatagaacaacctagacctcatgaaattaatttagttaaaaattgaatttaaagatctgctgcaagacagcattgttccccttcctactaaattaccattctacaaaaatgcggattcttataatttcagttactaaactaaaatgtaatagaagtaaaggtaagaggaaatatgaactatgaggtaatctataatacctgtttttaaaattcaatttcttaccagtttagtctacttttttctatttctgtcttcaaatatgcactaaaacccatatataggggctacatttaactgtagttagtatcttatttcacattaacttacataaattgaataaaagtattgaaatttaagtggagttgttaatgtcaaacattttcttctgtctttctgggtgggtttgtagttgtaagagtcacttgaagattaattatctcttcatgtaaacctctttttctcatttggcttttcggtttcttctcagactgtgttttagtaaatatgtgtctttaaaaatcatataggtgtgagtgtatatatatttatatataattataatcataaatgtgattacatatatgtagtttaatatatatgggatatcatttttgagattagattataaaatgactctggcttctgtcttgggcagtctttcctgaatcaccctctctggggtagccactgacatttcatgggttagccctatggagaagcccgtgtggcaagggtctgaggtctgccaagaaccacccgagcttgaaagtggatcctctccccagttcagtcaagccttcggattcaaccacaggctcagttgcagcttaactgcaagctcacgagagaccttaaggcagaggaattcagctaaaccatttccagattcctgacacacaaaaactgtaagataatgcttgctgctttaatgtgctaagtttgagggtaatttgttacagggcagttgataactaatacaaagtccaagctcaaaacatagtcattgctatgtaagtagtttatgagggaatccatactgtttcctccagtaaaatcacctattttcctcttgtatccattatggctactcatgccaaaactgaaataaacaaatctactttaacaactaaattggacataatcttttggctgggcatggtagctcacacttgtaatcccagcactttgggaggccaaggtgggtggatcacttgaggccaggagtttgagaccagcctggccaacatgtgaaaccccatttctactaaaatacaaaagaaatccaggcatggtggtgtgtgcctataatcccagctacttgggagactgaggcacgagaattgcttgaacacgggaggcagaggttgcaatgagccgagatcatgccactgcactccagcctgggtgacaaagcaagactctgccttgaaaaacaacaacaaaaattggacacagatttttttttttttttttttgaaattaacgaatacactggtcttctgaaaaaacttgcaactaaaatttatgagccaataccaaaataagtttaaacaaaaatcagatttcttaatgactgtgattataactatttaaattctaaagtagttattcattttgaggccaatactgtttgcaccatacatccgcagcaaaagaatatatccgattcagatgaagagcacaaactaaagactagaaggtaaggctaccagcagggtcttggtctgtagaattatgcaaacagacatatcatctgcctccctctggctgcctcatatgtgaatcagcaaggctaaacgatctacctccatcttcactgtgcatttcaacaacactgtgctggcttccaataatactgcctgataagcaaatagagagaatcaatatgtttacagaggtttgtatctgaagatgttgctcattagttatttttcttcaatatgcttatatttaaaagttttgcacaaaactttcagcatcactagctaattatactcatttattgattcactaccatgtgccaagtacaattctacacacttaggaaacatcattgagtaaaatatacagagatcatttaagagagctttcacagagcttacgttatacattaaatcttctattctctgtggaatttgacatggctgatttatatcttcttcttgaaactatgtcttccattggcttctgcaatctgataggattctgttctaatagtctccaattgttttttcagccttcttcaggggctcctcctatcatatcctaatagccgtagatcctaagatttggctcctgggctcctgctttatataattcatttcctcaaaaaactcattcatttcctgaaatccaatgatcacctttctatatgtggcctctcgattttatatttctcattcaaacccctatatagtgattccctatgcatacatatttctattatgcaatctcacactttcaacaaacaagttaataacctagtcatcatcaactacttaaaatgggtttccctgttctttcattttctaacaatggcatcaccattctctcagtcatctagtctcaatatcaatcctcttttcctaatcaatcaagtcctattcattataccattaaaatatctctcatatccattacttgcattccattccagcaactagttcctcaccacttcatatacagataacattgtcctgattgatttctagtctttctatttccaacctctcattcacactacttctaggttaatttccatcactttcatcatgtcatcatcctgaatcaggaacatttaatagtttcccattgccaataaaatctaaatccctaatcttgacttttaaagctctccataatctggctttaatttatttatccagctaatctcttgctattcaccagtgcaaactatttactccagctgggatgatttccttactgtttctaaagcacatgatgcttatgttggccactagaactctgctcatgctggtcatcatgcttggaaagcttggcaagcatcctgttcacttttttgttctacaaaatcctatgtatgctcaagtctctcgttccgacaaatcccttacaacttttgtccacattctatgtttttagaaacttggttatcatctactgtctatgtcactcaatttggatcttagtcatatttttccatattttgctttttcattgtctcagctttcttatatttaatagaattctaggctacttaacagtaagacaagtttcttcacttgttaaccccattttttttttagtagtctaccacagcagttctgaaactctttgctttggaacccctttataattttgaaaaatatggaggaccccaaagagcctttggtttttgtaggttatatttattaatatttactatattataaattataactatgacttgtaaaagtaattattcatgtaaatataacaacaataaatcaaacacatgtcaacagaaataacatgtttacaaaaataactattttctaaaacaaattaaaatcaatgagaataatggcattgttttataattttgcaaatactttttatggaagacagcatattagaaggcaggtggattctaatgtttacttctgcattcaattctttgtgatatgtttttggttaaaatatatgaagaaaatctaggctcaggtaaatatatagttggaaaatggaagaacatttgaatagtcttttcagataattgtagatattattctttaatactacatcaaaatttaacagtggcagttagtggcagtttctttagtgaaatgggaaatctgaatctatattaatgaacttttggggctttgttatattaaaaccactggtcagtcttgtactttaaatggatttttccccaggcatgattttacaacattattcattgatcatttgacaaatattggttcactgagttatgcaaatcttccaatgttacacatttcattacacaatattctcaaattagttaacatcatgactggcctcatcatagaagtctattagcattggtaaactctcaagctcatggtggcagatacgtgttccaaaattctaattctaaattttaacattggcaagaaataccagttgttttccttaaagtcacaggctcactttatttttgagaaaattactgccaaatacccagtgacacagaatagccatagtttgtcagttgttccttcaagtaaaattggaatcctatgtaaaaagctgctagttcagtttgcaactcaaccatacaaatgctttaccttaagacttgcataggaggatgcaaggtttattgaaggatgaataccattgtccttcagtatgcatcagaagtgctttatgtgttcttcccatttgatacatagaacatttaaaaatgtacataaaggtcaaaatgtaataaactaataatagttactgacttataaaagacattactgagaatggctttttttcttaactgtgagtgtgcagcagtaaagaatacaattacttggaagagtctggcaattcctcagatgactaaacatagagttacatatgatccagcatttccactcctaggtatattcttaagagaaataaaaacatatgcccacacaaatttcatagaattattcataatagccaaaagatgagaaattcccaatatatatcaatcaataaatgaataaacaaaatgtggtatatctaaacaaaataaagaatataattactaacaaatacaatttggtgccactctcttaatttccgccaaggtaccagtggttttacccacagttgcttttgctccatcagtgaaaatgtcaacatggtgaaaaagacaaataacatattagaattaaattgttttgaccgctcagactccctggaagaatcttgggctcggagcccccggtgttcatggaccacacttagaatcactggtctacactatgcctgaaactctttcttcttttaccattatctttggtcacttcactggtttcttattgggctcagaccatttctctttgcattgtaaatatactatacgagtgatataatccacataaatggtttcagctaccacctataaactaataatgctcccaaatctatatctctaatgcagacttatttcctgacccacagatctttatttcttactgatatcctagatacctccaaattaatacacccacaatgtaattcatcttttctcccaaatttactcctgactttctcatctagggtattgatacctctattcatccagtcactggacctagaaatttagggatcaacctgaacttcttcctcttcctactcataaaatggtcagcccaggcaacatcaatatgtgatataatacaatagggtattgcagagcctaagtctaattggagaatgtatgttccatgtaagagcattcagattcaaatactgtgtgggccaaacaaaacacatttattagttgccagtctgtgacatctagtaactaaaatatctgtttaatttgtaccttgcttttcatttttagtgccactctcctaatttagatcctccatcatcctgcttggactactgcaaatagccttataactgatctttctgcctccatttttcacaaatcctttcccctttccaacacatccagatttatctttcacgaggcaaacaaagtagtctttctaaaatgcaaatctggtcacacatttgaaacgccagcttaaaattccaaaatagttcctaatcacctatttaaaaatccacattccttagcacagtgtaagcgtataatctgcacctcccaacttattacatcaacttggtttttctccactttcctatccacacaccaaactccagctaccaaactcatgagtggaggccagacttcttaatcattctcatgtgtcaggcactgttctaaattacatataccaactcatttaatcttcacaaccatatatggtaggtgtcatttctaagtccattttacagatgaggaaactcagacacaaagccacattgatcattgggaggtcattgacagtttttcctgattcaggattctgtgtctttgcaaatgctattccctctgactgaaattctttttgttctcttttctaacaaacttccaccatccttcaagactcagatcaaatatcattcttgagctaccttctcttgctacctccttccccaggtaaagaaaggtaggtattccttcccacatttagagcacaaagtacatattaaaacttaacagaaataggcacctgcctaaaatttagcacagcataacagtggcttaccagtagtatgcaggccttgctgtaagcaatatgctgtatcaagaactacaaattctactttttatgaaagagagagaggaagaaggtgatggtgagtctgttcttgctctcccttcctatccccactcacctcaaatcaccatcacatccctttggcagatagtcctttagagatgatccaagtaaaagccatcacttccacatgttggaagtgatggggtcttatctggggtcttaaaatctatgaggcttaaacccacttcataatccctcaataaggtgatgcctgtttggataattggaactgtcaaaatcaataagaaaagtttaaaaacagtcatgacaagccactctgaaatgaagaaacaactgtaagtcactgattactatgatttttacaaagaaagctatatcatctttcgtaaattgagcattaaggtataaaagctccttattctctaacacatttagagtttgaatacatgtaatccggcatcttctgctaggcagggatttaatgaacattttgtgggaacatctgtttgttatttatctttgtctcattttacacatcagcaaatcccattctaccaccaggacagaataaaaatcaccatttcattacacagtgttcataattttaaacgtcaactggggggaagagaggcaattgtcgacactgtattctacctgatgttacaaggagaaagtacaaaggtgaggaagtgcagaggggaaatgattaaatatataaatccctttaacacacaccttgccaattgctacttgttttactgttccagcaactgctgagaattaaaagccactctatctttctagaaggacattcttattttgccctcttaagtctatgtcaacctttttctgtgtgttttaagagagaaacaactattgggcttgccaggtatagatctttgaatatttgggaaacaagtgagagggagggagagagggagggagggagggagagagagggagagggagggagacggagagagagagacagagagagagagagagagcttctatattttcttcaatgttactattccattgcatgaagtcatcaaatagcatttctatatgcttccactagtcgttatgagaaagagccagtatcaaggccatcaggaatgaccaccagtaccatgagctaaggctagtgcaaagaagggaaagaatactgccaatttagtccaagtgactaaagccattactgtataacatatgcatcatagtatctacttgtaaattttgcatgttttaagttagatagtaatattgagtgaaatcttaattgtaacagtaattaaaggtgatttttccctaaatccaaatatattgttctatatgccatggagaatactaaacaaaggaataagaaagtcacagtccttgccttaaagaacttgcaatcatttcctcccaacagtcatttgtagtacatataaatcactagtcttctataagggggaacaagtttggcacatacaaactcactaaagaacaggagaatatataacgcccaatcaaacattagattgggtagtacagacaataaatactgctgtagttcaaagaaggggaaaatcaatgtaggctagcaaaagaagaggaggctttctgtgatgtacaggatttgagtcaggtgagttgaatacgatttacaaaggtgaagggcgaggacaaacaatcaaattaactaatattatgtgcctttatcctatcccaacactagagttctttcccacaaaagcattttgaaagtccctccccataataccatcaaacaggtaaagaaagagataaggagatgcacacatctcccttacaccttcttttctaagccaccgaggaacagaaacctcagttaggaatcgatgcagatatttgattcaagtaattgatgctaaaatatggttaagggttaacctcaccatgagacattatatcttaaaagaggaggtcatgaatcaatacagaatctctaattagtttaattatgtggaaaaagtatttttaaagctgggcaaacctcttagaaactttttcttctatttgtccattttagacaatggtgttccttccccacccactctgctagagcttacaatatgcaggatcactgggggtagcaaatgcctttccttttatgtgcaagaactactttacctcattgggctcctcagtttttggacatagcaaattgctaatactagaaaccatctgacaagttgttctaagtaagtttctattttcttcagcattagttttgttctgttttattttgtaaggcaaaagcacgtattaagctataggaacttatttaaggttgcttaaaaaattctcatggatgaaacagtagtcatttttatttatctcagtgattttcagctaggctggtatagcactcactgaagatcatatcagaatcttcgagaagtctttttcaaactatgtctccctatgtctaatattgcatgtttccgcatggtggcatatctcttctctacttgatttcagcatcagcctatgtttaatacttacaaagtattacttaccttcattcctaacctacctctgcatggcagatcatcatgctaatggaagcaatgaaggaaggaaagaaaaagaaggaagcaagaaagacaatcctaagcaaaaagaacaaagctagaagcatcacgctacctgatgtcaaactatactacaaggctacagtaaccaaaacagcatggtactggtaccaaaacagagatatagaccaatggaacagaacagaggctgcaaaaataataccacacatctacaaccatctgatctttgacaaacctgacaaaaacaagaaatggggaaaggattccctatttaataaacggtgttgggaaaactggctagccatatgcagaaaactgaaactggaccccttccttacaccttacacaaaaattaactcaggatggattaaagacttaaatgtaagacctaaaaccataaaaaccctaaaagaaaacctaggcaataccattcaggacataggcatgggcaaagacttcatgaataaaacaccaaaagcaatggcaacaaaagccaaaattgacaaatgggatctaataaaactaaagagcttttgcacaacaaaagaaactatcatcagagtgaacaagcaacctacagaatgggagaaaatttttgcaatctatccatctgacaaagggctaatatccagaatctacaaggaacttaaacaaatttacaggaaaaaaaacaaccccatcaaaaagtgggtgaaggatacaaacagacacttctcaaaagaagacatttatgcagccaacaaacatatgaaataaagctcaatatcactggtcattagagaaagccaaatgaaaaccacaatgagataccatctcacaccagttagaatggtgatcattaaaaagtcaggaaacaacaaacgctggagaggatgtggagaaataggaacacttttacactgctggtgggagtgtaaattagttcaaccattgtggaagacagtgtggtgattcctcaaggatctagaactagaaataccatttgacccagcaatcccattactgggtatatacccaaaggattataaatcattctacaataaagacacatgcacacatatgttaattgtggcaccgttcacaataccaaagacttggaaccaacacaaatgcccacaaatgatagactggataaagaaaatgtggcacatatacaccatggaatactatgcagtcataaaaaaggatgagttcatgtcttttgcagggacatggatgaagctggaaaccatccttctcagcaaactaacacaagaacagaaaaccaaacacgacatgttctcactcataagtgagagtggaacaatgagaacacatggacacagggaggggaacatcacacacgggggcctgtcagggggtgggggactaggggaggaatagcattaggagaaatacctaatgtagatgatggattgatgggtgcagcaaaccaccatggcacgtgtatacctatgtaacaagcctgcacgttctgcacatgtatcccagaacttaaagtataacaaacaaaaaaaaagaagaaaagcgaggagaaatttttaaaagctagaggcacatacagtaccagctttctacttgactaagctttcaaatcctgattgaatgctcttcattcttaaggactagctttctattctccatactctaactaagaagtgtgccaggctgtgtttgtcatgtcctagaaaaccacttggtaaatactttgttccatctgtaattgaaaaacacatgacctgacacttttgacaccatctaggggatagagtgtgagggaattagaaaggttctgcggatcaattgactccttggtagtaaagagtgggaagaaagggcaaaagccaataagccatcatcacagggttggcagcacaggtaatcacaacagtggaggggaatgggtcaactatggaaatcatgtggaactatagcttaataaccaagaagaagcaaatgcagaaactagtgcgaagcaagggaatgagatacagaagaaggaaagcaatgaaataaaagataatacccttttcaggtggaaaggccaaattcatctgtaactccaaaatctcaataagctcatctaaaaggatgaaatgccacaaagcctatttgtaacattctattccattatcaaaaggcatcttgctaggatccaaaagaaaaaacaaaaaacacaacaacacatatacacacatacttgtgcacctatgcatatgcacatatctgcatgcaaggattaaaacagaaacatgtagagacatacacacagccactccccgcccacacagacactaacaccaacacatgcatgccccccccgacacacacaaacataggcatgtgtgctcactccaggatgggtctgagtaaaaagaaaccatctctgacctagctaattttcttcttcaacttgttgttcttggcttcttcactcaggaataatcccaatcaaatgcaagaagtgtgtgagtcactaaacagggcacttaattttggttgtcttatattacatatttataccatggagattctggctactttttaaaaagtagttttaaaaggtataggtttggttctgaagtggtgttactggtgagaaagggtataggaaaactatgtacagagtcacctctcatgggatcttattctaagtgaggtgtgtgccttttaaaaatcagtcactctctataaattcagagtaattgtttttgaaatctaagctggctttttttttttttgcacaaattgacacactgattccaaaattcatgtacaaatacaagaaacccagaaaaaccaaaacaatcttaaagaagagcaaagttggaggactctcatttcctgagatcaaaagagtgtggtactgacataagggcaggcatatagacaaaacagtgtggtaacaatgtaagggcaggcatatagacaaaaggaataaaattgagtgttcagaaataaacacttatatttaccttcaattaatttttgacaagagtgtcaagaccacgcaacagagaaaagtggtttttcaaacaaatgatgctgggacatttggatatccaggtgaatactatagttggatccctgcctcacatcatatacaacaatgaactaaaatcggatcataggcctatatgtaagagctaaactttgaaattcttagaaaacatgaaagtgaatcttcatgactttgaagttaagcagtggtttattatatatgataccaaaacagaagcaacaaaagaaaaaaagataactgtgctttatcaaaattagaaatattttcagacaaatgatataatcataaaagtgaaaagaaggcctacagaatggtagaaagtattttcaaaaccacaataagacaccacttcacacctattagtataaaataaaaagaaaggcagacaataataagtgttgacaagattgtggacaaactggaatgcttatttattgctggtaggaccgtaaaattgtgcagccactttggaaaacatttttgccacctcctcaaaaggttaaacatagagttaccacatgacccaggtatatacgcctaggtatatatataccaaagagtaatgaacacatatgtccacatgaaaacttatacattaatgctcatagcagcattactgacaatagccaaaaatggaaataacccaaatgatgactagataaacaaaatgtgctatgtccatacagtggaacattacccaaccataaaatggagtgaaatactgattagtgatataacacagattaaccttgaaatcattatgctaagtgaaagaagccagatgaaaaaggccacatatttcatgattccattcatatggaatgtccagaataggcaaatctatagagggagtagattagtagttgcctagcactgggagttggaggaagggagtataggaaattgggagttaaaggctaaggagatctgggtttacttattttgggggtaacaaaaatgttctaaaattagatttttggtgagggttgcacaaccctgtgaatatactaaagatcactaaattatacacttaaaatgagtaaactgtatgatatgtaagccatacatcaataaagctgttaataaaaacagtcactcggagcacatgatgattgttttccagcatttgaagggctaccagttgcttggcatagcagcaaggggaagtagaatcagggtcaccacactacataactcctcaatttattctgtaggttgtgtggatggtactatgtctaagagtaggagctgaatagaggctgaaaagagattttggcttatttatgcaaacattcaataacttgagctattcaaaaatcagatttcctaccgtatactagagactgttaaattattgggagtatctaagcataaactggattgaccacttgaggatggagtagatatagggaatagattatgtatgaaagggagtgagggaaaatgacttgataacctttaaggtttcttacaaccataaaattcttttaaaatgcttatattacaaaatccttctgaacttttatctataaacctcccttttctctttcttaataattttctcattagctggaaataaatgagtacttacatattcccactagagtcataagtcccaatagtcgtattattatacgaaataataaaacttgatgctgtggtttaagccatttctaatatttatatgctgtttctggctcaatcatttagcaaagggcacatctactggattgctctttccttagtctgcaggtttaagggtagcatttcgtaaatgttagtaagaacaacatcctacattgtacttaacactgataatagttaatgaatacaaatcattccgtactcttttatctccttcctccctcttctgtcctttccccagatatggaataggcaggctgttgatttttacaagttgcttccaaagctcctgaatgaactatttgtctgagcgttttaaatattttggcttaagtccatgaatgccataagaaactggcactccattttgcaatgcttttctctctgtcaataactttaacttgggatcataaagggaaagcatttggcaggtggtccattatgatctagatttaaaacctcatggggagtcgtctactccattttacactttactgggaatgattccgatactgaaaagagagaagtacagatactatgagaaaagctgtttatccatcacctgtttcacaacagcaaggggcagtttactatcctgggaggggcagcttatcaatagtgccctgaggatcagaaatggctaaagagcttcaaatacttccctcactggattggtcaagtacaggcaacacaatacagtaggtgctagctaagtagtgctggctgacttatcctggctcactgacatgtcaaaaatctccaatggaaaacatctgcaatgaaattgtactcattgtccagctagtacaccagagccttactataaatcccaacctcagtgttcatgccttggaactgtgttctaatgttctaacatagcccttctgttacttccagtaataaatccatgtggagatggtccaagaagggcattgccttagatcatattccatgttagagtgaggttcttctctacagcttatgcttcatctggccttaatgtgaggccagccaaagaaatgttctggagagtttgcttcggggtggggtttccttttattttaactagctgttaatatttgacaaaacaattatgtccttctcacttcaattccttcaaaccatttcttctcagaccatttctttcccttcttgttaaatgcctcacaaagcccatgggtagggcactcagggaatactagttgagatggggagagacactactggaattccaggctcatccctccagtggtcatatttctgcctgtgcttattcctttttccgtgagactatgctctttattgctcactccattcaaaagagccgtgagtgccaatattcacgaactactcaagctgtctttatcatatttactttgtgtcctaccttcataaaccactctccctagattccttaagcatttcaattgctcttttccatttcaagcatctcagttccagagaatggaaacttgggcatagtcttactaccaattaaaaagggattctcactactatgctctaagttatttgtccatatccatgtcagttactcaaaaccatattggcttttaaaatgatgtatcacattgcacactcttaatatagtttactatcccctgtcacttgtagatgtataaaagcatgaatcaaaattacttttgatgttttatatttatttgtttgatatttataaccaagacgaaatgtaaaatgccacccataaaacctttccagaatagtctgatttacttgcagcttattgtcatttttattaaatatggattgtcacaattattttacgttcctcatattccttaccacaaattgaggtgaatgcagattgtacaacttccaatgaataagctgggcaaatttccatgactcagcagagtgtgtaaggcttgtggttctttgcaattcctgttccacctccaaaccccacggtcaaggtttgggaaaatgccaaccatgtttggcagcaagagtcagcagtctcttagactgctgggcaagcgagtggcaataagtagagtgtataaagaatctaaagaaggctttctttacaaccccttagtcagaagccctcttaaaacacatcccaattcctgttcaatacacagctagcacaggaagtgttttctttacattctcccattttacgcagatctgggatttttatgagggaacatcctagtactgataatctctcttctctcttcccttctccctttctctccctccctccatccctccctccctcccatcttatctcttcaacacccatacccacagagaaacagagtaagagaataggtaaccattcacaattatgtgtataagtaaaaagcaacaggaatgcaggctttctaagagcagtgtttctggagacagagctctagacaagttagtggtatatatagtctcggctaagaagaacaacttctttatcatttattgagagtactaacaaggattaaataaaataatttatgtaaatatcttagcatagtcctatagcatacctttaaaacatatttcccttcttctctactctggtttaaattaggaaggatcctgatcagagtgaactttttttactgaaagcagaaatgactggtttcctaaacaaagtaaaaatgtcactgaaaattgtagatgtagtctgggggaagggagaggcaagaagttaaaattttcctttagatccaaatgggttttctctttacacatttctcaaaactgtagctgcgatactgtctctttagtcctcaaaacaaaagaacctatatgcagagtgctccagggtggccctgagaggcactttgaaacacccgttttgaactcctctaggcagttcagtgaggttggatacaacaatgaattctgggagtgagtttgaatggtacaaaaaagctggggaggatgcctgctgtccattaaaaacagaaaacagagccaaagaaagtgaagaatggaaagagaaagaagggaatttcaggatgtgctaaaaattttagcaattgaaaagtatacaaagaactgggatctaggcaacagagggcaggtccagcaggcatagttacttaccatatagtttccatagataacaatagtcaaggacattactctatccatgtatttttttttcccagtactttagaaatttgacactgggttctttttaaagccaccaagtacaactaatatacttgatgaactccacacaataacaaaacataaaaggacctacatttatatctctttatgtacagactacattccatttctgatcaacttcttccaaagtattaatgctattttaaataacaaaatagtcctgaaaggaatatactactggttcaaaaaagatttactcgcggaagaaatggaagctgaaaagttgtgagtcatgagtggctaaggggttgaacaatccaaaagaaaatagtgaaagggactatgagagctaaaatgtataaaagtgtctatgacataaacattgaaggtaggagctcttctgattaactcaactttcttatccctagctcagaaatcaagacttaacagccaaccctcaacagcaagccaatatgagaaaaacagtactgatgagaaatgcagagtgcagctcgcatttaaatttagttgagatcataatttgtcaaatcccttctgaggataactcactttaggccgtttttaaaatttaaattatccataaaaagaaatgcttgtcctatatgtaaaaggaaacaacattccagtttgatttcctgttgatacaattatcactgtggccatctagacctgtaagagaattactccttctggatagccaaaccttcttgagctgcactgacggtactacatccagtagccacatgtgattatttaaatatccatttaattaaacttaataaaacaaaaaaattcagttcctcagttgaagtagccacatttcaatgctcaatagccacatgtggctagtggatactgtgttagatagatagtaaagatacagaatacttcatcatctaacacagttccatcaggcagcactgggttagatatcaggaaactaagactttcagtgttcgaacaaaatattcaaaccattttcaggatagtttttccacagtgtaattaatatgaatatccatagagaatacagatcagaatttagcatttttgcctttgaacagtggttctcaaaagtcattcatacaggagaattatctggggagtttgctaaatgcagatcactcagagtgattcagtaggtctgggatggggattcagaaatctacattttacacatgtcttaggtaacgctgtcacaggtaattcctaaaccacattttgagaaacactgtgattatgcatcaaaaattccaattatcactttacatataccgatttcttttcttgaatggtattaaatatgtgtacataggcaagcccttatcgctatacaaaagtgcaaaatgttccacaaaggcaaaagacagctttcaaagtatagtagctctgagcgaggatgagtatagaaaaaaaaaattaagaaggtacttgcactaggaaaaaaaaacttttgaacagaatattccagaatacctatgcaaagcagaagcaatttagccatccagcttcagaaactcatgcttcggaacagctcggaacctttagctagcagaagaggagaaaaacctctggtggtgcagctgctgaaggtctgaatactgcatgtgagtgctaactgtgtgcaagacaccaggttatgtgctaagagacaagtaaaatatggtcatgacttcaagaactcagtctattgggggaagacagaccaaaaataaatattaaatacagtagcaggtataatttgagtggaaccttaaatattgagcagctctacgatcgctggagataaggaaggatggcaattgaaatgtagagaacagtatggaaaggcacaggagcttgaaaatttggggtgtacttatgacccagaagtggtctagagtggcaggtaaataagatatagagagcgttgtgtagtgggagataagagtgtaagggaattctgagtgcctgggacaaggctatggatggccctgaatgtctatttggaaaaaaaaaaaaaaaagcaaaatcctttagaggatttttaaggagaggagtgataggataagatctgcatttaggaagaacattctaacagttaggcataaaatggagtcgggagagagtagacacagagaagatgtgtgatgtttggccatttggctgcatggaagaaaaattacactttggctgtcaatgtttcttgttgcaaaaagctgagaatggagagaagcaacagattatgaaagagaccttaaaagcaaagctgaaaatctgaagaaagaacatgagtagtagcaatgtttagaaattcctggggatgcaatgttccccttcactttgtcagtaaagactaccaacgatgggggttggaaagaaagtaaaaatttttaatagtctggtcagcagacagctctacactgtctaggtcttttgaagtcatgaacaatgggatatctgctccgggtagcacacaggtgggcaaacagtttctttaataaagaacccctaaagacatacagcatactccacagtggttaagagcattggctctgaagacaaacttgccatccaatattgattcttgctacttagtaattgtgtgacgtggtaggctggatacttaaactctgtatctgtttttctaacctgaaaatggaaatactactgtctaccttatggcattgctgtgagcgttgatgagttcatacatataaggtatttataacatgatctggcacagagcaagctttcaataaatgttagtttgttttttgttttgttttgttttgtttttttctgagatagagttttgctcttgttgcccaggatggagtgcaatggcatggtctcagctcactgtaacctctgcctcccgagttcaagcgattctcctgctgcaggctcccacgtagctgagattacaggaacccaccaccatgcccggctaatttttatatttttagtagagacagggttttgccacgttggccacgctggactcgaactcctgacctcaagtgatccacccccctcggcctcccaaagtgctgggattacaggcgtgagccactgtgcctggccaaatgttagctattcttattattgtgtttatatatggctggggagacacacactcaactgtactatgctcaataatgtcaatcagtatagtttagcagccccatttgcagtatactatcctacataaatagcatgccttaattattgtattattcataataagcatattaagtcctttttggaaaaaggcaaatatgaataaattttcgaatttgttaatattcttggtgatccccttaaataagctagtgcaagctggctccagcacaccacggactggtgtatactaacctttatattcccgtccatgagacctgcccttcactcctctaaaacacgctcataggtgtaccaaagaggaaaatccatcagacgactcaacttcagctccctgaacaaccagaacctacaaatctccctcttgaatttttcttggcctcaaacaagacaaggaaaaagtaactattttgtagatgaaagactttttctttagccaataagaaaatgtcaatttctttaaaagccccaataaattctttttcatttatattcagagtgcctattcctagaaaaaggaacacagtgagggatgttagccagagcttccaactacgtaggacatttgccacctgaaaccaagtttaatatggaacttccaatttcatgcctagtttgcccagttctccttcctctaatcctgatctgttccccgaagttcccacctgtattttttaagtgtcaaattcatttaagtctaaagaatgataaaagggcttcatatcatcctcctttcttttttgccagaaggaaataatatgaggacagatttactttaagacatgttaaaatataaagataccatcttagataagggtaaattccaattacatggtatctgagataatatattcattaccatcttaaagtctcataaacagattataacaatacttgctctatctctggcccattttcttatcaacattctcaaatgttcattgtcaaatgctgaagaagagttgtctatggcgtgaacatcgagtcattaatctagtacacgggacagtctctaataaattcagatataaaaatggccccttcaagaatgtttactgaaggggtcctaaagaaagttttaccagagagcttgtatgagccattcaagtagttgggttcatttgatgaattgataatgtggctttaaatagtattcctttcttcagtgggacaaaaagcattttttcccttaaaactaattaatttaaaattgagaaaccatttggaaattttaaaagataagaatgctgatctatgagagagagagagagagagagaaagagagacacagagacagagacagacagaaagaaagaaaagtgtgaacctgaattagctgtatattttttctgctgatctggacaaaatactcaaatttcaaaaacatatagcacttcacattcatagccagtatatcttaaaatacatatactttcatggaaacaatcttataagttcatccagtacaacagtacaaacaaactagctttttagaagagaaaatactccatactaaccttttggaatagacaacattttgcttccccaaaatttcacaaagctctactttcattcatattgatgtacacattaatcaaaacactagtgtttcttacacatctgtaaaattaatcttgaaatcacacacatattcaaataaatgctagactaaaaatagttttgaaaacatctctagcgtcctatccaagaatacatttttcagtaaatgaccaaatttatcctccttctctagtagcataagtcacatttacctggcacccatcaaccgagaggcagcctgatatcagggaggaaaaagcacagattctttaatcagataatgtaacctgtaagtttaggctgcacttagatggagacctcaggccagttactcatcctgagtctcagttttcttacctataaaatggagatcatatcactgacctcacacttactgagaatgaactaagaaagtatatattaaatcactgtctaaatgttttataccacatccactatcattcagtaaccaacaactacactaatattgtaatttttaatagagtaaaaccattaaggaattaaacatgtattcactattagcatacaaataaaatacagtcataaaagccacctagttagatttgaaattattcattaggtcactgtggaattgagagctggcaaggagataatgtcgtttttaaaatgtaaacatttttattagcagagagaagttcttcccagatatagtaattccagtagcataacaaagtccagcatttttcattgccagaaacttaaaccagtaacactggtccatgagaaatctctatttattcaacaaagcaatattttccatgtaaatctatttaattttatagtggagaaaataagacaatctctggttttaaccgtaagaaaaaagcctcaacaacttctcacattaaaatgtacacagaaggctcttctagagtcaagcatgcattggaatacagagaaaacatccagcaagcacaactttccaacacttagcagaaccaaccaaccaatactcaaagaagaaactgaagctataaattcaaataaatgggctgcagggagactacacaaacctgctgttgctttaattgcagacaattcaattcagcagctgttggtccaggcactaaggttcactgtatgctcttcaacgtaaccttgaaatattgtcactcactcacttctccacatcatctgcatgctgtccaattaatgaggagcgaaatcaactgtcaaaccacgcatcaaaatagaacatgatcttttagctgttaagcgtaggagcataatattttaagaataataaagcaacaatggagatgaaagtccttgacaacaaatgatattcaaacttatcaaaacaacgtggttgtaggaactaagcttctgttctgtgaagcaagaaagtgaaactttctcagggtttttcatttgcaagggacctttctgtctaactgctgtgtaagaagcctttcaaaaaacattcgcccatacctgatcagaatcttcttcattattatggaccattatgtttctgaaagcttaagagaatacttaagaaacacttttgatccaaggatattttacaatacagatggtttggggctcgtatttgtagctttgctgtttccagcacttttttttttctgtcaggagaataaacaaacaacaataatatataatgttcatcaacctgagttcagtaatgaaaaataactaaatttaccaaacagatgtgtcctggaatgcttcctgtttgaagtttccctactcttaggtatatcccaaatctatacaaccaattaacaaatacaggagttaataaactctagagaaacataacacactaagtgtttaaaaattgctttttgcttccaaagcactgtcttctgtgcaaacactctaagctatatcacatactaccagttgcagacataagacttgagaaattcaatacaagaatacagcagagaagcgtgcacaattaagggatcgggactaccagtttaacagaaaacgcagattttatacagcaatctgctacaaacattatagctgggggcaggcatgttttatgcagctattttgtttagctcattagaaccctatttgtccttcagtacagttgaactgaaggaaaaataaaagaaagaaatgcactttgaaacaaaggggaaattcagataaaacaaaacatactatacctgtatattgtaccaggaacattgtgacactcttcagggaactgtttcacgttgtatcctatcgtgagttattctctccttaccctcttctctccacaagaagaaaagccaaagcaccccaaacccccactataccctatccctaacccacccaccccattgaggaaaaagaaaaatagctataattcagcttagatctgacgcttctgtttagctcagctccagccgagcaactgagcttcagcaacggagcatagggaggaggattctgatgccagtagcacttccatccacttcacttacacaaaagcaggcagtggaaaatccaggagccttgaagacaagggctggaactggcttttatgaattgctattactgcatgtgtcaccatccatctccaatgacggacacttataggctgaattgggagtggagggggtggggtggaggaggttggagagcaggtggagaagcaattagcagtatgttcattggagaattcgttcgggatttcatacatcagtgcctaaagaaacagcatgcagttgacaaatcagaactttacgatttgcatgccttggaagaaatcttagctcacagctccaaacaaaataatgtttgcccactcttacagggcacagaaagtcacccctttgctttttctttcctctggctacccttattcctgagaaatcaacattcagaatgaatatttgctaattttccctaaagaattgtatttttaaaaggctggaagcaaaggaagtataaagaaattaaattctattgaacatgacatctcttaacacaaaggcaagaagctaattattttaaggcaattcttcatccctagtcccattccccaagcgcagctttcacacctataatcagtggatcacacaacttttgtccatatatttaacactgaaaaacaaatctatgtctacctaaaaatagttcagttaaaatgaaggtgaaaagccaagagctatgtgcaggacccacttcattaggtgacttgagaaagcactttacatgtaagtgcttcagttttactcatccactaaactaaagctcatttttagacggattttaaaattaatcacgagtaggaacaaaaaggagatagtgtctttgggaggaaacatgatacaaccgaaggagcactggggctgggtatcaggaaacctgggttcagcttccagttctacaactttctaactatgtgactctggccaagtcacttaacttctttgagcctaagttccctttatttgttaactggagataatagtacctatcctgactgtctcacaggattgctgtgaacagctaatgagataataggtatgaaaacccttttgtaaattgtaaagggttatacaattgtatgggattattactaccatgccctaaacaaatcttgccttaatgattgaagtgaggcacctctatcacataaggcaaataaaaagaaagaactaatataatttcatgaaacactgctcaattcttacaatttttaaattagacggaatcgctgtttgctcttaaaattctatagcagggaacgtttttgagaaaattttaaaataatacatcaaaagtttattaaagagactggagccctctaaattctctctttcctttctggaaagtcagtccatttttcttcatatggtctagcattatgtcccatctggaatgcaaactactagataatgagcatctccttttgttcaagctttctatttgcctgttacatcctcattgcccagtgtgttgggggaggattcaaggtgattaactaaatctaaatccacaaggtaaaaatccaaagttatgctttatgaggctccaagctgccttgatcctatgtatacagtgaccagctggcttcagctgggacacaattttagcacatgaagtcctggggtggccacacctggggcactaaatgatccaggcaatgtttggggatctttggttcagccaaatcccacatgtcctgatttccatctgtatggtggttcccaagtgtgtttgtccacatgaaccaaatctgaagcagccaaaagaaaggtgggggatagagcagggatatcagatgtcagctcctcttggtcccatccagtgctatctgtgccctcaaacaagtgcccatcctacttcttgtaagaagaaagaaaactttttctaattgcccctttgaacgtcattgctactactgaagatgccagtaaaatatatatccaaaatctatgttaagccaattgggaaaaggataatattaatcacataacaggtaattggtagctaagagcaagtgagctgctgaaagggggaaggggagaaaaagacaagagaggaggagggaaacagaggggaggggtggagaaaagagaaaatgaatctaaagtgagagctttctaatcagaaacatacttgctgaaatcatccaaagtctcacctactataataaaaagtgcttgtcttttgaggtattgggagtggccccctaaccatcaaagctgcaaacctagccttccaactgcttagggaaacagtcaagagcctgaaaaggtactgacagccctagcaccagatctcactttcctctgccattcagaaagtgagtcaggtgggatacaattctccagaggcctcatccctgctaccgtccaccacagcctcactggcagcatggctgcccactaaggaaggtgtcagtccaatttcaggttcagcaaaggaggcttgcctgtgacttttaaaaccacattggtaagaaaggaacaaaggctgtatttcagaataggactgttctccctttgggcattgcaactaaactccttcacaaatttaagcttgaaattcatattccccaagttcctcagaagggccattcaaagtaaagggaaaggacaggaaagatgattttttttttgttagcttctttctgacagtcaaaaaatgaggaatatgactgacagagtgtcccaaaaggcaatgaggtgggaggcagtagtttcaacccaggttagcaagaagggcaatgaaagcatccttataaaaacaaacacgcataccaaaaaccattgcactgtttccattatcccgatttcaagctccagaatgtaagcactaatggttccctaaaccacccaagctcctcctcggcagccgtcaccaagcctgactgatttttttcaaatgaatttccatcactagccaccccagattctgagtatttttgtcaaaaacaaaagtcctagtggaagatttcaaagaactaagaacttgaaccaaaccatgaacttaaacgggaagacacagaactaatttgctaaattccaaacaaaacagaaattgtaacagtttgaaagcaacaaaaactagcaagctgatttgaaccagaacaaagtttcatgttttctgaatcaatcaaacttgcaccaaaccctgagagtctaatcagctcaagctcctgcaaagaacacacagcaaggtttggtttcacctgtctgaaagctgacaagggaaccacagaatgaacactggataaggagtcagaagaactgacgtctcctgattttcttcactgtttgatcttggtcaagtcacttctactctcttagcctcagcttgcttgccatgaaatggccaggctgggattgccaatatcccaatatcccagttttaatagtctatgccaactgtggaatttagtctagtgatgaaacagataaagtcacaatttagccttaatctgcaggaggcagagagatggaccaccccaactcttttaaggattcatgtttctagcttattttgaaatatacttggccgggcatggtggctcacaccaataatcctagtactttgggaggcccaggtgggaggatcacttaacctcaggagttcaagaccagcctgggcaagagagtgagatcccacctcttaaataaataaataaataaaattttaaaaagttttttttttaaaagaaatacacttcatttaagagttggtaactgtccttgttcagcctcagaaataacctaatatactttttcagaatgtctctcctcaaaaaaatgtttcaggaatagtttgttttcctcaagtgaaagttacagatgagttgtttggtccaataaaaggaaaaggaaagaaatgacagtgatctagtataggctgagcccctattacatgtcagacatggcaaattttacataattttcttaaccaatcttcacaatacaacactatatggttttttttttttttttttttttttttttgagaaaggatcttgctctgtcacgcaggctggagtgcagtgacacaatcatagttcactgtaaccttgaactcctcggctcaagtaatcctcctatagcagacacttttatcctcactttataggcaaggaaactaaggcttactgatgctaagtgacttgcttacagtacttgactggtactgggattcgaactcaggcaatttgaatccattactataacaatatcttaagaattaaaggaatagttcttaattcactgattcaattggacttgcttagtgaataaattacatgctgattcaaaacagtgaaagtaaatttacttgcatttatactgggttgacatttttttaaatttcattttacagtttggtataacggttaggaatactgggctctggagtcaggcagacctgaatttcttgaattctgtcttatggacaatacagttaaccatgctttgtctcaagttttcttatctgaaaaatggggaggaagtagtccctaccttgtcaggctgttggaaagtgtcagtgatctgatagcatctcgcatagtacttgacacaaaatgacaactcagtaaagaccgatgaaagctatccttgtattcacagcaatacaagaaagaaaaggttataaaggaaaacgacactgggattcactgaatttaagtgctctttggttatagcacagatatagtttggaaggttttcagtggtctccgtacattctccaaaactaacttgcatcttatggtaaatcagcatattcatgaagcaacatgaatacattaattggggtttcctaaagagtagcaaggaaacttgtcatgtgctctgcttagcagcagttgtccctagtttcctggaacccatccttttaaagaaaaagctcggaagtagcagacagtactgctggaagtaccaggcaggtggagacatcctgctttcccccaattcttcaagccctggcttctttcctattcacctgtggccctcttctcagattcccttctgtccttccccagtttattctggttttatcatgattcttcctctggcactagctctgtttctgctcatcagcatcaagtgctgtctatggaatgtgtgccttgcacgacactaggtgaaatagaaagtcatccaagagttaatgaaaaagacatgtgatccatggccaaacagatctaagatacacagactagagttttggcaacacagtaaatgcaggtataatgcaggatgacttggttgatttcagagcacaaaagagtttgttcatctagttaatgatatgcataaaaaaattttttaaaactgtactaatgtctgccacttaatctgaaatgcagaaaagaatggatagattaataggtgataaagcaaatacaacaaaatgttcattgtagaatctaaatggtgagtatctgggtgttcaatgtgcaattcttttaacttttctctgtatttgaatattttcacaataaaaggttgacgaaaaggagagggggaaaggggtatggcttattcaaccacaagtgtttcagaacaaaataattataattatatagaaaagtataaagcaaatagggcaaaataataacaattggtgaatctgagcaaatggtatataagaattcttatatgatgcttgcaatttttctatatttaaaagtacttcaaactagaaagttaaaagataatttgttgagcaccaacctcttttacctagtgtctcagttgccattttcagtagtgagggcattgggttaatagtagagatattggaaacaatggtggaagggtggggaaaaataacagtcacagatatatattgggggcctactatatgcaagacactgtgctaggcactttggggaattcaaagaagtaaaaaatacagcccctgagagggctcccactgtaagtaatggaatgccaaagcagtgtctgaaagggtaactggctggagcagagttctgtaagacagaagtacaaagattagaaaggtaggttggagccagattgcagacagtactaaaggtcaggctgaagagtttggacttcatcctatggataatgggaagccatttacagtatctgagtcagggaaagaacatgatctaaaactgactggctagatggtacaatttgtttgggcacaggtaccttcaacatgcatttgttttatattcatgtacatctggtacgtctatccacttcccatatctggatgtgacgtttaaggatttccaacatgctggttgctgcttatttttcaaatagccacttcctgacatctcttcagcctttcctttttcctcccccaaatcccaagggcagctgaccagcacgtgcctcagccctgctgactcagcaagcaataaatacgcctcatagaatgcttttgaaatgaagctgctgtgcttcaaaactgatttctttccttcatgataatcaaacctcaattactgctggaatcactgatttgagttggaaagaatgaatattcatctgagtaacatgtgaaggagtgcaggaagttatgtcctgtgtgcagaaggaaacaattgttcaaagtgatctctgtatatggaaagaaaccctagcagagatggcattgctgaatagtagcaagtgattagggtaaaacctctcaaagactgccaaattagaaagtggactttataatcctttggatatacacccagtaatgggattgcttgggtcaaatggtatttctggttctagatccttgaccatggcacatgtatacctatgtaacaaacctgcacgttctgcacagtatcctagaacttaaagtaaaatttaaaaaaaaaagaaaaaaaaaaaagaaaatttcctgatgtctatgatggtattgtagctatatatggaatatccttttttttttttttggtagaagattcaaataaaatattcagaaatgatgaagcatcatattaaaattttattctcaaatggttattttaatattctttataccattctttcaacttttttctaaattgaaagtatttcaaaataaaaataataaaaaaaaagaaagtggacttcatctgtcttcagcttttccccccatgaagtccaacctccagtgcaatcatgttactcctcccatttaaaaccctgtgttcactcatccctacatataggacaatggccatacttcttagcaagctgacttacttcacccaaccagccacaggatacctttccagactcttatcctgtccccctttcccatgctttcagtggttcacacacaatatcttacctttttctgaactatgcagttttacacatttgactgccttgcatgtgttgatggtccctctgcctggaatccttgcccatcacctctttgtccacatagagactaggcaatgcccctcatcctttatgattcagcacagttagactctgatctctaagttgtccacccccagctgtaattccctcctccatattcccagaacaccttctctctcttttgggtgcttttcacatcaaaatacgatcactggtttgagtgtctatctcccctattagactgtgagctccttaagggcagggattacatcacatcaaattcattattatagtcctggtgtttagcatagggtctggtcctgtatatatgctcaaatgtctattgaatgaatgagtttgaacatcaagtactccttgaagtcaaactcagcatctcttgaaaggtgaaaattagaatggtatgtgaccagagtaatcctagtgaagtatgtttgaggacctgactgaagaaaagctgataggaggacaccttatgggggcttattgtggggcagtttctatcccaggaaactcttattagcagttgttgctggctaaaaatgaagagcagctggagcagatgacaagggcccttactggggatttctccatccttatctttcatagttcaccactaaagcaatgttgttctctgaagtaacattttccatagtgtctcaattctcctgaatgattgccatattcatttgtgctctgcctaccgaggcatttggaccagctttgttaaagtgtggtcactgaaagctctttgattcttctactcacctatcgttattatgctaaagaacaacattttgtgagtaagagaccactgaaaaacagagcaccagaaaggggagggaagcagagctaataaaaattatcttttttctcctcctagattgccaatgtatttcaccatgtttccatcctacagtgttttatactatgtatcagtaaaggcaaaaaaaggaaaattaagacttcagcaaaactttacactttgtaggcaagaaaaaaaggaagcaacactgagggatagaacataaatctttagacatatgatcagtagccatttctgaaaagtacacatttgggctgttttaaacaaatagcaaaaagcaattaggtctttctgactaaactgaggtgtatgctgatttctttttttaaactaagtctgttttgatcttcaaaaatgtcagactggtaaacactttacttttttgcacatataaatctaagagccaagcctagcttgaggaagatttaagagacataaaatttgtctgaggtgtctgccaaatctctacagcagagacagaaaccctggaaaagctgacacaatcataactctcacatcaccagcaggcttgtgcagggctgggaagcacagaaagtcactgttccttctctcatactgtttgtaaacagagaagcagatcatttgcttatcagctatctggtagctcatttttgcctagctatcccactgagaaaaaaaaaacaaaaaaacacacatccccacgggtacatatcccagttttcagctgggtgaattttcatttataagatgggcccgcttgttaaaattttctcttttatttgctcttgaattctcttactcttgtgtgcttgcttgctctctctctcccttgttctttctctttttatacagaaggcattaaaaggggtatttatgagtatctagtgcagtgcctaacggagtgctttcacatagtaagcctacaataattcatcgaatgaagtgaaaccctatctgtaatttctacattcaaattatttgatcatgtagcaggaaaactatagattttttttcctggagtatttaaaagtaacaattccttataaagaaatattttactcagatgactcatgcttaggacttccatcccttagaaatcatccatttttgcacaatgggtattatctgtaaggaaaatgaagggaagactacacttcaggatcctgaatgaccactgatacgttattgtagagaaaatcagatatcctatatacactcgactgtatgtcgtatggtaatccactacatatgtctaaaatcacttaacaatgcaagaatatagtgcacacatgggctgcgttctgtaagtaggattaactattgaattcaaccaaggtcttccctggggacagattgctggaaaatacatctacatgacatttaaaaaaataaattaaccaatgacatcggctcccatgagacacattgtttcttgtacattcaattctatcacggttttctgtagctctctgttgacatacccatcccaaatgacacagaatttcaaaaaataaagaaaaacagagcaactggagctattccatctctcctgtgtgaagtgttatgtacacaaaggaaagatttccgtacatgagcacaatgtgaaccacgacagggtgagatcatgtcagttggctgttcttgttatgctgtggtcacatataacttgcccaagggagtgtacaaagcctgttttcttcctgacaaggaccagcagggattgctggaaaataaagaaaacagagttatggcaggaggttttaaattttctctttaaaaaatgccctttattatgataacttttcttctcgctttgatgtatttagttttcctcatctgtaaaataggaataactattttatgtgtttaatatttttgctctgagaattaaataccagtagattgcctggcataaaatagctaatccatacagtccacatcaacattggctaacattaattaaatacctattatgtgcctgccactggccaaagaccccccaaaaaagtaaatcacagaaggaaaacctaatactagaggagcaagcagggagctgattttcaaagcttttatcaggcagtctaagaagtctggatattactctgaagacaatggacagcctttgaactattttatatagagaccagatggttttagatttgtgatttacaaaaatcattctgtcagcattggtaaagagtagactagaagggaagcaggctggaagcagcagtaatccaggctagaagtgatgcatgtgtgttggggggtggaaggtatgccccaaagtaagacaatggtggacaccgggaaaacattttaaaataactttttttttttttgagacagagtctcactctgtctcccaggctggagtgtagtggtgcaatcttggctcactgcaacctccgcctcctgggttgaagcaattctcctgcctcagcctcccgagtagctgggattacaggcgcatgccatcacgcccggctaatttttgtatttttagtagagacggggtttccccatggtggccagcctggtctcaaactcctgacctcaggtgatccgcctgccttggcctcccaaagtgctgggattacaggtgttaagccactgtgcctggtcaaaataactttttaaaaattaacaaatatactgtagattagaaaataaaaatacgcaaaaggttaaaagtagaagtcatatgcaatcttactacttgcagcaaacccctattaatatttttttgtgtgtttaccattacaggatttttcctatgtatgcctacacagatgtgtgtgtgcgtgtgcgtgtgtgtgtgcgtgtgtgtgtgtgtattatgtatatgtttttaaactgggatctgtcactctgtactgagagttctatgatgtgaattttctcttaatatatcaaaaacaattttccacatcattaaatattgtttggtaaaatcaacttacaaggctacttagtaatccattctataaatgtaccacaattgatttcattcaaatccctagtattgtacatttaagatgttcttttttttcttttttttttttttgttgtttttgctattagtataaacaactctgggatagatgtcctgagtattaaatttttggaaacatcatgattgtttcctcagcatagagctctagaagttgaagtggtaggttaaaagctgtattctattaaggtttctgatacatattgacgaattgctctccagaagagctgtatcaaattatagtcccagcagcagagtctatgagtaggagatgaacttgagagtgatgtcaaggacggagtgtactggacttgggtgggtagaaggaaggatgtttcctggcaaagtatcagggcaggaggaagatgaactctgtcaagagcagcaaagtaatgggcagggctaaggaataggtgcctggataggtaaatgataggaaagaaaaaggtaagataaccaggggagagtgaagaaaagagggaaaaagtaggtctttcatgaaattatgggcactttaatttactcctttcttcagcaaaagtagcaaatgtagcaaacagctagtcttttcatagcatttggcactctgtgctaccaaggtccccagttatattcatgcaaatctgtttatcaattcttttcacccaataaccatttattaggtgactaccatgtgtcaagtgctcttctggatgctatgggtatggagatgaatgaaacctggtccctgccctcaaggagttcacagtctagtggggaacacagagacatccacagaccgacaccctacagtgtggtacaggctaggacggaggtaactaagtgcagggtcctgtggaagcccgaggcctaacattgccttgtgcgtgcattcatgtatgttgggcaagggctgtcgggaaggcttcacagaggtgttgacatatgagctgagtcttaaaggctgaggaatttcttgcatgcctaagggtcacagatcatggtcatattcctaatcagtgccttgaatatttgtgctactgctctcaaggacactgagtaaggtgggaaggatgtttgtgtgtaatccaaatccactcgagtggtaactatagcttccattgtaatcttaatgaacatagaaacatagcatgttttggcaatattattgctcaccatacaatataaaggacaagaggcaaggggggcatgcagacttttaaaacaattctggtaacactgacaaaataatattaacatccaccaagtcctaataattttacctcctaaatgtttctcaaatctcttcgctccgctcacgtcactactcttgggtctttattgtctctctgtggaacagagtagcagcctcatcatatccacctccactgtatccttcccactgtcattttccttacagtaaaaatctgatcgtggtgctcttctaaaacatgttaatggtttcttatggcctacaagcagcacttcccaaatttcagtctgagtattacttagtgatttttaccatattcacacacaatgtgtactattactacttaatatttgtctttaaatgaactgaaaactggttcactttctatttttatgaagtaaaatccaaagtaatcttagatgtgatggcttagttcagttttatgttttttaagacatatttgaacatgtaactagtaaaattaaaatgtttgtgggagcacagtgtaactaccactggcagatgccctacgttttgagaaccactgacctatgggggcacattccaacttaggattgcaatcaaggttctttgcaaatcagccccaacctctttccagactcttctcctacccattacagtttccttttactcaactatctgcactccaaccatgctgaattcttccacattgaatgaacatgccctactcttatacagccacacatctttcacagactgactcctctatctgaaatgcctcccctccactccttccctgcctggggcaaactcactatccttcaagacctatctcatgtcacctcctcatggaagccttctccccgagtctcccttacagtgagtcacaccttcctttatccctccatagcattttgtacctgtctctgttatactacacactacagtatctcagaactgtgggcatccagctccccagctagaccccaggaagagttcacaccttgtacttcattgtttctccaacacttcacgtgggcagaggtcatgaaagagatctagtgtcccaggtaacttcttaaaatgctaaaataaaatacatccaaagtgctatcaaggtccaaatagcttagaggtatgatatgtgttataaagagaatcatctaattcagaaatagccgtactgactatggttttggcagacacaattagctacagttgcaatgacagttaatttggttttggcagctactttacagcaaatacattctgacatagaaattttaagtgaatcatttgggttttggccaggatgatgaactatacctatctctccttaccacaactggaaagtcaagaacaagaaagaacattgggagcagcaaaccatgttgaacagagcatgggctttggagtcagaaatctgtacacccaaacctcaactcaacttataatctatgtgactttaagtagattgtttaacttctgtgcattttagtgttttcttctagaaaaagaaacaggaataatagtacctacttcataacactcaagataatgcaacaaagtatttatgatgatgactaggacattatgtgggttcaataaatagcagtcattattgtcacccaatgagatgactacagttcagataatgtgatgcacggggacagcaaatgcatttcttaagaaaatatatcgatgtctctaggctttaaagttgacagctatagactgtagctaagaatagctacaaacaaaacatctgcaagacaagcttcttcttggatttaaactcacacctggaacataccatcacacttctttgtgttctccaagaattgatctcaaatcaggttccctaggatgaaaagaaaaatcatccaatcttaatttttgccttcaattttatttgatacagaataatatccaaactatgtgtatgtttcaaagtatcatgttattatgaccccaagcttctccaccctatttatttcccagtatatttgtgctgatatcttttattccaatcaggcaagcccacctgtctcacagtgctccctcttctgtttacccttctcaaagtccaatctcagtagcaggaagcattttctccctcctctttgacaacttcaaatcccctgtactctgctggagcccagattaaaattcacctccttcacaaagcctgaaagccggatgagggcttcagcacttcccgggttaggcttgaacttccatagatgaactcaccacccccatcagtatgctcttccactgacccctcttagcgttttttgcacacgtttgtaataatacaatgattaatatggtctgtttcacacggtctactttattctgtagaataaaggtgtgccccctaaatgtttgtcaacattagtgctatcagtctttgctggaaacccctaaagcgctggatttttataaccagtctaacttgccttttactctcaccagaaccctgcactgaaccttaaacacacatttctcaaaagcaagattccttccctcttttgcttcccatcccttctagaaattgaggggaaactctccccacttcaaagacctggtgggggaagtggcaggtggctgaggggccagtaaagagatggcgatcaattaaggaggcaaaaagagaaagtttgaaaaaaaaaagtcacgccctgagcgtggcaaggaattcccatgccccaaagaaaatggggagtgtagcgcagggagggttatgtgcccaaacctgaaatacaaattgagggaaaagaggaaagagatcacccaattcctgcggtaagaattagagtccagtcaccgcctaggcaaaaccctggacgcaaaccccaacttcggacctctgaggaggcacagagccagggggaggggggcggcgtcgtgggaaaaaaaaaaaggggcgggcgagttggaccaaaaaaaaaaaaaaaaaagagcaaagacagcgcgctcccgggctcaagagaactggcgcctagagctcaaaagcccacccccgactcccagtcccgataccccctcccctgcagaggtggagctgggtggagttaggcgctgaggaccgcggccccggaagcaccctcctccctaggccccctcagtcccacagtccccagccacggccaccggggctttctgcctctctgacctccagctccccggctaccgaagcgctagtccttatacagccgcggaaaatcgggccggcgcggcagttcctgggctcgtagtgccctcgcggcgccccacgccgcgccactctcttccgaaatgcccgcctcgcgcttccaggcctagacccggcactctggcccaaggctggactctcacacacagggtgcccactgcggcgtctcctattggctactggtcaccggggaagccggaggcccgagcccatggcttcatgggaaatgtagtttgaggtcgctggaggctgttcttcctgggggtaactcgtgttgacattggcagacagacacaagtgaggaccgagaattatgggagatggagttgcgggacacttatttctctatacgcacaattcttcccctccccttccgattgtccccagcgttcagacggggaagggtattctgggtattgtagtttgggtgcactgtctagagaatctctcttggggttatgggtttgtgcttgtggggacagacgaaggctctagatttattttcatgtcggttaagctcttagcattttgcgggaagcactttctatcgtgatttgaaattgttattgagttttaagtgtttttcaaaagatgatgtttattctttggtaagcttagaattttaattgagagttatagtcctttaaaattgttaaagtgtgttccttgtgaaccacctgcattaaaatcacttgaaaggtatggaagaatgtatatatttttttctaattggaaattatagttccccctggaaacagtgtcataaataggcatagaaatgtgatctacaccagcccagaagaagcctatttaatccataatgaagctatgttgttgccatgaaaaacagtggccacataaactgctataaataacaatttagaacagatagacaatacaacttaagtacaaacgagtaactatatgtgtctttaagaaacttaaccttttgagtaaaaatatgttacaagagctggataaagacataggtggggaatgccaagcacttccaagtgacttaaaggttgaggaaaatggttgtttattagggctaatttcactcccaacttttgacctttttttttctctgttagagatgaatccttgtagccttgttacagttgaattactacaacttcttgatgaggacaacttttcgactcacgagtaaaatgaagggaaagacaggggaattgcattttgctgaggtaattgcccaatattttaaaaagataagtgaaggaggaagacgatttaataaattcaaccatttattcagcatagtgctttgtgcaaagctctgggctaggcactgttgccacagaattggaaaaatagtccctaccctcaagtagctcaaaatccaggtgaggggagttgtagtagaggagaatctggggggaggaatagatgagtatacaatgtgcaaaatgctgtaaagaagtctacatagggttctataggaacatagaggaggaagaacttgttctacttctggagaactggttgaagaaccagtaaaatatttgtcagatttggggcagggaggtcaaccatattctatacaaagcatatgcaaaggcataaaggcatgaaagagtgcagagaacaatagcaaaagttccatattgcagagactagatcaggcagcaacaaggggtcatatcaattagttcataatttaacttgaaagtgggagagaaccatcagaggaatttttgtgcttatatagtgtttattttttaaagcatatacacatagaacatactgggaacacatagctagggtattatggggaatcattctggagggtggtaattgaattgctatattatgttttaatactttttatacttttaaattcctccaggaaaataatttgcttttttaaaaaaagaaaaatcggctgggtgccggggctcatgcctgtaaccctagcactttgggacaccaagttgggaggattgcttgagcccaggagttcgagaccagcttgggcaacataatgagaccttgtctctacaaaaaatcaagaaaattagccaggcatagtggcgcatgcctgtagtcccagctactcaggaagctgaagcaggaggatcccttgagcttggaaagttagggctgcagtcagccgatattgtaccactacactcgagtgtagtgggtgatagagcaagactctgtctcaaaaaaaattaaaaaattaaaaaaagaaagaaaaaagagaaaaagaaaaatcacctcatttcagccataaaaaggagtgaaacaaggcattttcagtattatggccaccagaaaaacattgtgtgaatcaaatgcagaatttcttttctcagctttgtctcctttctttttatctttttttccatgactctttactttgatttgatcattgatttcaaagtatttgcagagcacctactatgttccatacactatgacaggttttgggttttaatggtgagttaaaacatgggttcctgttcatcaaagtatttctagcaggaaatggaataatcagatggagttggtagatgtggaaagtgagagacggggaggagtccattacgactcccaagttctgacttggaagactaagtgtatggtagtaccattcactgagatattgaacctagaaagaatagcaagttttgtgaagaataggaggaaatcagttttgaacatttaaaatttgaagagtctgtggaacttttggttggagatgcctgataggctgctgagaaatgccggtcggaagcttgggagagaggtcttgcttggaactaaacatttgggagacattagtataatatagagggcaattaaataagtgaaaaattgtttaaactttacttagagagtatttttttttttgagacggtttcttaccctgttgcctaggctggagtgcagtggcacaatctcggctcactgcaacctctgcctcctgggttcaagtgattctcctgcctcagcctcccgagtagctgggattacaggtgcctgccaccacagctggctatttttttttttatttttagtagagatggggcttcactgtgttgcccaggctggtctcgaactcctgacgtcaagtgatccacccgcctcagcctcccaaagtgctgggattacaggcgtgagccactgtgcccagccaatttagagagtatttagaataatagtttttaaaaagacaaagattatggaatcctggaaaataatgatattcaagtagcaagtagaagaagagatgccttccaaggaagctgagagggaatgcccaaacagatgaaccaagagaaaacaaagtagaattactggcatatattacagagaggtcaagtagcaggacagaatagtaagaagaaattactccttcatcaatataacaagtttttattgagtacctataatgtgccagacattattctagatgctgggaatagagaagtggaaaacacatacaacatcccttccctttggaggctatattctgttaggaagaagccatcaacaaacaagataaataattaaaatacatagctgtgataagtaatatttcttactgtgtatgtcacagctgtgtatggctatttctgtatggtgatataaatacacacacacacacatatatatatctccaataagccatatggaaattttatatataatatataaaacatatctatatctccaataagccatacagaaattttatatataatatatattatatataagcacaaatgtatacatatatttgtatgtgtatatacaaacgtgatactctttggtctgttgttatataataagatgaatttgtgaaatactggcccagggtcaaacagtctggctggattcagagaacaattaggaagtcaaggttagagctgtatccagagccagtgtagagcccaggtcaaggccagggttcatgtgtataatgtggaatgtatttagcttcaatcttttctcaggttaagatttagtaagtctgtagctgtttttacaggccattgtggattcaggatcagaagaccatcaaaccaagcttagggttaagcctgatagcaatattaggccccagatttagagccatggttcagtctgtgtcacagattaaagtgcatttctgaccactctggactaacagcagcctcagggtgttaaagctcactctgaggctgctgtaagtctagagtggcctggtttatgaagtcaaggtgcaagatttgggttcaaattttggccagaattaggatttagtctgtgtgtaggaagaggcctcattctaaaattagagttagggctcagtctgtggaccagacttagaccacacccaaggttagggctcagctcaatgtttgactttagtttttgatcaatgttggaatcactttcatttctagacttgaaagtcaataaaggccaggaccatggctctgcctgggattagtcttcatgctgatgatgttgcctaggaaaaaatgaagtaagaatatgaacaggatttatgttcagtctttcttcaggttaagtttcaattcgtattcatggttagagtttattctgggtccaataattaagtctcagtccgtggccaatggtaaggcacagtcaatgtctaatattcagtctgttgccatgttaggacattacctgtcatgtgccctagagccttgtctcaaaccagagttagcatttcatatatggacaaaattatgatacagtttgtggccaggatttcaatgatgaatatgaacaggatttgggatgcatatttggctagagtaagttcaaggtgtggtttctgactttagccagtgtcaggattctgtctttgtccatagctcatatcaacaatgttctatggagctaactcacagtggcctgtgttggccctcattctgtggccagagcagggctcagtcggtgacctgtattagccatttcaatttgaccactatcagagttgagtctggagggagtaattccactatgactttatgtagcatttgtgttcactgagtattggtggtagtgctatctgattaaacttgtaccagagtttgggagttaccaataaccaaggtaaggcttactatgaagaaggttttaaggctaagagtgtaaacaggttttttggattagctgttgatgttatttgtcagtcagtggatagagttgagatgagaacaaacaacacataaaatccagattgaaagctttagaggctcaggctgtaatcagggttttgggatcaggatgttgccagggtttgagttcagagtgttcattgcctgttgtcagtctggcacttagactctggcttagtgtagcaggcatttcggtatcagtagtagagttcagtctttgctaattgttagtgaccataatgtgcccagtgccatgggtacatctattcacaattgaggactaagtttgtgaccagactgattgctcaacctccagctagtgctaggactcagtttgtggccactaatacagtgaactttgtttatgggtttaagacttgatatgtgacaaaggtgagtacttagtctcagcctgttgttagatctgataatatgagcaggattttgatttagtcttgtagggtcaggaatcatttctctaaccaggcttagggcttggcctttaggtctcagactgtggtgggacttacagtcttcatcccagctcagtattcagaatgtggccaggaagagggctcagatcttagccatggtgagttccgtctgtgctcagggttagaattaaatctgttgcagggttttaggccaagaaaatgaaaagtatttgttttgtctttgtctagtttgtccttcattcatcttcaaggtttgggttcagtctctgcccagtgctggtgagcagcttaatttctggtattaggaatcagtcggtagccagggttaaagttaaagttgtggttgaaattgggatccagtctcgggtgaacatttagccagagatagggttcagtctatctcaaaaattcaggatcagtcattagccatttggagaaatcagatttattttcaggttgaaagctcatgtcagaggttaggcttatgggctcagtctgtgatgagagttaggaattcagtctatggctagagttagagatgcagtctgtaaccagttagaagctgtaaggtttaggggtcaaatcagtggccagtgatagggctcagtctgtcccaggatcagtagattatttcctgatcagatttatgaacccagtctctgtccaggtttagaacttgggctttgaacatggttaagactcagtttgtggccatgttcagggttctgtctatagtcaggattaggacatatgctgtggtcaaaatattctcaagttttgtggaagatttggtttcacttcttggccatgattaaggcacagagttgggacaagtttagagtctggtctctgtacatgttttcgtctctgtatgaggccaagtttagtagtcattctgttgccaatgttggggtcattttctggttagtgctaagtctgggaaattgtagctgggttggtttccaagatcagatctcaggctgtgaccaagttagagcctcagtctgtagtcagggctagagctcagttagtatctatgctgagcactcattttgtggtcagttcaggatgttaagtatatcccagagttaggtcatgcagtctgtagcctagtttagagactcagcctggggacagacttaggggctatatctgatgttatttttgatccctgtatcgtgaattaaggacttatacagtagccatagttatggttcaataggggatcagggttagagattcaggttgggaccagtcttaagtacttactcttgggccagatgtagacagtcagtatgtaactaggcctagggacttgatttaatcaggattaagaccttggagtgtggccagaaagtggctcagtttgtggatagaattagggtcttcatttgtggccagggttaaaggcttggtgtgaaattggagttaagcctccaagttcagagttaggagtttaggctatgtcttgggttaggtgtttggctggtggtcagggttaaacacaggatctgcattcagtgttggcagcttgctctgtgaccaagcttaagagactgtttgctcagcctgtggtgatagtgattggtaattatacatcaataaagttgtcataaaaggttaaaaaagtggattcatacaagtgaaatggtaggaatgatgcagggaagaaaccataaagagaggccgtttactgaatcaggaccagcaatgtccttggtgtctcagaatttttgcttaagaaggacagggcaagcacatgagattgagaagaaaggaaagaactggtgaccagggagctggtaaccctgggaagtagatatgtgcttcttgaaggacagacatttttataaattgtggaattaatgcaagttggaaaaccttgcaaaaaatggaaagtcccatttggttttttgtttgtttgttttgttttgtttgttttttggggatttttttgagacggagtttcgttcttgttgcccaggctggtgtgcaatggcgcggtcttggctcactgcaacgtctgcctcctgagttcaagtgattctcctgcctcagcctcccaagtaactgggattacaggcacccacccccacgcccagctaatttttttgtattttcagcagagacgggcttcaccatgttggccaggctggtctcaaacttctgacctcaggtgttccacccgccttggcctcccaaagtgttgggattacaggcatgaaccaccacacccggccagaaagtcccatttgttaagctcttacatcatgttctttttgccagtattggttttcctgagcaccctttctaaaccattcctcatcttgccccaggctacactgatctccattatatctcactcactatatgttcaataaatatctatggaatgcatgtttgtttttacttacattctcccatggaggctcatgacagtccaatatgataagtgttgttatcctcattatacagattttaaaaagctgttaagctaattaagagattcaaaagagccacacagctagtaaatgcagagccaggtttcaaatccagttttatctgaccccagtctactgtgctttttgcatatgccacctggcccatataacatatgtgagatttacatctcaccttgaccccttgactttgtcaactttgtcttaattcttacagcaactctaatttttcatctggaaaattgggatgagaataatattaatacccatttcttttctttttcttttctttttttttttcagagatagcgtctcactctgtcgcccaggctggaatgcagtggcgcagtcttggctcactgcaacctccgcctcctgggttctagcaattctcctgcctcagcctctcaagtagctggaactacaggtgcatgccaccatgcctggctaatttttttttttattgtagtagagacagggtttcaccacattgcccagtctggtctcgaactcctgagctcaggcgatcctcctgcctcggcctcccaaagtgctaggattataggtgtgagccactgcgcccggccaatagtacccatttcataagattgttatgacaattaaatgagccaatacattgaaagaacttggattcatcaggttcatattatgatgatgccctttttggagttgaaaaaacatgttcagagagtttattttctcaatatcacacagctagtaggtagcagagtgaagagtagaatccagatgggtccaactctcagttgaaggcttttgctggtttctcaggctgcttctgaatacctcagcctccaggaatggcttttgatggacattttgggcttcggtgcagagtgacacagggaaggatttagtgggaagaatatgttagttttccactgtgtcattccctacagtgatttgaacctgtgaggaactgagagagtgtacagaagggggcatatcatcatctctgtgagggtacatgtagcttctagggcaccctctccatgagaatcactgagtgtaaaatgtaagttcgtgatagtgtgttgtgtgtgtgaagagtatgggggcagcaaaaaggtggatgaccactgaggtaggcctccatgcttttctctatgcccaaatatcagccttgccaacagtatttccaagggactgtacagccaactttccattatttctaccgtctgctcttggcttggcttggcttatctacattgtatctggcatctacgtctttccccagggagtctatatgctgtggacaagagggattgattatgttcctgccttcagtatggctaaacaagctcctgctgggcctgtgggacactattaagcagaccaacgttgtcataaatggaaactccagcaggataagagagagagaaaggggcacaaagaatatctgaatgaccaaaaatatcccaaacctgatggaatatgtgaatctacatatctgagaactcaacaaaatccaaatagacaaactcaaagagacctattttctgatgctatggttgacgcacattctttggctatagtatagcacctattctctagttaaaatcttgtgcataatctcagtacatggaaagagcaaatcagagtgctctattccagtcctttacttcctgatgcgactcatggtcaaaacttgaccctggtatatgcaaagctcaaatcccaagatcatgttttctgcatctatagtagatacaactttgctttacgtgatccataaccttccactcaaagtgataggcacttttgggacttcgggctggaagacgggtataatctctggctggagaaaagtgaagactgggccaccaattcacaaccaaggaggcttcatcaggatctcattagtgggtctcaactatttttctttgctttcattcttgagctaccagaccatgggccatgacccattatctataaatccaataatctcaaaaaccgaaagttttcataagtttaccaccaaaactcattaggtagcaaaatgtgacctgaatcaacataaggctacttacagtcttcaacctatttctatgaatattcattttgatatagaaatactaatgtgtttgtaacacctaccaggggtattatagaccatgtatatataccatattacctttctaaaatctctcaaataatgaatttcagaaaacatcggcccctaagtgttttgtatgaggaattttggatatgtatttcctctccttgctgtctcattctaatgtcacgttcctcactttatcccatacctggcaacatctgccaaggccagggaatgggaacactgaatgcttttgcagtaaaacttcatatcataaaataaataatgatgagttgaattagtatgacagaggaggaagtgctaagaaaaatatcttcatgtttttcctccatcgtaggttcagatccaaaaacatattctcccataccatattgacaaactctccaaggttctccacctaaagacccatttgtaatccagctgaaaacagacaggggttggatgctaacctcaaaacctgattactgctgctgctgctactactactactactactactactactactactattacttgtactactatactaacattgagtacaacttgccaacttcttgttctagagcttagaatccaagctctttcaatatattggctcgtgtaatcgtcataacaatcttatgaaatggatactattataattaccatcgaaattttacaaatgaaaaaaacggaagcaagagagatgaagtcatgtattcaaatccatacagctaagaattagccaggcaaggattttgatgtacctcgtacttcctttgcatcttcactttattttgaaattgacttatggcataacctaatggacttatagacagggggagaagtatgatgggctatgggtctggggagccaatcacccatcctcacctgccaggatccaatgaggctaaggtgttttcatacacatttttttctatggagtctggaatgtggaattcattatgcaaatttcttgatgtgatgatttggctggaaaagcaggtactatggaaaagttcccccacttatctctaaggactactctgatgtaaaatattatgtgttgatgagtatgttttttatttgcatgcatgggcatacatttacatgcatgattctgtgtcagtcagcatgtatgtgttaagtatagtacattggttctcaagctttagtctaatctcagatacctgggtaaaatcacaaatactcctgggtcctatgctcagagattctgattcagttcagttggggtgggacacaacagcttgttacttgcacctgaagtgattctaatacaggtggtctgtgcagactacattttaagaacaatgggatcatgctttagagtaggctctggagccaggctgctagtgagtggtttaattttaggtttaagcaagtcaactgggctctgttaatatcagtttactcatttttgaaaatgaataataatatacctacttcatgaggttgctgtgaggattaaatgacatacacttatttaaagggtatctcatttgatgtgcctaacccatcataagtgatcagtgaatagtagctacactattcacatagaccacaaggataatggcaaacataatggtgctccccattcctacccccgtcccagaattatgcagtgcagatgccctgagggcatgctagggaatagtgaagtggtgtgaagaggccaactcctgaggggctgcaaggaccaggaattttggttgtaacccacagcctcactccttgaaaaggatttaaagaacatagaaagcaaaatggtgaaagggtttgcagatggtaggtttgggagtgctcagcccacttcaggtctttagggcaactggtcctgcaccactgtgttcacaatctggcccccagctggcatttaggactggaagaacaatggaccctgtattcagggaaaacttgaggcggagtgctgctcattggtcttctaccattaagatgctatataaagagaaatactaatcaagtagaaatcatggtgcctgacctcaaggagcctagagtctttggaagaaacaaacatgccagcattgttactttaagcaattcccatccactctctgggttgaagctttgtctgtaaaatgatggtttgtacttaaaactttgaacatgttacatttctcatccttctagaaataaacaagcattaagtcacagaaaggagtgcatgatgatgacacagtgtggtagagtgaggcaatatcactccagccagcttgcaaagctgctgtagagtgcaatggctagagctactgccaggaaggaagaggggtaatgggattgggtcaaaggccttagctctcttgttggtgccaaaaattgctcactttgatacctaccttgagccagatatacaacagatatgccacatgttggctcttgctgatactcctctagcccccttgctgctcactgattttagctgaaagtggggattaattgacaaggacatcttggaggaggatgtcacagatcctgtagtgtgccagaatgaattcaggattaagtaggaaactggagactgaagtgactgagagccaggacagggttagcctcctaaaacaccctgtctggagggcttcactgtggctaagggctgctaatatgagaagtgtatactacagctataaaattaaagatagcacttactacatgctaggtgctgttccaagcgctttacaaggaataactcttttttgccttattataaccttattatgatagcaattattattattttcttttaaagttgtggaaactgaagcgtattaagcactctccagccaccaatttttctcagaggtttttgttttgtttgtttgtttgtttgagacagagtctcactctgttgcccaggctggtgtgcagtggcgcgatctcagctcactgtaacctctgcctccagggttcaagcaattctcctgcctcaccctctcgcgtagctgggattacaggcgcctgccacgagatgcctatttttagtagagacgaggtttcaccacgttggccaggctggtctcgaactcctgacctcaggtgatccacctgtcttggcctcccaaaatgctgggattacagacgtgagccactgcacctggccagagttttttttttttttttcttgtcttcattctttccctgtaccctgaaactcaccttgatctgccttgcctgggaataacattttattccaataatgttctatatataatgttctatataattctggagtcaaggtaccttggaaatctagccaaccatagctaactaatctttctttctgcccctatcagcctcatagacatgtcctcagtgggacatcttccaggaagtaccaaggagtggctttggggaaatagggagagatggttagaagagcaactcttcccgagcaaaaagaattaagaggacttatacagccttttgaaagtgtggcaatgggatactttgtcttagagaagagcttcctggcccaagtgctggaaaggaaggatgagggaaggtggaaacacacggatgaaagtatgggcagggctgtaaccttagtcaatgggctaggatggcccatgcacggtggtttggggtagaccttaaataaaaaataaaaactcttctcccataacaaagtcttgtttggttgtccaggaagccccccacagaattcaaacgcctctgggaagtttggtgcagagcttatgggcttttcgcattctctggtgccacctggtggacaacaagaggtaatgagatgggatctaggaaattgggcagttcagtttggaagggaggagaggggaagtgaagctggaccagatgattagtgctgtagtgggcaggcactgaggggacccagtgcacccacaggaaaattgggttcctggtgaggctgatggagtcaaagagtgtagaccgttagagataatatatgtaaagaccctgatctacaggccaactgtaacagcatcaaaaggtagtgtttactacttaccacatgccagactgtgttattaactttttcatgaattttttaaaatttaattcttccagccacactttgtagcatccccattttgcagataagttaaagtgaggctcagcgttagtggcagagacaatgttcaaggttttaatcattatgccataaattgtagttgttgccaatattgtgatatgatgtgaaattagagatatgaaggaggatccttaagtacttcaaatctgagtcaagtaggctttgatgccagtgggagaaaagggaaggagaagtgtcatatacaccaccatctctaccttatccaccttcaaatatggggaaacaaaacaaaagcaatctagaattcacctacccactgtctcagccagtaagcacattttaggcacctattctatccagagctttgtgggacaaaatggcatttgcccccaggagtcctgatatgccagcattactcgtttctccccacccctatctccaggtcttctaaagtcctcaggtggggagcatgttggtgagtctttcagaaaacactgtcccatagggaataaaagacaaaaaataaattccatctatatgttgattgaggaattaggaaatgtcttggtttaaaaaaaataggagaagcaaaagaaatcagaaaacattgagcacctgctatatgttagctaggccctatgctgagtgcttgacaacagaattttatctaatccttccaacttctgtgaggcaggtctctaaatattgccgtttgaaagtgaggataactgaggatcagggaggttaggcaacctctctatagtcacacagctaatcagtaggggaactctgtatggccgcaaaacctatgctgttttagaatgaagggaggagggtatttatttttcctttttattgtggaaaagttcaatcaaatgaaaaatagaagtaatagtataatgaagtcccttttacccattacctagtttcaattacagttagcacatactcaatcttatttcatctgttctcccattcaccccctcccacaaaactggattattataagtaaattccacacatcattttattttatccacaacattttcaggctgcatctctaaaagatatggacttttaacaaaacatgactaaaatactgttatcacagctgtaaaattaatactaattctttcatatgatcaaatatatattttgtgtttaaattcctcctatcatctcatgtcttttctcattatattagtccattttcacactgctgataaagacatacccaagactgggaaatttacaaaagaaaaaggtttaattggacttacatttccacgtggctggggaagcctcacaatcatggaggaaggcaagaaggagcaagtcatgtctcatatggatagcaacaggcaaagagagagagagcttgtacaggggaactcctctttttaaaaccatcagatctcatgagacttactatcacgagaacagcacaggaaagacttgctcccatgattcaattacctcccagtgggtccttcccacaacatatggaaattcaagatgagatttgggtggggacagagccaaaccatgtcattccaccccttgccccttccaaatctcacatcctcacattttaaaatcaatcatgccttcccaacagtcccccaaagtcttaactcatttcagcattaactcaaaagtccacagtccaaagtctcatctgagacaaggcaagtcccttctgccatgagcctgtaaaatcaaaagcaggttagttacttcctagatacagtgggggtacagacattaggtaaatacaaccattccaaatgggagaaattggccaaaacaaaggggctacaggtgccatgcaagtccaaaatccaacagggcagtcaaatcttaaagctccaaaatgatctcctttgactccatgtctcacgtccagttcacgctgatgcaagaggtgggttcccatggtcttgggcaactctgcctctgtggctttgcagggtacagcctccctcccggctgctttgatggactggcattgagtgtctgcagcttttccaggctcacggtgcaagctgtcagtggatctaccattcccgggtctggaggatgatggccctcttcttacagctccactagacagtgccccagtagggactctgtgtgcagactccaacgccacatttcccttctgcactgctctagcagaggttctccatgagagccctgcccctgcaacaaatttctgcctggacatccaagcatttccatacatcttctgaaatctaggtggaggttcccaaacctctgttcttgacttctgtgcactggcaggctcaacacccatggaagctgccaaggttgaagcttgcaccctctaaagccacggcctgagctctacattggcccctttcagccatggctggagtggctgggatgcaaggcaccaagtccctaggctgcacacagtacagaaccctgggcctggcccacaaaaccactttttcctcctcagcttcaggcctgtgatgggaggggctgccatgaagacctctgtcatgccctggaggcattttcccccttgtcttggggatttgcattagttatgcaaatttatgcagctggcttgaatttctcagaaaatgggattttcttttctatctcattgtcaggctgcaaattttccaaacttttatgctctacttcccttataaaactgaatgtttttaacagcatccaagtcacatcttgaatgctttgctgcttggaaatttatttcactagataccctgaatcatctctctcaagttcaaagttgcacaaatctctagggcaggggcaaaatgctgccagtctctttgctaaaatgtagcaagaattacctttgcttcagttccaaacaagttcctcatctccatctgagaccacctgagcctggaccttattgttcatatcactatcagcatttttgtcaaagccattcaacaagcctctaggaggttccaaactttatcacattttcatgtcttcttctgagccctccaaactgttccagcttctgcctattacccagtttcaaagttgcttccacatttttgggtatcttttcagtagcaccccactctactggtacaatttactgtattagtcctttttcatgctgccaataaagacatacccgaggctgggcattttacaaaagaaagaggattaattggacttacagttccatgtggctggggaagcctcacaatcatggaggaaggcaaggaggagaaagtcacgtcttacatggatggcagcaggcaaagagagagagctttggcaggagaactcctctttttaaaaccatcagatcttgtgagacttattcagcatcatgagaacagcatgggaaagacttgcccccatgattcaattacctttcactgggtccctcccacaacacatggaaattcaagatgagatttgggtggaaacacagccaaaccatatcactcatatttctgattctttcttgttattgagatgtaacatatatggtaaaatgtaccaatctcatgtacaccttgacaaatttttatcggatgtatgtctgtataactaaagtatattccaaagtggctgcaccaaatttattctcttgccagcaatgtatcaaaagttaagttacttcacatccacagcaacagtatggtcagtactttaaattttagccattctgattggtgggggagaagggtaggttagctgtacctctttgtagccttatatttatccagtgaataatgatgggtgcatcatttggatgtccattttgtatgcctgttattttaaaactttgtcaatctattcttactgatatataaaagtttattatatatgttctgaatatgtatcagcatatatacagatcttcttccagtctgtgtctggcccttttcctctttatttttatcttgtcttttgattaaaagatattcttagctttaatgaagctcaatttatcgctttttttggctatttttttctgtccatttaagaaagttttgcttccctgaatataatgaaaatattcttctacttttcttctagaattaattaatgtttgtgtatgatgtgagttagaggtcaaggttaattattccttatgagtattcactttacccagaattatcttttcaccactgagtagtagtgatgattctgtcatgaagcaagttactgtatgtgtagatttgtttcctagctgtctgttttattccacttgcctgtttatggttttatcaataccacactgcttaattactatagctttataataattattgctatctagtagtataagtacttaagcttgatagtgttggaggatagtgttaggatagtgttggaggtggtggttcttcctttgcttctccttctctcgatacctccccttccttcctcttcctcctttttctcttcctccttaattttcttggctattctaagtttgttgatttttcatacatgattttacattgccttatcaattttttgaaagctgctgagattttgaatagtattttcatgagtgcatacatcaaatttggaagaattgacatctttaatgatattaagtcttccttccatgaacctggcatattaaatttatttaggtcttcttcagtttccttggcagtattttgtagttttcactgtacagatcttataaaaaattttgtaaaatttatccctaattgttttctctgtttacatgctgttgtaaatagaattatcttcttaacatcatttttcatttttttcattgctactatacagaaatataattgatatttgtatattgccctattgtccagtgaccttgctaaattcacctattagttctagtagctttttggtaggttccttgaaattttctgtgagcataatcatgttgtttgcaaataaacagttttaatttattccttttgaatctgtattccttttatctcttcttcttgccttatggtgctgactaggactcccagtacaatgttgaataaaagtggtgggagtggacatcattgccttgttgctgatattaggggggaagtattcgatctttcaccattgactatgatgctagttttaggtttcatgtaatgtccttgatatagtttggctgtgtccccaccaaaactcatcttgaattgcagttcccataatctccatgtgtcatgggagggaccggttgggaggtaattgaatcattggggcagcttccctcttgctattctcatgacagtgagtaagttctcgtgagatctgatcgttttataaggggcttcccccttcgctaggctctcattcttctctctcctgctgctttgtgaagaaggacatgtctgcttcctcttccaccgtgattgtaagttttctgaggcctccccagccctgaggaattgtgagtcaattaaacctctttcctttgtaaattacccagtctcaggtttgttcttatagcagcatgagaacggactaatacagtcctcaatcaggttgaagaagttgtattctattcctaattgctgagatatgaatgctgaattttatcaagtgtgttttctgcaaatgctgagatcatcatatagatgttctcctttattccattaatatggcaaattgcattgattttcaaatgttaaagaatcttttattaatgggacaaaccctactttgtcataatatgttatactttatatatattgttactaaagtactaaattctgactttaaaaattttttcaattgtacataaactaacttacttactttctctctctctctctctctctctctctctctctctcttttgagacagggtcttgctctgtcacccatgctggagtgcagtggtgtgatcatggctcactgtgcagcctcaacctccacaggttcaggtaatcctcccacctcaacaccccgagtagctgggactataggcatatgccaccatgcctggctaatttttgtattttttgtagaggtggggtttcaccatgttgcccatgctgtcttgaactcctgagctcaagtgatccgcctgcctcagcctcccaaagtgctgtgaatatgggtgtgagcctttagtaaaaagacaaagactttcaaattagattttaaaaacacaactctgtgctccttaaaagagaccctttgcctaaagcatgcaggaaagtcaaatataaaatagtggaaaaaggtgtctggcctgtacataagctttctattgcaatgttttctgtccttgttatcatttcctttcttatattttctttaggttaatttgttttactagctttttgagcaggaagattagatcgttgatgttcaacttttttcattttagttcatgcatttaaaactttaatcttcctactgaaaactgatctagctgaatcttacactttgatagtttatgtcaaaatagattattcaattcaaaatattttcagctttccactgtatttttttgacctatcaattatttataaggtattgcttcattttcaaacaattgaaggtttggggatatttatttaatattggtttctagttaattttcattttggttacagagcctctcctatattacttcagtcttaacaatttgttgaaacttgcttcatcactcaacatatggtcttttttgggaaatgttctgtgagctctcgaatatagtgtgttttctgctatttttgcaaatggtattctatgtatgtcgattaggtcgacttcatctgttgtgttgtttatatctttatataagtactgactttctgcattttctgatttactttgagaaatgtgttaatttttcatactacagttgtagatttgtctatttctgctttgttacatgaacttatgtgttatgtatttaaaaatgtgaaatttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaatgtgaaattgtgtgcacaaacatttatgatttttacatctccctgttgaggttgtattatgcccctacgaactagtgatttttgtatcttccatttaattctttcttaatctttgaattctgttgttgaattcctttgccattatgaaatatccttctttccgtaagtatactttgagtcataataatatagctatatcaactttcttctagttattgcttacatggtgtgtatcttttcccgctcttttatatttgactttcttccatgctttaggcaaagtgtctcttttaaagagcacagagttgtgtttttaaaatctaacttgaaaatctttgtctttttactaaattgcttattccatttgcatttctaaatgtgttgactataacttatatataataaagtgcacaagtcttaagtgtgcagcttcatgaatgtttatacatgtaaacacctcgtaaccatggccggaccaagatatagaatattttcagcatctagcaggctcattttgccccttcccagttatcctcatagaagactactattctgacttctatcatcataaattagttttgtcaatttttagtgtaatactcacggaatgacacagtatgtactctttagttctacttctttcattcaatatatttcagttagattcatcaatgttgttgcgtgtgctagtagtctatttttaatttttgtgtagtattccattatatgaatttaacatttattccatctactgttaatggaatttttgttgttttcagtttgagactattatgaataaaatcaatgggaacactctgtacatatcatttttaaatacatgtactcatttatcttggaaaatatatctagatatatagcaaaatatatctattattgcatcatagggcaggcatatgggttatttaagtattctgtcaaatgtttttccaacatagttaaaattttactcacaccagcaatgtataaaagttccaggtgcaccacttccatgttgacacttactattgtcagtatttttaatttaagtcattcttatggtcatgtagttgtaactcattggtggacttaaatttacctaataatcattgatgttgagcactttttcaaatgccctattggccatttggatatctttttttttgagaaatgcctttcaagtatttagctcattgttaaaaaaaatcaagtttattgaattataagttacataaaataaaatgcactaagttaaagtgtacagtttgatgaattttgacaaatttattcacctatgtaaccaacacaattaaaatataggacatttccatcactacctcaccccaaattcccttgtgcccctgtgcagtcagttctttcacccctaactccagacaatcattgatctgtttttttgttatacttttcttgttccagaattgcatataaatgaaattatatagtttgcacccctttgtttcttacttctttcactcagcagagtgtttttgagatttatccattttgttgcatgttccagtagtacattccttttaattgctgaatagcattccattgcatggatatacagaacattgtgtattcattcacctgttgataaacatttgggttgtttacagtaaaaaactgttatgaataaaggtgctatgacatttgtgtacaagtatttgtgtatatatgtatgcttccatttatatatatttatatatatgcttccatatatatatataaatggaatatttatatggaaaatggaaaatatatatgaaaaatatatataagggaagcatatatatatatatacacacaaatacttgtgtgtaaatgtcatagcacctttattcatatcagtaaaaaactagaaacaaccaaaatgtttatcaacaggtgaatgaataaacaatgtataaatatatatatatgcttacatatacatatatacacacacatatatatatgtacacatatatatatacacacatatatacatatgcttccatttcttttggataaatatgttggagtttaattgctgagttatatcataagtatatgtttaactttgtaaaatgttctcaaacttttttccaaagtggttatacgacttaacattccctttattgatgagattacttgtgttttcatatccttgtcaccagcagtcttttttttttttttttttttttttggagacggagtcttgctctgttgcccaggctggagtgcagtggcgtgatctcagctcactgcaacccctgcctcccaggttcaagcaattctcctgcctcagcctcccgagtagctgggactacaggcacacactgccatgcccagctaattttttctattttagtagagatggggtttcaccattgttgcccatgctggtctcgaactcctgagctcaggcaatccacctgccttggccttccaaagtgctaggattacaggcgtgagccaccgcgcctggccaactagcagtcttttaatttttctgagcattgagcattttttcatatgtttatttaccatccaaattatccttttgtgatgtctgttaaaatattttgcctattttattgttataagagatctttatgtattttgtgtacaattcctttatcagatatttgacttttatatacttgctcctaatctgtgatttgccatttaactttcttttttcatttcatttcattttatttttaactgacaaatagtaattgtacatattcatgtggtacatagtcatgttttgataaatatagtatatcatgatcagtttagggtaattagcatatctatcatcttcaacatttatcatttctttgtgttgggaacattcaatatctttcttttagctatttgaaactatataatagtttgaaactatataatatgctgttgttaactgcagtcatcctatagcagtatagaacactaaaacttattctttctatctagctataattttgtattccttaacaatctctccccatctctccatttccccctacccttctcagcttctagtaccctctgttctactttttacttctatgagatcaatttttttttagcttccccatatgagtaagaaccggcagtgttgacctttgcgttcctggcttatttcacttaacataatgttctccagttccatccatgctgctgtgaatgacagaattcttttcaatggctgaatattctattgcatatatatatatatatacacacaccacattttctttatccattcatctgtcgttagacacctaggttgattccataccttggctattatgaatagtgttataataaacacaggagtgcagatattttcttgaatatactgatttattttcttttggataaattcccagtagtgagattgctggatcatatggtaattctatttgtacttttttgaggaacctctataatattcttcatagtggctgtactagtttacattcccacgaacagtatataagagttccctttcctctactttctcaccagcatttgttatttttttgtctctttgatgatagccatcctaactggtatgagatgatacctcattgtggttacgatttgcatttctatgatgattagtgatgttgaggattttttcatatatttgttggcccaatgtttttagcttctttcaaagagaaaataattttgtgaaagtccaatttattgtactaggaacaactacatatgtaatgcttttagtacatatctgtaaatatctgacataaattataaccttatatcctaaaaccactcatcctgatagagtctattttcttcattttactaaagggaaaacaaggttcagaagtattaagtgacttgttagcaatgtaagaatggcttgatttttttaaaaaaaagtattaagtgacttgcttgaggctgcacccagaggtaccagagttggtattcaaaccccatccatccaaatggccccagaaccagaacttcttgcactacatgacactgccctctactatctgcatcctctgaccacctctttacaacagatgagacaaaagggtggagcattatgttgctcaacctcagctggaaacatgtattttggacaactcaatattttcaccctacacatattagataaagtagacttcaaagcaaaaaacaaataccaaagggagacatatagtgataaaatagctaatacaccaagacgacaaagcaatcctaaatgtgcctgcatgaaacaacaaagctgcaaaatacatgaagcaaaaactgatagaactgaaaggagaagcagacaaatccacaattatagttggagatttcagcatccctgtctcaataactgtagaacagttagacagaaaatccataaggatatagaatagctcagcagcaccatagcctgttagttgaatctaattggcatttataggacatcccatccaaaagcagaatacacattcttttcaagtgttcatggaacatacaccaagatagacaatattctgtgccataagacaaacctcaacaaaattttaaagttgaaatcattacagaccatgtcttacaactataatgaaaaaaaaaaaacgtagaaattagtagcaataacatgaaactctctaaactctaggaaagtaaacaacacacttaaatcatccatgagccaaagggaaagttgcaaacaacattttataaaaatacaaaatacaaaaaatacattgaattgatctaaaatgaaaatacaccatatgaaaatgtgtggagcacagctaaaacaggtctgagagtgaaatatatagcactaaatgcatgcattagaaaagaggaaatattgcaaatctataatctaaattctcacctcaaataataaaggagagcaaaatgtacctaaagcaagtggaataaaggaaataataaagacaagaacagaaaccagtgatattgaaaacagaaaagcaataataaaaatcgatgaaacaaagagcttgctcttttaaaagatcagtaatagtgacaaacctttagcaatactgacaaaaacaaaataaaaaaaacaggccgggctcggtggctcacgcctgtaatcccagcactttgggaggccggggtgggtggatcacttgagcccaggggtttgagaccagcctgggcaacatggcaaaaccccatctctacaaaaagtacaaaaaattagtcagacatggtggagcatgcctgtagtcccagctactcaggaggctaaggtgggagaatcacctgagcccaggaggtcaaggctgtagtaaaccatgatcgcaccactgcactccagcctgggcaacagagtgagactctgtcttaaaaaaataaagggaaaaaaaatcacatattacaatattagaaatgaaacaagggatatcactttacactatgcaggcatcgaaagtataatagagaattataagaataattctacacatataaatttgaaaacttagatgaaatagacccattaattagaaagcataaacaactacaactcaccaaatatgaaatagattattgaatagccttataacaataaaggaaatgaaatcataatttaaaaattgcccagaaaaataaatttccaagctctcatgacttcactggagaattctaccaaacatttaaagaaaaatgaacaacaattctatacaatctattcaagaaaatagaagactagggaatattctttttatgaagctagtactatgctgataccaaaaccagacaaaatctgtaccaaaaagaaaactacatacaaataatttccctctaatacagacacaaaactcttcaacaatattttagtaaatataattcagtaatgtattttaaaaatgatacgccatgaccaagtggagtttactccagggctatgaggccagttcaatatttgaaaattaatcaatataatccactatattaacaggctaacgaagaaaattatcatatgaatgcattaaaagcatttgtcaaattttaacactcattcattataaaaactctcagaaaaatagtaatagacggtaatttcctaaacttgataaagagcatgtacaaagcacctacagctaacattatacaggaaaaaatatttaacgtcattagtgtaatgcacattaaaactacaatgagatatcactatacacatattagaacagcaacaacttaaaaatgacaatacctaatgctgtcgagaatgtggggaaatggaatctttcatacattgctggtggggatgtataacctttctaggaaacagattgacagtttcttcaaaacaaaacaaaacatatacttgctatataaccagcagtcatactcctgagcttttattcctaagaaataaaaaattatgtccacacagaaacacatacacaaatattcatagtacctatatttatgacagtcaaaatttggaaacaacccagatacccttcaatgagtgaatttgtaaactgttgtaacatgcgtacaattaaaaagaaacaaactattgctatacacaacaacctgcctgaattgccagagaattatgccgagtgaaaaaagccaatccccaaaagttacatgctgtatgattccatctatataacattcttgacatgacaaaattataaagattgcaaacagattagtggttggcagggatgaaagagggagtagaggtggaaaggaaatggaggtgaatataaaagaaaaacatgaatgatcattgcgttgatggaaatattttgtatcttgactgtatatatatcggtattctaattgtggtatttttctatgctttttcaagatgttactgttgagaaaaactgggtaaatggtatagaggaactttctgttaatttcttccaaatgcagatggatctaaaataatctcataataaaaatttaatcaaaacattttctgagatcataggaggaagtctcaggaagctaccacttttggggaaaagcaaaacattggaaaggcagcaccccttagagacttgatgaaggaaagaaggatgcaagaagggaaattaaaattcttgcagaaacaacaaaaacagaatgacagaatcagaaaacacaccatgaccattaatcaccaccatcatcaccatcaccaccaccaaaaaccccaactttgttacaccaaagtaaagggcactcttgaaacaaaaaagcttatttcacctctacatcccaatgcaactgttcttgctgtgcaggaaaatattttatttaaaaatgacctgaaggtggctgtcaatattcatacataggtactgtgaacaaagtcagaaaattagaatcaaaacattttggcgataaaaatttcttcccaaatcaagcatgaagcaaaaggaaattgtgagacttcacaaaccagtaaaaatgctttaaattagaaattcaaagctcatagcagaagtggacataaaaacaaatgtatgtaaaataagagttagctgaattcaagaaattaattgatgtcaaaatcatcatagaaatgaggactaaattgtaatcaataagtgaaagacagcttggctcacactgtatttccttgagtttcttgaacatgctactccattgttgtcttgctttctatgttattgttgggaagtttggtgctaaacttattttcattcttttaaagttacttcaactttttgccaagaggccctgagctttatttatttacatttgaagtctaagatttggcactgagatttttattggtgccaaccattctggatcatctttcccccatacatgacggactgtatctagtatgacaatgctggttttattttgttgctggaaagtttttttcttttaagtatacttttaaacattagttctgttttattgttacatggggaatacatggaggtaaagggatatcaaataaagattaaatctgacaaaccaggtagtagaaggttaagtaaggaaagtaagagtattataaaagacagtagtgtaaaggtaaccactagaacaaagtgacaaacctgcctaattaccaaggcaggaaaagagcccacatagacacacagaaagtacaatataatacttacagtgtgacggctcccatgagatgtcagtttggctgggctatagcccccagttgttccatcaaacactaatctaggtattgctgttgaatgttcttgctgatgcaattaaagcccctaattcattgattttaagtaagagagattatcctggataatctgagtgggcctgactgaatcaattaggtaagtcttaaaagcagggctgaagtttctcgaagagacagaaaaaattcttcctgtggacaacagctttggcctgtgcctgtggaatttgagcctgccagtgaacttcccttcgtgactgcttgccctaaggatttcaggcttttttagctaggccctacaattgcataagccaattcatgtaacagacatacaccctacatgttctacttctctgattcaacctgactgacacacacagtaatagaataaaatagtatgacagagttgaaattaaacatatcagtgatatcaataaatgtgaatgggcttaattcactatttagagaaaatgattcagaggaaatacaaggtgagtctggagcatcttgtagtaccacaaaataaggaagtagtttttctaaaaaaaaggtagggcatgtcaaagtgacacagaaggacagaaggcaatgtgaaagagctcccaatgagcaaagatggaaaaatctgaacaacaaagtaaatcatgtactactggattattacccaaagtacaaaataaaaatatttgaatccttagtggtataaatagatgattgaataaataaataaatgagggaaacaagacaaattttcttacaacagaattccatgtttatcagaaatttgttagaaatttctatagattctcccctcttggagatgatgcttaattattattgccaccaccactccttgagtttgggcaagacttagtgacttctttccaaacgaggaaaaaaatcatctttacagtaaagaaactatcacaactggcatcaggatccctcatgtgactcccccatatgctttaaatccctttgacttccccttttgctactagctggagaaaactgcatttaaaagtgttcatgtgatttgactaggctcacctgaataatcttccttttttgaggtcaactacgctgtgtaacacaatcatgagaggtatctcatcatatattaatatatctatacaggttctagagattagggtatgacattttaggggccattttaagaattctacttaacataccgtcatataaatatacatttaaaattaatagttgggtgcggtggctcttgcctgtaatctcagcactttgggaggccaaggcaggtggatcacatgaggccaggagtttgagactagcctgaccaacatggtaaaaccccatctctactaaaaatacaaaaattagctgggtgtggtggtgcatgtctataatcccagctactagggaggctgaggcaggagaatcgcttgaacctgggaggcggacattgtggtgagcctcccacctcaccattgctggtgagcactccagcctgggcaaaacagcaagactgtctcaaaaataaataaataaaataattaaattaaatcacacttacagaaaactgcatttgtatgaagaggtttttcttttcggagaaattgttctccaagaatcatcaggtctaactgtaatacaatttattggaaatttattacattgttatcacaacctaaaaatgcatgttgctttcattatgtcaattaaaaatgagattacttgccaggcatggtggctcacgcctgtaatcccagcactttgggaggccgaggcgagtggatcacaaggtcgggggattgagactatcctggctacggagaaaccccgtatctactaaaaatacaaaaaaattagccgggtgtggtggcaggcgcctgtagtcccagctactcgggaggctgaggcaggagagtggcgtgaacccaggaggcggagcttgcagtcagccgtgtttgcaccattgcactccagcctgggcgacagagcaagactccatctcaaaaaaaaaaaaaaaaaaaaaaaaaaaaaaaatgcggttactaaaattaaaaactttgaggatctaataaataattttcacaaaagtgagccaaaaaaatcttatgatcaataaaaataccacattaataaaatattattcattgtattatataaaattttgacaccatttttgcaatttgtatgtttatatatcattcaggtatcatgtatcattgcatgtgcaattaaagcccctgatccactgaattttaagtaagggagattatcctggataatctgagtgggcctgactaaatcaattaggaagttttaaaagcagggttgaggtttctataagaaacatttatgtatcattgttatctatattacattttatatgtaataaaagattttaaggaaaaatgttgatattttagtacctttaacatttttaaaaagctttatgaataaggggccctccattttcatttgcactgggtcccacaaattatgtacccccagctttaacccgacaagagcattacaaaaaaagcagattacaaaccaatatccctcatgaacatagatgcaaaaatctgttaaaaatattgacaattcaggccgggcacggtggctcacgcctgtaatcctagcactttgggaggccgaagccggcggatcacgaggtcaggaattcgataccagcctggccaacatagtgaaaccccgtctctactaaaagtacaaaaattagctgggtggggtgatgggtgcctgtaatccttgctactcaggaggctgaggcaggagagttgcttgaaccccggaggtggaggttgcagtgagccaagatcacaccactgcactccagcttaggtgatagagcaaaagcaaaactccgtctagaaaaaaaaaaaaattatatatatatatatatatatatatatatatgtatatatatatacgtatatgtatatatacgtatatatacatatatatacacgtatatatatacacacacaattcaaatccaccaatatataaaaggaataatacattatgaacaactagtgtttatttgaagaatcaaagttctatttaatgttcaaaaatctatcaataatattaagagaacaaagatttttaaaaaccatatcatcacaacaaaggcaggaaaatcttacaaaattcaataacaattcagaatgaaaagaaaaattcagcaaactagggaacttcctcaacctagaaaaaccaacagctaacataacatttaattgtgaaatattaaatgcttccctcaaggttagaaacaagacaaaaatgtctgctttcactatttgtattcaacattgtactggaggccctggtaagtgcaatatggtaagaaaaataaagggcacaaatattgaaaaggagaaaagttgaactagttttcttttttttcatacccaacatgattatttacatataaaccctaagaaatattcaaaaaatggaaaatttacaagacaaaaggtcaatacataaaaaccaattgtatttatatatgcaagcaacaaataattggaatatgaaatttaaaaatttaccaaagctcaaaatatagtattcatatttaataaaaaatatgtaggctctctacacagaacactcaaaacgttgaagacctaaataaactagggaatgttttcatataaagtgttcatggcttagaagactcaatattttaagatctgaagttatcgcacattcattcttgctttcaacaggattctgttaaaaattccagctggattttttcatagaaattgtcaggatatttctaaaatttctatggccatgcatcttgactagaataggcaaaaacattcttgagaaaaagattaaagtaggagtatttacgctgattttaatatctaaaataaagctatggtaatcaagataatatggtatttatatatgaaaacagatccatggaacagaaataaagtcaggaaatagaccaactcacgtattaccaagtgatttttgacaatgacaccaaggcgtcaaaacaactaaatatcagcattgaaataaatgaaccttgtttcataccttataccatatacaaaaataaactcaaaatggatcataaatataaaaactaaaactttaaaactcttagaagtcataagagattatctttatgaactggaggctaggcaaagtttttttaaatgtataaagcacttaagttgatcgcataaaagtagagtagaatagtgataactagaagttgggaagagtggagggaaagggatagccaaagattggttaatggatacaaaattaaagctagataggaggaatgagttctggtgttctatagaactgtaaggtgattaagttagcaataatttattctgtgttttcaaagaattagcagagaggattttgaatgttcccaacataaagaaatgataaacatttgaaattataaatatgctaattaccctgatttgatcattacacattgtgtacaggtgttgaaataccacactgtactccataaatatgttcaattattatgtgccaattaaaaataatttttatgaaaaatcaagtctgtcttagaaataagtaaatacaagaacaatatacactaaaatgcataagagaaaagacaaaagcaaaaaatgatgaaataaaaaatgatatgtgtatttcataaaaaccaaaaatgtctactcatcaaaaaacaacattaagaaaataagaagacaagccattgtactgaaaaatatatttgtgaaacatataactgacaaatgactcacacacagaacatgtgaagaactcttacaactcaatgataaaaataagcaacccaataaaaatgtctaagtttttaaaacttagacatttcatagaagagtatctaccaatggccagtaaagatgctcagcaacgttagccattgagttaaagccatagcaatgtactactacacacacaccaagatggttacagttaagacgactttcaatatcagatgttgcagaggttgaagagtatctgaatctcttgtatgctgctggtggaagtggaaaatggtataaccacatttcaaaactcttataactccaaacatatactatgtggtagggttcttcagagaaacagaactaatggggcatgtatagatgtataagacaggttatgggaattggcttatgttattatggagactaataagtcccacaatctgccatctgcaaattgtataattaggaaagcaggtgatgtaatttagtctgaggctgaaggcctgagaatagttgggggtgggagtgaagaaggggtctgctggtataaatttcagagtcccaaagcctgaaaactagcagctctaatgtcccagggtaggagaaatggatgtcctagttccagaagagagagaagagggaattcactcttcttccacctttatgttctatttggaccctaattgactggatgatgccagcccacattggtgagagtggatcttttttactcaggctactgattcaaatgctaatctaatctggaaatactttcatatacatgcccagaaataatgtttagtcaaatatctgggcagtttgtgatctagccaagttgatgcataaaattaaccatcacatataactaccttataatccaacaactctactcctagataattattaaaagaaataaagaccatatatccacaaaaaatcttaagcatgctcattgcagctttgttcagaatagcaaaacattggtaacaatttaaatgtgcatcaaaaggagaatgcataagtaaagtgtgatacatttacatgattaaataacactcataatagtggttgcctctgggtggaagggggataattaacttgaaaatggcatgggggatctttctaaagtgctagcaatattctgtgtctttatattggttttaattacacaggtgtgttcatttgttaaaattctgatcaacctgcacacttaagatctgttcattttaccaactgtaactatatctaaacaaaattaacattaaaatgtatgttattaaaccagcgtttacggagaaatatatagttaaatatacaaatgtaaaatatatagtatatatttaaagaagaaaaattaaaaaattatcaggaggctgaggcaggagaatcgcttgaacccaggaggtggaggctgggctgcagtgagctgagattgcaccactgcactccagcctgggcaacagagcaagactctgtctcaaaaaaaaaaaatcaacaatctacatgtctaactcaagaagataaagaattgatagattctgtggcaagactgatcaagcaaataaaagagaaaaaacagaagttaccaatttcatgaatttcatttaatatcctacagatattaaaatgataataagatattatgaagaattttatgccaaaaactttaaacttttgataaaacagacaaattcatttaaaaattttaccaaaaccaacactagaaaaattgaaaatgtgaagagtcctgtatctattatactaaagaaatacaaaaccataattaaaaaccatgccacaggaaataaaacagccaggccagatgacaacactggtgaattcttctaaatatttaaggaggacatgtaacacaaattgcttttgagggaagaaaaacaggatacattagcaacttgttttataaggcaagcataatttttacttataatatgaaaaaagacattattttaaaaggataattataggtcaatatctgtcctgaacataaatgcaaaagacctaaaatttttagcaaattgtatctagcaatatgtagaatactgtactatattataaatacatagtaaaatttattgtagtaggagcagtgtttcagtatttaggaatttagggtttaaggcaactttatagagcataactactttgaataatgagaatttactggaaatacatacagccatccctcagtatctatgtgggattggttccaggatccccctcaaataccaaaattcatgggtgctcaagtccctgatacacaatggtgtagtatttgcatatcacttatgcacatcctcccatatactttaaagcatctctaggttacttgcaacacctaatacaatgtaaatgtcatgtaaatagttgttatactgtattgtttagggaataatgacaagaaaaaatctgtacatgtaagcacagatataaccatctggttttatttttcaaatattttttatctgtagttggttgaatccacaaatgtggaatccacagatactgaaggtaaacagtataatcataatccatcagtgttattattttatgggttcaagtaaagtgtagaaaccctacctccttttacattcctgagtccttccccatttatgatataattgtcttaaatattttttacatatatttagaaccacaacagtgttataatttttcctccacatatcacatataatttaaaaactcaagaatgaaaatttcttgtctttactcatttttttaattttatgatctttcttccttcctgatgtcccaagatttattttttgtcatttcctttctgtttacagacccattcttagagggtagttctgctagtcacacattttcttaatttttcttcatctgaaaatatcttgatttccccttcattcttaaaggatattttttctggatataggattctgagctgactgttcttttgtttcagctattgaaaatgttgtgccattttcttttggtctctctattttctgacgagaaatctgatgtcatttgaatagtttttcctcccatggataatgtgtcatttctctctcactgctctcaaaatttttcttatttcttttttagttttcggaaatttgactatgctgtgtcttagtgtagattgcttggggtgtatactgcttggggtttgcccagcctctgaaatatgtaggtttgtgtcttgtaacaaatgtgagaaatttcagctattctttcttatagtacttttccagccctttcctttttttcctcttttttataggactccagtgacgtgaatgtcctgttgtttattatagttctacaggttttgggggctctattcatcattttcaggctatattttctctctattggttaatttccattgttatattttccagtttactaatttttttcctctgtcctctccattctgatgttgagtctgtgcaatgaattttaaagtagtgttatagtatttttcagctctaaaattttcatttttttcttttatacatgttccatttctttgttgagacacgctctcttccttgagtctctgtttttcatttgcttcaagtatgtttgcaattgttcactgaaacatattcatgatggctgcttataatcttaggtaattctaacagtgggagttgaacaatgagaacacatggacacagggaggggaacatcacacactggggcctgtcagggggtggggggctaggggagggatagcattaggagaaatacctaatgtagatgacaggttgatgggtgcagcaaaccacaatggcacatgtatacctatgtaacaaaactgcacgttctgcacatgtactccagaacttaaagtataataaaaaatagaaattatatacatttagggtgtacagcttgatggtttgatatatttatacactgtgatatgatcattacaatcaaggtagttaacatacctattacctcacatagttaccactattttgatgttcagaatatttaggatccaccctcttagcaaatttcaattactgtatgcagtacagtattgttaactaaagatgctgtgctgtaaattagatctccaggactaatttatcttgcataatggacactgtaccctttgaccaataattcccctttctctatacctctctattcctctttctctaaacctctggcaacccattctactctgtgcttttatgagtttgacaattttatagcccacatataagtgagatcatgcagtacttgttcttctgtgtttggcttatttcacttaatagaatgtcctccaagttcatttgtgttgtcacaaatggcaggatttccttccttttaaaggctgaatgatatcccgttgcatatacaccacattttctttatccatttatctgttggtagacatttaggttatttccacatcttagctattgtgaataatgctgcaataaacatgggagagcaaatatctctttgaaatactttttttatttctttgggatatatgtccagaagagaaattgctggatcatatggtggttatatttttaatttttggaggaaccgcctcattatttttcaaaatggctgtaccagtttacattttcaccaatagtgtatgagggttcccttttctctacatcctcaccaacacttgtcatcttttgtctttttgtaataatcatcttaacaggtgtgaggtgatatctcattgtggctttaatttgcatttccttgatgattagtgatattgagcacattttcatatacctgctagccatttgtatgttgtctttgaaggaatgtctgttgaagtccttttccattttttaaattggagatatatatatatatatatttatatatatagctattgagttgtggaaatcccttatatattttatttgtctgtgttaagaataaggaattggctccctagcatctcccaaagctgaccaaataaatgtgttctggcttgcttttttatttcattgtattttatttattttagttttgctcggttgctcgggctggagtgcaatgatgcaatcatagctcactacagcctcaaacttctgggctcaagctatcctcctgtttcagcatcctaagtaactaatactagaagcacacatcaccatgcctggctaatttttttatttttattttttaagagacagagtctcgctctggacccgggctggagtgtagtggcacgatcgtagctcactgcagccttgaactcctgggctcaagcgatccttccacctcagtttcctgagttgctgggactacaggcatgcaccactgcacctgcctcctttgcattgttttaatatcatgatgagttcatgtatctaaacatttttatatgttaaaatgactgcagttattgttctttttaatgatcaaattgttctatcttccactggaaaccacttaggttggcttctgtgtcctttttgacaaaacctaaatagcgtttgttagttttcttgctttctggcacgacagaaaatagctttgaatcatctttcttgatatatagaatgatatttgcatgatatatagaatcacccattataatttgaggctcatcatatatatttcctgccacagactcagtatgagctatttcttcaatgaatcctgattccttttaatgggaaatagtgtttagagaccacaatctgaatgctgtggcagttagtttgctactatgttcatattttctaagagttttctatgatcagagctattaaataaatatgtgttaagaagattacatcatgagttcatactaacatttcaaatttaagtatagggttatagggtttttatttattttatttcattttatattcatatctcttttcccatatgttgaaaaccttaatttgctttattctaaaatatttattatggtgctatgtatggactgaatgtttgtggtcccccctgctaaattcatatgttaaaatgctaatcccaatgtgttggtatttggagatggagcctttgggagataattagatcttgaaggtagagtcttcccaaatggaattagtgcccttttaagaagaggccagaaagccagctaactctagttctgccacatgaggacacagtgagaaggcagctgtctactagacagaagagggctctcaccagaacccaatcatgctggtactctgatcatggacttccagtctccagaactgtgagaaataaatatctggtgtttataagccacctagtttatggtattttattatagcaacctgaactgaataagacatatgttttcataaccttaccaatgttattgctaacaatatggctactgaaaatgctttaagatttatttgtagctgcttttgttcctaaggtatgtcccactgtggatgtgtagttaaagtattgtgttttacaatcacttgaaataattcctttctgtatggttaaggttatgttaccatctcaatataagttaaattcatcagtttcatttcgtgttttgatttttagtgattgctttatcattttattttactttttaataatttataaaacagcattatggttccaaagacaaatatacaaaatacattacatttacatacgtttagcttcctttattgttcttttcaccctggtttctccctcctcataagttgccatttttattatttttggtttatccttccagtattattttaaaatatacacataaatacacattcctattctctctctttatcagattaaagctatcatactgtatacattattctgcactttgtttttataacctaacagtagatcctggagatcacttaatagcagcacatacgaagattcctcatccctttatgtagctacataagcttttttttttactgtgtggctatgagtaggttattcagtctctaaagagagtactttaataggaacagtgtcacgcaacaagcctgggaacatagcaaccagggcacaaagaaaaagtgtcaattccaagttatgggcagttactggcttaaagagaaaattgctcaaatagtgaaagcaacatttcaatactgagctgtttgtggcaaaaaggaattgcatactcaaaccaaaagtgtgttaaattaatacaatgggggaaaattacaaccattgaaagagactgataccttggtttattagggaaaaaaaaatatgctttggtaggatgattgctgcttgtagaactgccaaattggggactgaatgaaaaacactcaggtataatatagctacctcagagtcttttaattccacataccaaggtagatattaataataatatatattttttaattcagaagatgttttcccacatagctgtggacaacacaaggcaattgttagaggaaatttgatgaagttgtcctgacattgttctctcagtgggtttcccctctattatttcatttcatctttacaactacctttacagctatggtgttattattttctctatttgagatgtgagaatgttcagaggtgtgaaatgacttatccaagatcacttaggtgtccagtgaaaatagctgccattcctagcccagtgttttttccatgacatcagaaatagtacagtaacaatcaagtaaggcctaatcaagtcgtctagtcaaattttgaacatactcaacccataaaaattcttgtgctaactctaagttcagcagttccctaaagggtctagggatagagcagagaagagagggctgataataatcatgtaaaccaacacgataatttagcagctgagatacttatctattgttgcataacaaattattctaaaacttagcttaaaacaacaaatatttactgtatcaagcagtttctgagggttaggaattcaggaggagcggcttagctggatagtctggccccagatctttcatgaggttgtagtcaagctgtcagcaaggggtggagaatctgctgccaagctcagttatggggttgaaagaagcctctattttttgacataccacgtggacttctccatggggctgcttgatatggcagctagcttccttcccccagtgtgagtgatccaagtgagacagaaagcgcaaatgaatgagagtgcccacggtgaaagacgaagtcttttttttataaccccgtctcatcacttttgccttataacatagaccaaatccaatgtgaatgccaggaaacagggatcactggaggcccatttgggatgctggcaccacaatagctaatgctgggagaagtcttactgtgcatcagacactttactgagcactttatatgtattattttatccatagccctcacagtgacactgagaggcaggcactattattattcctgttttacagatgaggaaagtgaagctccgaggtgttgtctgagtgagtgaacttgtccaaagtcacagagctagaaagtgttagagccaggattcaaactcaggtagtctggcactatctcactaagctatattgtctctatgttcagatattagtaagtgctatgaaggaaataagataatatgatggagtgactggagtatggatcagacagggattttttattttgttatgttttaaattgagttgtcagggtaaaccactctgtagaggtgatacttgagttgtgacccaaatggtgagaggaaagccagcctcatgaattggtgaagatacactttagacagagggaatataatgtgcaaagacctcaaggcaggaaaaatcttggtatattgaaggaacacaaagaaatcagtgtggtttgagtatattgcgcatgaagggatgggaataggatctcaggtatagagaagacatttgtacaatcccttctctgtggggagctcagagaatcttctcccccagagagatatttgttacactggtcaaaattatcaaagaaaacctttaaaagtctctggagattgtccaaaactgggagggatttattcaacaaatttgatcaaaacttgtatgaaccacagcaggccaaagcacctgagccagaggctgcacccatctctcctccagctctgtgtatggaggaactactctgggcagactgaacagattccacagctgcaaccaagtaggcagcttgtgttaccccatttctctggtattgaagatctatatttgcaaggcagtatgagctggtaaacaatagattccatttcctgccatctctctcatttctcctatctcccccatcttcaggctgtagaaatctacattgggtggtggcaatagccaggtggtgttgtctgcttcctcaacccacagcactcactttgttggaaagaggcgggtggagcagtaagtgaagaacagtgtcctccaattctcctacaactctcatgccatggcattgcagttctacctgggagaaggggtgaggcaaactgcaaagactggaagatctggctccagcagagaaggagatttcatttggttcagagaatggtggaattcatgccctagggtatgttgttgaaactataaaaatcagtgtctagcaattggaataacagcttggtaatagcaatagagggagaccagccatgagtttaacaggtagatccaggaaagagacagtctaagaaaaccctgctaaaatcacacccatctctggtggtcaggaagacttccatgctcaaggctgcactttctcaggctgactagaaaacggtactttcaaaataagttttccccttaacagagaaagtaatctccaagccatacatagatcctgtggtaaagggtgaaaactactggacctgggaacttatttacaacttttgaccagtcagtggctaaccactaagctatgctgatctagaggcaacctctgggaaattggtctttaaaacgaaaacaaggggaaaaaatcttagcagggacatctggggctacacactgcaggggaaatagacttcacagaattaatccagacatatcaccaaacaaataaacaaatgaacaaacaacatgaacaacaagccccaaagggagaatagtatctagagttgctacaatattttatccaaaatgtccaaatttcaacaaaaaatatgagacatataaagaaacaggaaagtattgccctgtacaagaaaaaagagcattcagtagacctgtctctgagtggacccagatgtttgcttagcagaaaaagacttcaaagaaacaattataaacctgttcaaataactaaaggaaaccacatttaaataattacatgaaggtatggtgacaatttcttatcaaatagagaatatcagtaaagagacagatattataaaagtagcacagtagaaattctggagttgaaaagtacaatagcaaatgaaaaattcagtaaaagggcttacttaacagcagatttgagcaggcaaaagaaagaatcaacaaacttgaagctagatcaatcaagattttgcagtctgagggacaaaaataagaatgaaaaaaaatgaacagagcctcagagacctgtggaatgccatcaaatgtaccaccatatgcataacgggggtcccaggagaggagagagaaaggggcagaaataatatttcaagagctaattgctgaacacttcccaaatttgacaaaatacattaatccacatatccaagaaactcaagaagaccttctctagtttctttctccaaaggcttggtgtccttcagggaggagctccctagtttctcacctccctgaaattgggtaacctctcagtctagagaccagtagaagtgttgggcagggtggtaagaaggtctgctctggaaaattgggcaggttggactctgtacaagagtgtatggccaagggagtttaaaggggctataatccagtccattctccactccccaagccatatacctgattcagggttgcatctacccagaagaaaagccatcattttctaatctgcctagcgtctcaatctgctctccaagccctgtgcccatggggttgcatgtattaaagggacaactttttctaattctctcaaaggcacttctggattagtgtaggtcctgatgtggaaacagtagggaagtggtgggactcagggaagacagaaaagccacttcacagaggtggatacccatgcaattaaccatgtgggacttgcggtttactaaaactcgggccaccccaaaccttaccttcaactctgcctgagcttgagaatccaaccataagagtagctctgttagttttaatgattccaaaaggcttttgccgaaatacttctttgttacttaggtgaggcaacccagacctagcatggtagttaagagctgtgtgatcttgggtaagttgcttctcttttctgagtctcagccttttcttctatgaaatgggaaaataacaatccctacttcagaaagttttcataagaaggaaaaaaagagtttaagtgcttagcaaagtatttggcacataatagattcttttttttttttaattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgattcttaatatatgtgagctattattcatgatcaaagtgttgccaaaggcaggggcagtgtgtgactcctgacacagtgctcctaactgtaccctcccttaccagaagggctggagtctccaggaatacagtcttatccctgggggcattcatccccttttccttggctctgcaaggtaacttctgcactcacttctcttcaggctacattggctggcactggggctagtgagcacagtcctggcctcttggagctggaaagggtctcagagggcctctggttttccaaaggccactgtgtgaacaggcttcagatcaggagcataggggtcacttagtaaaatgcagatttcccaaaaccttcctacagagattctgtttcaggaagcctgtgttgaacttggaaatctgtgcttttgactagtgccccagattattcttgtaccttcttcatactccatgcccacaattgtggaatgcaccctgtagggccccaaccacctataccagggataaggaggcaggctgatgggcaggcaggctctggctgtcaaaaggtttgtccccatctaagcccacttcttctacctcccataacttagtgacaacactaggtttgagcttcgaagccacaatacagaaaccagttttctcctttattctcatgtcaccaacagtgacagccatgcacctcacaactgaaaaaagctcctgtctccaaccggccctcttcatgcttcatttctccagactgagcaaccttcccaccctctgtgtaactaattggcttagagatattactgcctcaccagtgggctaggaaactgagctcttgccttcagctttcattgcttttccaggcatggcggagcagtagtaggtggcagctgtgtcccaaaatgtttccattctctctcccttcctccctcctttcttctcttcttctgatcctgtccaagactgacaggcgttatgggagcactgtcattttgctgctttgagtcccccaaaaccaacatgttgaacattgctctatacacatcatacagagggcacattagttttgcttggtgagcacaccctaattgggttcccagagggaaattctaatgccagtgcagagaattaagaaccagccaacagatggggtgagaagcatgatgaggagggtggcagccagggccacatcttctggagtctatatcaaccatgagactgacaggttggatctgggggaagcagctaagctcccagtggaaagattggatcagatggcagaatgaagtcatttttcacaatatttacaaagtaaatatctgcccactcagggatacctttgcagaatatgaaagcagccactttggacctgctattttgttttgttttgtcactttttgagggggtgggggaaggagggtattttcctcctgggttccttggacatagactcaagtcatgaggcccatattcctatccaagatatcccagcctaataatccccagcctgtgggttgcagactccttactgcaagtagtccacaaatccacatgcttcaatgttccatacttttgtaattgggtaactttctgaggtaccttttttttttccgagaaccttctttgaagtctcagttattagtttttctcttttctctaagcaagaattattcccttaatgatctcatccagtccccaaggtttactatcttaatcccttccccccaactctactgccaaaccctctccacctgcagccttcaccatattaacacctttacatcatccttgacacttctctttctctcacatcttacatgcgtctgttagaaaattctgttctactttcaaaacactatgtatccagaatccaactgcttctctctacctttacgttactgctatcatcctagtcggagcaattatccatttattcctggatttatgcagaagtttcctagctgttctccctgctgccacccttgcccttcaaagtttgttcttaacagccaagtgatgctttattctaattgaaatttttattgagctaattgtagattcacatgcagttgtaagaaataatttagagagacccattgacactttgctaagcttcccaaatagcagcattttgcaacactatagtataatatcacaaccaagataccgatacactgatacaaatcactaatttgattctgatttctccagttttactttatacttgtgtgtgtagtaagttctatacaattttatcacgtgtagattcacaaatttagcaccagtcaagatacagaacatttccacaaggatcctttgtgttgctcttttatagccatgcacacaaccctcctgtgcaccccacagtcccatccctaaactctggcaaccactaacctgtcattcatttctaatatttggcatttcataatgttctatgaatgggattatacagtgtgtcaccttttgggattggccttttaaaaaatttagcataattctccaagttgtgtttatcaatagttcattgccttaattgctgagtaatattccaaatattccatggtatattagtttgatagggctgtcataacaaagtaccaaaaactacatggcttaaaacaacaagaatttgttgctctacagctctggaggctagctgtcccaaatcaagtcagctgtctctgaaactgtcatggtagaatacttccttgtcatttcctagctactagtagtggctggcaatctttggcttgcagctgccatcagtccaatctttgcctacattatcacataaccatcttcatgtcatcttccctctgtgcatgtttgtctctgtgtccaaatttcccctctttattttattaaggagaggagggcaagggaacttctgggggaacgagggatcaaagaagaagcttaagtgtctaggttatatcactgagcagcagagactctgaagggtaacagtggcttagagtctttagccctgtggtttgtcttatctctggctaacaggtgttggatgcagttttgtggagtatgcaaagcaggaaggctctaaatgagtaaatatctgtttatttgagctacatttataacaaaagaatgtgtgaaaatttgaccttagtactgatgggcttttgagctaataaatcctggcttgtgaaaaaaataaacaagatagggctaacatacagaggccatctttgactcatttgtataacagtgggtcatatggaaactacatttaatatgttgaagaagtaccaaactgttattcagagtggctacattctcacccgtaatgtatgagtgatccagtttctcctcatccttggcagcatctgatgttgtcactattttttattttagctaagctgatagtagtgtagtgatatatcattgtgattttttttcacatttctttaatcactaataatgttgaatatctttccatgtacttatttgccatctgtatatcatcctcagtgaaatgtctgtttatgtcttttttctattatttaattggattttttaaactgctgagtttgggttactcctatactctaaatattgtcctttctggatatgtggtttgcagatattttctcccactctgtagcttgttgtttcatcctcttaatagggtcctttgcagagaaaaagttttttattttgatgaagtcttatcaattttttccttttataaattgtatttttagtgtcaaatttaataaatccttgtctagccttagaccctgaagattttctcctacttaaaaaacttttttaaaaagttttataattttatgttttacattgaagtccatgatccattttgaacttttataaggtatgaggtttaagttaagggtcatttgttgtctatgaatgtccaatacctctagcaccatttgttacaaagtttatccttcctccagtgatatattttgacaactttgtcaaaaattacttggacacatttgtgtgggtccacttctgagttctctattcagttccattgatctatgtgcctatccctctgccaattccacaaccttgattattgaaggcatatattaaaaccttcatattatttaacatttatttattatttataataatacttagtatttaatatttaatagtaaagctttaatattgggtagattgattatccctactttgtttttctttgtcgagatcattttacatattgtagggcctgcacccatccatataaattttagaataaacttttccatgtctacaaggaaactttgcagatatttttataggaattgcattaaacctgcaaatcatttggagggagaattgacatttttactatgttgaatcttctattccatgagcatgttattccattccaattatttagctattttaaaaatttctttcattttattattttcagcttacagatcctgttcaagttttgttaagtgcatatgtcagtatttcattttatttggagtgattgcaaatgatattttgtttttaatttcagtgtatacatgctcattgttagtatacagaaatgcaatttatttttgtgcattggtcttataaactgaaactttgctgaactacctataatttctaggagtttaaaaaattccctcagatttattacttaggccatcatgtcatctgtaaatagggaaaataggaataattgtgttttttcatttctgatttctaggccttttattccttttgcttgccttaatgcagaggccaggatttccactactaagttgaatgagaaaggcaagagtacatatcctggctttgttctcaattttagaggaaagcattcaatctttcaccgctaagcattgttacctataggtttttttgtaaatgctctttatcaagttctcaatcatataatgagacatactctgttcatggattagaagacttattaggagagttaagatagtaaatatgtcagttctcccccaaatgatctataacttaattcccctcctattcctaattttctaaaactttttatcataaatgggttttgaattttgtcaaacctgttttccacattaattgatataatcatgatttttcttcttgagcctgttggcatgagttataatatttgattttcagttattcaactagtcgtgcatacgtggaataaatctcacttgttataggtgtataattctttttttacattgttagattctgtttgctaacattttgttgagggtttttgcatctagttcatcagagaccttgttctgtagttgctttttttgtattatctttacacggtttttgctatcagggtaataatggcctcataaaatgagttgggaagggttcatccagtttctattttttggaagatgttttgtaaattcggtataaatacttctttaaatgggaggttttctgggaggttttaaattatgaattctttctttgatgattatagggatattcagattgtgtatttcatcttggttgagttttgatagtttgcgctttttgaggagttggtccatttcgtcaaatttgtgtgtattgagttctttgtagcattcctttattctcttttgatgttttcagggtctgtagtgatatcctctgtctgattcctgatatgggtaatttttacattctttcttttttctgtcaattttgctaatggtttgttaattttattggccttttcaatgaaccagctttttgtttcattaatttcatctatttttctgttattaatttcattgatttctattcttgtgtttattatttaatttctcctccctgcttgaatttattattttgtcttcttattccctgaggtaggaacttattgatttgacatattttctcatttctaatataaacatttagtgttataaattaccttctcagtatcactttagctgcttaccacaaattttgatacgttgcattttcattttaattcagttcaaggtattttttaatttacctttagacttcctccttgacccatgggctatttacaaaagtgttgtttagtttccaagtgtttgtttatctttctgttactgatttctggtttgattccactgtggtcagtgaatacattctgtatgatttcaatttttaaaaatttattgagtctcactttatgtaccagaacatggtctgctttggcaaatgttccacagtgtcttgaaaagaatgtgtattctgctgttttggggtgaggttctccacacacatcaattagaccttgttggttgagtgtgtttttcagatattctatatccttgatgatgattttctgtctcgtaactgtgtcaggtgttaataagagggtgttgaattcttcaactataattaaggatttgtctatttctccttttatttctgtccatttttgtttcatacattttgagattctgtattttggtgcatatagggtgatgctttaaaatcctaaattagattatgcttttcctccactacaaaacctcacaatgattccctatttcgggaggctgaggcaggcggatcacgaggtcaggagatcgagaccgtcctggctaacatggtgaaaccccatctctactaaaaccacaaaaaattagccgggcgtggtggcgggcgcctgtggtcccagctacttgggaggctgaggcaggagaatggcgtggacccgcgaggcggagcttgcggtgagccaagatcgcaccactgcactccggcctggacgacagagcaagactccgtctcaaaaaaaaaaaaaaaaaaaaaaaaaagattccctatttcattcagaacaattgatcaagttcttataatattctatagggttctacaagatctggctcccggtaacatctccaacttcatttcccactgttttcccccacacttactctgctgctgccacactggcttccttgaacagaacaggcacactgtctccttcgggcctttactgtaactcttcattctgccaggaatgctcctccaccttggaatgggggtctggggtatagttattgtaaaaattgttagctttacatatcagggaagccaaagcctggagagggtaaacatcaataacaaacagtgtataattggcagagccggtgtattatggagatcaaaaggtgagcctgaagaaaagcagtgagagaaaatgaatgaagagggataaacagcatcagctctggttttaaatataggaagaactgataccccaaattccctcattttaaaacgtctcttccagcagcctggcattagctctgaaattccagcagtatacttttttgggataagcatgtaaaggctattgtaaaggaatcctgcagtataaaactttgtataacagattttgttttagaacaaactttgtatacttagatttcaccaagagattcacaaaattatttgacaatagaacatctccccaaccccatgactgtctcacaaaatccattttggaaaacaatcattgaaagctttgtgtttccagaaaactcctgccaaaaggctaatattattagagagattcacctagtttagtctttccgactctgtgataaattattttatccaattaacttaggagatgcaaactatggcaaaggcctcagtcctcccccgattttgtaaaataaagtttgattggaacatagccatgtccatttatttctgtattgtctgtaactgcttttgcattatcatggcggagttgagtagttgtaacagaaactgcatggtcaggaaagccaaaaatatttactatctaaccctttacacaaaagtttgttgagccccgggtttacccaatagtaaggccctgagatttatctatcgctgcttaacaattgacaacaaaagtttgtggctaaaaacaacaattcattattatctataatggttctgtggattgggcgggctcagctgggaagttctcaatttgcttctttcattcagtgacagtcagagggcaactggagctacagtcatctgagagctaaactgggctaaacattgaaaatggctcacttacatagctggcagttgatgttagatttcagctgggagctcatcaggagctgttgactggaggacctacatgtgcttgctctttttaggttgggtttctcgcagcatggtaggtatgttcccagagggagcgtttcaagagtgtgaagtagataatgccagttgtgttaaatcctaggcttagaactagtgtaatgaaacttctaccttttccagttagtcaaagcactctcatgagttcagacccaagaggacttgaggaataaactctacctctgcacaaggaaagggcaacagcatacatggaaagacataatgacttctgattatgttgaagacaaactaccaccatcttcaatggagaatcagtatgaggtacttgaggagcagggtgcagcaggttttcctggaagggatttttagcgtgaatgaagccaactgtgttttcacccatgcccatttcatagataaatgtattgaggctcagagcattaggagaagctactgaaagtcggtgtctgtgtcacagtgttggcaaggaccttggttagcttgcaggaggtgtgtaactaactccaaagaagagaggggtctagagctaacagactggtatgagggggctgatggaacctgagcctttgaataaagccccttcctttccctaacatttccttaccctctactgctcgctcaggtgtgttagttactatgtaaatatctaggccttacagacaccctagattcctgccactatgccttgtaggcttctgaagtctttttcgtatctagactctgcactccaaataagctgtgaacactttgaacatagagatcacatctacaatttctttcacttctggccctgagatgtctcatatagatgttatatacacagcagataacagaaattggaggattatttgaatcacagctaatttcccagcatagcctgtgtaagtagtattctatggtttggtccctgcacactatactagccttatttttgaattttatccattttcagtaattgtgtttatgccagacattcagtcatacatattcattctgtctctctcttttctctcaatctctctctctctctctctctcacacacacacacacacacacatacacacacacacacacacttctggcctgatgaacacccttcctttccactcacccacaccagtctaccttttttgacatgcatcaggactcagcctgagtgtgttaaagaaaaaatggggggaggagccaagatggccgaataggaacagctccggtctacagctcccagcgtgagcgatgcagaagacgggtgatttctgcatttccatctgaggtaccgggttcatctcactagggagtgccagacagtgggcgcaggccagtgggtgtgcgcaccgtgcgcgagccgaagcagggcgaggcattgcctcactcgggaagtgcaaggggtcagggagttccctttccgagtcaaagaaaggggtgacggacgcacctggaaaatcgggtcactcccacccgaacactgcgcttttccgaggggcttaaaaaacggcgcaccacgagactatatcccacacctggctcggagggtcctacgcccacggaatctcgctgattgctagcacagcaggctgagatcaaactgcaaggcagcagcgaggctcggggaggggagcctgccattgcccaggcttgcttaggtaaacaaagcagccgggaagctcgaactgggtggagcccaccacagctcaaggaggcctgcctgcctctgtaggctccacctctgggggcagggcacagacaaaaagacagcagtaacctctgcagacttaaatgtccctgtctgacagctttgaagagagcagtggttctcccagcacgcagctggagatctgagaacgggcagactacctcctcaagtgggtccctgacccctgacccccgaggagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagtgcctctcctcctccaaaggaacgcagttcctcaccagcaacggaaaaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgactggtgtacctgaaagtgacggggagaatggaaccaagttggaaaacactctgcaggatattatccaggagaacttccccaatctagcaaggcaggtcaatgttcagattcaggaaatacagagaacgccacaaagatactcctcgagaagagcaactccaagacacataattgtcagattcaccaaagttgaagtgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaacactttacagacaagcaaatgctgagagattttgtcaccaccaggcctgccctaaaagagctcctgaaggaagtgctaaacatggaaaggaacaaccagtaccagccgctgcaaaatcatgccaaaatgtaaagaccatcgagaataggaagaaactgcatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctcaaaataaagggatggagaaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccacaccaaatcaacagaatatactttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcaatcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagaggagaatcaaatagacacaataaaaaatgataaaggggatatcaccaccgatcccacagaaatacaaactaccatcagagaatactacaaacacctctatgcaaataaactagaaaatctagaagaaatggataaattccttgacacatacactctcccaagactaaaccaggaagaagttgaatctctgaatagaccaataacaggagctgaaattgtggcaataatcaatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggaaaaaactggaagcattccctttgaaaactggcacaagacagggatgccctctctcactgctcctattcaacatagtgttggaagttctggccagggcaatcaggcaggagaaggaaataaagggtattcagttaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaatagagccctcagaaataacgccgcatacctacaactatctgatctttgacaaacctgagaaaaacaagcaatggggaaaggattccctatttaataaatggtgctgggaaaactggctagccatatgtagaaaactgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattggcaaatggtacctaattaaactaaagagcttctgcacagcaaaagaaactaccatcagagtgaacaggcaacctacaacatgggagaaaattttcgcaacgtactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacgtgaaaaaatgctcatcatcactggccatcagagaaatgcaaatcaaaaccactatgagataccatctcacaccagttagaatggcaatcattaaaaagtcaggaaacaacaggtgctggaaaggatgtggagaaataggaacacttttacactgttggtgggactgtaaactagttcaaccattgtggaagtcagtgtgacgattcctcagggatctagaactagaaataccatttgacccagccatcccattactgggtatatacccaagtgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataataataaaaaaaaagacatatagtttaaaaagacaaaaaatttggattgagaatagacataatcttgatccagtaccttggaagtggccatctctatttcctcacttggtaagaaagcgagaaagacgagagaaggagaaagagaagcaaagagaatggggagaaggaagggagagagaaagaaagaaatcataaatcatagtattataaaaaatgacaaagattgcaaattatctactcaaatttcttttttctttcataacaggatgttaggtaatgttcccagctgaataaaatgacatttcatttctcaaaaaaaaaaaaaaaaaaaagaaaaaatgattcgtgaaaccagttaaagaatggtaaggcagactttattcatgtggactgtagtgatagacctaggtactaccacagtgaggttttgcagtaggcaaaaaggattgagcttaactctgaatacaacaaggaaaagtggagatttatagccgagcagcagtgggatggtcagtggatggaaaattactaagaggaaacatcaggggtcagatgggatcctggctaatctgacctaacaggattcttgctgaagataggccagggtgatcaaacatcacctgaggggtgatggaggttgaagaactcaataagatgttgagggtgatcagatattgaagatggggagttctggctaaaccaatgagcgggatacttgctaaaattgtacaacgcatagaagttcaagagtcaaggcctagttgggaagaggattcatcagagcccgactaaagttggattaaggagaggctctctgtcagttgttacttcttcaaagagatccttactgctctcccaagtacagattaggtacccctcttttgtgttctcacagcaccctgtatttccccttttaatagttattttctcattgttttctaaatataattacttacttgtctatcttcttgatttgactatggtgctggagggcacagactgtctttaacttgtttccctatggatttgcaagaggtctaacacaacaaatggatacactttctcttcagtgatctctaccttatgtctgcaggaaccagttgtttaatgggcagacactgggacagtggacaagaaacgtgtgtccaaaatgtcgtgctggacacgtgcagcccctctgaacaactcttaagagctattgctgatcttgtcccgcaaccctgatcgcaaaaactaaaaggcatctttgtaagtctccatgcatatactgctccattttcccagcctcctactgccaactcagtgagcgctgcatgtggatcacctttccttgcttcaaatcctccaaatacacaagaactgtggcagagcactgggaatgtttgccaactcctgagtttaggaagtctgatctgggctttgtcacaaaaggagaggggtgcggtagctctggggtgccaatcaattgcaagaggacagctaatgttcttgggagatgactggccccctaaggccatttgtcaagcaggatgattatgattaaatataactcaccagtctacaagtggccctcagacagcagaaagtatccagcaggacattgcatgtcacgaagcagcgccagggtagtggacatcaacagttctgtccaattaatccttggaagcacagtcagaattaattgggaacttgttgaaagttgatcgacacctttggaaaggtgaaatccttttctgttcccattaagtgttgttaaggccattagcagaaattggaatagagaaatatgacctttcatgtggtagattcagagactgagaagatggacgagatggaaatgtactggcagcttataataagcacctgggtggggagtgataactaaagattgaaaattgacaaatgggttaaactggcagagatcaagacagagagggatggggtgcagtttgcatgcagaggtggtgagagaaaggaatgagagcatcaataatccagcagggtcgcccatgctgagggtcagatatggattactcagaaggtaggcaaaatttgctaggtgggagagtagggagatttggttacaagatgaagagatcaatttatagctgttgagaggagtaaatgatctagtcctccccagggagttaggataccacagataaatactccagactaaaatcaggaggtctgagacatttgtttattcagttgcaaagtgactgaatgtctccaaccctccccttcccacagttggttatgtccttccaagtgactaacgtgaaatttctttgaaagccatcaagctatacagatgtaaggaattatcatcataatcatccaactgaatcaagtgcaaaagaatattgctataaggaaatatgtgagattttaattatttcctctgatggagtagaacatgtttgcagataatcttgaacagcaacagtgcccgaatgatttatcttgggctttacagccacacatcatgatattttgatggaggaaggtccggagttgtgggatgtgcatcaacatgcaattttccctgacattttgcattggctcagattatgaagccctgacagtgggaagaaatggaccaccagaaagtagttcttaaattaccaggagcgctgtttgctgcagagacactccagaatcttcaagttaggcgcagcacgtgagagttggcagttttccacccaccgacctgagttgctgtggttagatgagggctttcttgcaggatccaccagaggctgaggctttgggtcacagttatcattagaatgttgtctctttgccaggtcctatgctaagcattttacctgcaccatctcatttaatcatcaaaactactctgtggagttagatactattattgtcttcattttacagataagggaacaggattaaaaagattagtaacttatccaaggtcacatcactagcaaaagacaaaacttggtattaaactcaggcattagctccagagcctgtgcacggaactgccatacaatactgccatgcgcatatatgaataagcctgagaatctgagaaagaaggagatgtgacctacctaaggccactcaactagttagttgtcccatataccatttgtttttgttgttggaccagatctagtatgctcacagcaaatgaagaattttaaaatttccattttatagatgtagctcagttctagtaataatgatgatgacagtaacgacaacagcagtggcaactaatatttactaaacatctgtttttgctgagcaccgtaatagctactttatgtatacactcatttattcatttattgaaaaaatgtttattgagagccttctatacacaaacaagtgtgttcacacaaaagcttgtacacaagtcgtttacagcagtattgttcataatagcctaaaggtggaaaaattccaaatgtccatcaactaatgaatgaatacatgaaatctggtatattcatgcactagaatataatacagccataaaaagaatgaaatactgatacatgctacaacaaggatgaaccctgaaaacattatgctaagtgaaagaagtgagacacaaaaagccatatgtagtatgattcaatttatatgaaatatccagaataggcaaatttatatagagacaatgaatagattagtgatttccaggatctggggggaaggggcaatgggagtgattgctaatgggtaggggcttcttttcagatgtgacgaaaatgtcctaaaattgattgtggtgatggctacacgtttctgtgaatatactaaaatctattaaattttagactttaaaattgtgtggtatgtgaattatatatcaataaagctgctaaaaaaagagccatttcatatgtcatctcctttgtctagcctttcctgagatcctagacagggtagtcccttcttctgaattcctctatcaccatgtacacacctctgccatagcacttctacccctgtataaaattgtctacttacgtgaccttatacttggctctagaagctccccaaggtcaaggaacatgttttatctatttcctacctcttacaatgtttccctgtcctgcctccacccttttttcctcccttaatctctcttcccctcccttccttcttttttcaacccaaatttttgttgagcatctactgagtgcaaaggcactgtgctaggtatttgggactacagcagtgactaaagcatggtccttgtcctagtgcacttacagtctaataaggaagatagacattaaacgtacatgataagtgttagggaataaaattgtttaactgggaagtctgacctaatctgaggaattagggaagaaatctctcatgatgtgttattttacctgaaacttgaatgactagtacaaattagttgtgggggtagagaaacagcatagggaatgtattgaggctggaaaaagattgacaccatggaaaaagtgaagggagggcagtctggctgaaatggtagaaatgaaggtgtcaggggagtggagtaggtcatggctaacataagacttgagaggaaggtaaaggctttgttggccagactaaaggatttacactttgttccacagatggtttttaagtgtgtgtgtgtatttttcaaatgctcattgcagctgttcacttggagaatgtattggagagagcacaagtattacattagaataatccaggcaagtaacaatggtgagtagggtaactgcaaggggtgttgagaaatgtgaatgagaagggtttgggtcataatatcagaagacacaatcccaaaagccataatcccaatgttgaaatcttgaaagaccacaatctctgaagtctataaaatctcaaaaatcacattgccaaaagatcaaaatcctgaaaagataattctgggggaaataattttaaaattattttaaatacatttatttacattttaaagggtgatttatttgagaaacacatgaaatcatgacagaacacttcataggctggccactttacacaataaaatgggcaaaaataacgtgtatatttttgcaaacataaacattcaggtacactaacagtagtcacatgggtataaaagttatgagaagatgaaccgtattcataaagagatcaaaaagcaaaatacataaatgcatattactatagttagtaattgttttcacccagctttataactgtggtcttctgaaatactataagggacagcataagtcttgacaagatcattcaaaaactgccatgggtcaccaccgcatatagttacccaaaaagctgagatctcaagaaattttacctttcacaaatgcatatatacaaaaagggcatctcttcatttattgaggaagtttcaatgttttcacatacatacacaatgcttatacacaaagtcagggttgtgataatgcagttttgtggagtcaaatttgcaaaaaaaatgcatacaacacattaaaactctctaaaatctttacacaattatactttcagtattagaaatgatgcaaatatgaaatacatagtatggtgaattggcactgtgtgagaagggacacaagtcatacataattgaataatctgacaaagcagatttcttgtatttttttgcctgcattttcacttctacgatctctgaaacacttgttgcacttgtatttagagagtggttgtggcctatgcatttcctaagtatatgctgtccacttaaagtctgataattgctcagctgttgaaattattttctgcttttgcagcaccaatagtaattcgcttttaaacttttatctttcaccattaagtagccttgtatacttctcacggcctttttgcaaaggatcattttttttcaggtctcttctattgtgtcataaggagtacagtaagaaggaatgacatttagctcccccaatactaaatctgtattagtcagggttctccagagggacagaaccgatgggatacatatataaatacttgagagagaattcattaggggaactgacacccacatgtatctccttaaatcacacttaatttccaaataaagacaataacaaggtaatagttccacctaacatgatgcaagtatcctatatacaaccaaaaattcactaatctcttccctagaattcagctttcagggtttcagtatttggcattttaatctttcaggattataattttcaggcttttagatgttagggtttttagattttaggaattttgatcttttgggattccaacattcggaattatggcatttggaattgtgtccttcaggattatgacgatactgtgtaataggtacaatcaatcagtttagtgtttggtaggatatggggagtcagcaaggcctccagaaagattcctagatatctaggtggggcaactcggtgaaaatgatgccattaatttcaatagagaatacaggggaagaggtagggttgggagttatgtggaagtaaggttgtttttttgttttgtttttgatgtggtgacatggaggtacctattggcaattcaggtagagaggttcaacaagaatcagttgatgtatatggagtgcaggaaagatcatgtgtgagctggagttatagatttcagagttgttaacaagtaaatggtaattgaagccatggacctagcttattcatctttgtatttcccacagtacctggggtggtgtctgacacaaagtatttgttgaatatgaagtaagaagatgtcaaccataatccccttcaaagggatggtacatataggactccaggttggtgtgcacagcagatacacattaagagctaatgtttcttgagcccatactatgcatcagtcactttctaagcctcatgtcttaattgtctcagtaacactatggggtaagtattagcactatctctattgttcaaaaggggaaatggagacacgaggaggtcacacagcaagtggtagagttaggatttgaatccagacagtccgagtgtagaacctattattttaaccactgaggtatatttccactctagtacttgaggcctaagttattggtttgttaattggtcagtgtaggctgctgttcatggttgaaaattccttttcatgtctttctccttctctctgggtagcacttttatccctattctcctgacatttttgtgcttgcctcccaatccagcccattgttactgggataactagattatcacattcaaaggaatgaagttagaccttgcagtggtttgaatgtgtcccccaaaaagcatgtgttggaaacttaatccctaatgcaacaaaattgggaggtggagcctaatggaagatatttagatcatgagggtggagcccttatgaatggattaatgctaattataaaaggggttaaggctgtaagtttgatctcttgctttctctcgccttgtcctgctcttccactttctgtcatgggatgatacagcaagaaagcttttgccagatgtcagccccatgatcttggacttcctagctctcagatctgtgaggaaataaatttctattatttataaatgatctactttgtagtattctgttatagcagcacaaaatggaccaggacagacctctaccacacactatacataaaaattaactcaagataaattaaatgcttttatgcaacagctaaaaagataaaactcttaggagaaaacgtagatgtaatcatcattcttatgaatgtcaagtccattttccccagcaccatttgttgaaaggactattattttatttagttgtcttggcatccttgtcaaaagcttttcaaagtccctatgaatatctcactccctagttttaacttttaagatttttggtcactctattgtttgcctcaactgttactcaccatcttatgcagcagcagcgctaataaattgcttggaattgtttttgataaatgctcccaggtggaaggctttcacactgggagagtgctgaatcaggttaaatacagacaaccttacaagtggcatttcctgggaaccaccagacaggttgaataatgacaattctttgggaataattattggaaagagttccagctcctttcggctctctctggtgtctgtcaggatgttggttttcaccatgaatgcagattatgatttttcaagcctactgttgtgctagagtgtagggaattggactaggacaagtaaaaacaccacaatctcactcttcttactgagattcagccatttttcttgaataaatgcacctcagattgctggaaactcttggataatttctagagttctgaaaaatttgcttctgacaatttttgctagttttcccattacttttatggagaagaggagttttggagattcctactctgcaatttttcccctttactttttcaaacatggtttcctttagttctttaaacacatttctgatggcagctttagaatctttgtcaaatccaacatctgggcccactcacagattgtttctgttgcctgcttttgttccatacatatgattgactttcttctgtttctttagttgtctcctatttattttttgttgaaaattgggcattttaggtaacatcttgcagcaactagatattgatttcccttctctctctccgaggcttctttttgccattatttgcttgtttagtgacttgattaaactattttagtgaaatcaatttctccctcagtgtgaagtcttcagtgttgatcttcagagagcacagccttgggcacgtgcaccatcaccctaggatgccagtggttttattgcagctctctttctccatctctctgtcaagctatgtgcattgtttggaatcatacccagctgcgaagtttcactacttgctgggtgattgctttattgtttttgacaaagtcctgggatataaattgtttcacagataaatccaattaaatctaggacccttttcacagatagtacttgaggcaagtctttgaggtttgttcagatctcaggagggttcatctttgctgtctccttctctggttctctctggtgagctagtttgcctatgttttaagtggttgatcttaattaagagaattctcagcctcttcttaattgcttaccaccaaatatccattgtttttgaaagtgcccttaggtttgaacttctccagtctgtttcaaataaagttatttactttagggagagcttcagagctgtctgtccttatgacctgcctctgctgctgagccaaaatctgtgagccacaactccagagctgggtgcaaggacagtggcccacttttcttggaatgatattcatgctttatgacgaggctgtttggcaggggcagtagactcaggttttctcagcttggctctcccagaattgaacctctgccctatgagtgagatggggcaaggacaattagtgcctcagtattcttatcctttcatacctgggggtagagcctctgccctatgattgtgtctgggtggagaaaggaatacatcagcatttttcttggctacactcatctctgcaactcatggtgaagtggtggggggtgatgataaatactggtggcttgccctcctgtgagatattgagtcacttgaccgggagctgaagggagaggaagccttgtcatcttggccttatgtacccagaatgaagtttctttcatgcttagctggggaggggagatggaaggaatgggttatggctcaagtgcaacaaactcttactgttcttgtcaagatttagtagattttcttaaataaatatttcctcacttgcagtcttgccttaggacaattttgagagacttttaaatggttgttcgtttttaaaataacttttatcagttatacttgttttactcgcaagtgaatatcttcattgtcatatacttttttgatgcctgcttttctctatagcctgaggaagattctgaattccagaaaatcaccatttgcagttgtcaatgctataatacattgtgcctgtataatatcatccctagacaaagttcccaaatagatattaagttcttagaggagaaggactggatttaatacaaccatgacaccctgtatacttaatgggcccaaagaattcatctaaagaatgatgcacaaatagataactatagcttctatttaaaaatgacctcaacaatggagcataactcccaccccttaagtctaggcactgtgtagtaactttccattcattatggaaaggggagaaagagcaaccttacaatggacaaacttgacaaacattatctcaagctagttgatcaaggttaacaacaatagtgacatgttatattaatagtgtatactcgtgatatgatgtgaatgagaatgtcgcttgacctctgaggtcctcctgccaaaaacacattaccccagtttggtcatgaaaaaaatatcagacaagtctcaattgagggacattctgcaaaatacctaaccatcactactcaaaacttgtaaggtcatcaaaaacaagaagtgactaaaaaaaccatcacagccaagaggaacttaaggagatattatggtcaaatgtgatgtggtatcctggattggatcctggaactgaaaaaggacagtaggtaaaaactaaggaaatataaattaagcatggactttagttaattataatgcattattaatatcagttcactaattatgacaaatgtaccatactaatgtaagatgttaataataggggaaacaggatgttgggtatatgggagctccttatactatcttaccagcttttaccaaaaacagttctagaataaaaatagtttatttggaaaaaccaaaaacaaaacaacaaacctctactacaatgaggcaggctttgtgctgagcagaaaaatactcagtcgacctgagagtctgtttttcttgagatcccttgtggagtggggcccatggagacccagagaaaaaggtagctagggtagaatcagaactctgtgtttttttggcccaatagtttctttcctatgaatctctcttaaggaaacagccagatgaatacacaaaaatgtccatgccaagtatggttactgcagagtgaaatactgcaacatcctaaatgtccacactggggcggtatctcactatgtttgttctatagagcatcagtccaataaaatgctccgcatatacaaacaggaaacgctgcgtgctatattcccgtcgagagtccaatatacattagtgtaataaggctctgagatgagtcatgctaaaaaaaatgtaaagttctgttagaaacagggtttgaaactcacaactatggatcattttttatactttttttttttttaaacaaacgctactaatgtcttcacactttgtaaattgttacactaaaggttgggttatatagattatgaaatatgtttctattggaatattatatagcaattagtgaaatcatacttttataggactaatgaattgagaaaagtcacaattttaaataaggaaaacgagatacacatttgtatatacaatataatcttaattatttaatgttttctgtacataagaaaaggacaattaaaaactacaaatggttatcgctgggttgtgtagttacaggtgattttaaatttcttctttatagtcctttaatttcatagtggtctacaaagtaaatatattatttaaataatcagaaaagaaaacacatcataaagcaatattttgtaagctaaatcattcctacccctcatgcactctaaacttatttgctttttgttataaaaaagtatttgtcagaatttttttgaaaaagccagattatataagctcgggaaagggaacggcagaatgtcttagatgggcttgatttaactagtggagcattataaaaatagagcatttctctcttatggccagcaaggagatggccacagtaacctgaaggaacgagcagtccaggctgctaaactgttgctattttttggctaatgctggactgtgatgcccttctttggctaaagctgtactgtaccatctgagatggcatttccttacagataaatgttcttcttcttgattaaggaatgaacacacaaggcttcagcctaattccccatgtcaaaatgacctccagaggacagatacttcatcttcttgtttgtgtgcaggaattcctttcaggttcctcctatgagactcctacactaatgcaaaaatttctgctctttctcaggtggctggaaggggaagggctgagctggccactttcagtgcctctctgtgcagaaactctgtggcacttaccaatgtctggctggcctgggattgagcactagcatgtgcagggtaggaattgctggataaataacctgaaatgcattttcgggtaatcagtttcattcgtagaaactgcattcagccaatttgcaatgttatatgatatcatatgatatggtatgacatgtctgagaataaagtgcaagatgctggagaatgagggaagctcagtaataatcctagttttgctaccaattctttgtgtgatctttgaccattgcttcccctcactgggcctcagttccgccaaatataaaacaagtggtcggtctatgaaattggtttcctgattcagctataataaaacttaaactcctttacatgaaccccagggccttgcatgatcaggcctcttgtctccctctttgccttcatcacccactagtttctcccttacactattccaaccatacctcaggacctttgcactatctctttcctctgcctggaagactatctcccaatatctgtctctggttttgtacctgggtgttagctaaatgtcacctcctaataaaggccttccctgactagctgctatagttatggattgtttgtccccaccaaaactcacattgaaatttgatacccaaagaggcagagttgagaggtggggcctagagggaggtgtgtgggtcgtggcggcagatctctcatgaatggcttagtgttgttttcacagtagtgagtgagttcttgctcttgcaagactgtattagttcccacaggaatggattagtttccccaagagtggattgttgtaaagcctggatgcccttcaggttttccctctcatgtctgcttcccctttgaccttcccaaccatgttatgacatagcatgcaaggtattgctagaagccagggtcatgcctttgaactacccagcctgcagaactgtgagataactgaacctcttttctttataaattacccaatctaaggtattatggtacagtaacgctaaatggactaagacaccaccttatggaatggtgccctgtgccttttcccccattactctctttcctattaccttgtttcatttccttcctggaaatcattactttaatatttgtcttatttattttattgctggcctatttactgtttgtcttcccccactagactctgtagggaatcttgttgattttattcatttctacatcctttctgactagaaagatgactggcacagagtaggtaattgatagatctatgtggaatgattgaggaggcacctgacatttgcttacttaacaaacactctgtgccaatctttctatactgctttgcaaatttcaatttatttaattttcataacattcctatatatgaggtagacactactatttttcccactttagagataaggaaactgaggcagagagaagctaagtaatttgcccacggttatactgtagtttacattaattgtgtcttctaatcctaccaacaatcctacaaagtacatattatttttacttcattttatagacaagaaaaccaagacttagaaaagtgaagcaactgggtaggtgacaaagaagttgcttgaatccagagtgtctgactccagaacgctgcttactcaagactgtcacataactgacctatgtgatctttcttttttaaaatatgtttttatttcaataacttttgtggcacaagtggttttgggttgcaagaatgagttatatagtggtgaattgtgagattttagtgcactcgtcacccaagtagcgtacattgtacccaatatgtggttttttatcttcgcccccactctcccccttctgagtctccaaagtccattataccactctgtgtgcctttatgtatccatagcttagctcctacttataagtgagaacatgcggtaactggctttctattcctaagttacttcacttagaataatggcctccagttccatccaagttgctacaaaagacattacttttgttcctttctaaggctgagtagtattccatggtgtatatataccacattttctttatccactcaatgattgataggcacttaggttggttccatatctttgcaattgtgaattaggctgcaataaatatacatgtgcaggtgtctttctatacaaggcctgaaggttagataaggcagatattgggtccacagaggtcatgtagcagacagagctgtattgagttgagaggctggttttcagggaaactgtggttatgggagggggagcccttttgcccacctcacccagagtacatgctggagtgggctgggcctctttccaaagctggctacatcctgcctcccactggagacagttccgttaaggggccaggccaaagggacgttgctagggccgaaggagcctaagtcccagaaagaattgttgagacaccctgaaaccttctctgctccagggacaaccatgaccactctcagcttgtacatccagctggagaaacatcatagaggcctaggaaaggtacaggagagatccagaggtaaggccaatggctgggattgcagtgtgtctgctctagacacactgacaaactagaatcattggccactctggaaaaacttataactgcacagataacaaaaagataactccacccactgagcagacccatggactggtctggatggtcaggctagaccctggccagcccaaacaagccacatagtctagagaatgtattttctatctgtttatcttcccttttcccccattgttctgcacaggaccaccacactgcataaatccagagtatgtcatttcatttcatagtatatgtaaatactgcccctggagttgtgagtaatgtgtatggtggttctggtgctacagttcacttgtgtgtctttctgtgagtccattcttatttatcatgttcagctacagtggctacctccctcaaaccagtggtgtgcagtggcaaatgggcatatgaaaagttgctcaacatcagctgggtgtggtggctcacgcctgtaatcccagcactttgggaggacgaggcaggcagatcacttgaggtcaggagtttgagaccagcctcgccaacatggcgaaaccgcatctctactgaaaatacaaaaattagcctgccacggtggcaggcgcctgtgaacccagctacttgggaggctgaggcaggagaatcgcttgaactcgggaggcagaggttgcagtgagccaagatcggaccactgctcaacatcattgatcactggagcaatggaaatcaaaactacaatgagatgtcatctcaccccagttaaaatggcttatatccaaaagacaggcagtaacaaatgctgacgaggatgtggataaaacggaacctttgtacactgttggtgggaatgaaaattagcacagccactgtgtagaacagtttggaggttcctcagaaaactaagcctagagcgacaatatgattcagcaatcccactgctgggtatgcacccaaaagaaaggaattcagtatattgaagagatatctgcactcctatgtttgttgcagcactgtttacagtagctaatatttggaagcaacctaagtgtccatcaacaatgaatggataaagaaaatgtggcacatatacacaataaagtactattcagccataaaaaaaatgagatcctatcatttgcaacaacatgggtagaactagagatcataatgttaagtgaaataagccaaacacagaaagacaaacatcacatgttctcacttatttgtgggatctaaaaatcaaaacaatggaactcatggaaagagtagaaggatggttaacagaggctgcaaagggtagtgagagggtggagggaggtggggatggttaataagtacaaaaaatagaaagaatcaataagacctactattggattgcacaacagggcaactatagtcaataataactgtacatttttaaataacggaaagagtgtaattggattgtttgtaactcaaaggataaatgcttgaggggatggataccccattctccatgatgtgcttatttcacattgcatgcctgtatcacaacatctcatgcaccccataaatatgtacacccacaaaaattaaaaatgaaaacatttaaaagtggtctctaatatttagctaggttgaataatgaggctttttttctgtattttttcagccaatatgtgtgccaagcatccagtgatcatgagaaaatgaagccttttaatttataaatgttgatactgacagattgtagttatgagactgtaagcctttctgatcatttattttcttattgtttgaaaaattaatcacagaacttccctattaggtgtactgttgagtatgtttattggaaaattaataagtgcataaagacatttatagccttgtgtgtgtttctgagtctaccacaggtgcagaagttttacagaaattgctttctcatttccaaatccatcttttgtcatggagagactgctctttcaggaatctgatcgctcagaagtttgatcatcaggctcactagggattgcatctgaaaagaataagattgttaattgtatttacaatgaaatgtctaaataaataaagaaagccctttaacatttgattaataactattaagatctgctgaaacaggatgttatgctggatgcagctggttatgaatcacagcagtgcaagagtgttttatacatattatctcttattttcccaatgcccctgaaaggaaggagtgatgatttccattcacagatgagaaaccaaaggatcagaggaaggaagtgacttgcctaagatcccagagttggtaagtagtagagccagcagttaaatatttctggtacacgtcgatttcataaccttaaagaccatataaacccaaattagaatgctgtgctagaatagatacaaaattatctttaattcaaattcttctgatttgtgggtggcatttctaaactttctttactttcctgtcctagagataccaggacagaggggagtcccagagagtagcccttaacattttgagacactagggcatccagaacttgctgaagatgagaggcagagtgagaggggaaggtggcacagggataggtgctgagccagtgtggaagacccctggaacacaacaggacatattgatattaccgccagctgttcatcaacagctgttcatcagagaagggagtcctgtggcttggtgcttttcttgggcagaactgacttgggctttgacttctgttcttccttcaaatttccctgtagaaatagacttgggtctaagtcttagctctgccatcccctctggctgtggaatctcaaacaagtcaaccactctgacctttagttccttgtctgggttgatgtgaagattaagctagcatctagtacagtgcctcgctcacactaagctctccataatgaatatacttcttattcctattgtgctctcacatttccaccccagacaccccaacacttttctcagcgttcattttccacttgaaatgagcatggagccctgaggaatgtctgtgtgtcttccagatggtgctagcccccactcccatccctactgccttcaggtttcagggcagcatgtctgtgtagatctgtatcttgctctattttaccaggtctaggcctgcctgtctctttgctttgatccctccatacacacgcatatacctatactatgcccaggtcaaagtggcattgacatggaaaagagtgaagaccctatctcaaccagactagaatcctgaccctgacttaaacactgacacagcccctaacctaaaaaaggggaaggatttcattgaaggaccaaaggaaagatatacaaaagtctactttagagatctcctgccctacttcatacctgtaccatgtctcaacctgttggtatagcatttttatcactgccaaagtgtacaaagtctcagttataaaatgaataaattctgggaactgaatatgcagcatgattatgatagttaacaatactgtatttgtatacttgaaatttgctgagagaggtgatcgtaaatgctctcgccacacaaaaaaaggtaactttgtgaggtaatgaatgtgttaaccaatttgattatagtaatcattttgcaatatgcagtcagcccttcattatctgtgggttccttatctatggattcagtcaaaccaggatttaaaatattttttaaaaaatatatggttgcagctgtactaaacatgtacagactttttgtcttgtcattattccctaaacaatgtggtataacaactatttatgtagcatttatgctggattaggtattacaagtaatctggagatgatttaaagtatccaccaggatgttcataggttatatgcaaataccacaccattttataacagggacttcggcattcatgaattttagtatccacggggagtcatgaattttggtaaccatagggagtcttggagccaatcccccatggacactgagggacaagtgtatatgtacatcaaatcctcatgttctgtaccttaaatttatacatctttatttgtcaattatatataaaactggggggaaaagcatcaactctggaatcagacaaataccagttcaaagcctggcttggctgttcatctgtgtgactctgggcacattttttaacttctctgagtctcaagtggcttgccagttaatggaaataatacttagccctagttcattcatctattcaacaatgtttatcaagcccctgactacatgacaggcactgtgctaggcattgggaatatgatgatgagaggggagataaacatgaataagaacacccataaatgtaaaattgcgactgttcaaagtagtgacaaaggtacatggtattatgagctggtatctgacctaaacagagaagtaaaattgacaggacttgcttggtgatggattgaacttggaagacaagctggaggaaggagtcaggaaccattctttgctttctggatggcaacaggtgccattcaccaggaccagcagcagtggaacagggccaggtttggggaatagttatggctggtgggggatacacatgtgtgtattgactaaaagtccttactaggcgtcagggacagtttcctatttgtctcatttaattaaatcatgatggcagcttcattaggagaatgactattcgcattttccaggagtggaaacagactcagaggattgaagtgacttgtcttggatcttacagctagttagtggcagatccgggactaactttcattctgtagcccaaacacatgctttttccaatacttcaccctatgggacccagcaaagcctgcaggggaagggaaggctggcaggccaagggcagggactccaagaaggcagaaagggtggtgggagtagaatgaaggaaaggggaacagaaggaaaaagaactgtggcaaaggcaggaggaattctctacagtgacttaagatttattatttggagacaggttgagcaggccaaactgaggttcatatttcacaggcctactgccgcctcctaccaaattttggctctgaaccctgaggaggtggcggggagggaaacaaatgaggaggcagtttatgaagtggcttaaggcccagggctaaatttgaaattaacatggagatttcagtcagaggagtcaagtttccagggccgtggctatgcccagcagctggggccccaggagggatagaaagctgaccattcctggctagtgctttggccccaaccttcctgtcacctgctccatgctcctggcgttctaggaagcaatgagagtcactcttttagcttgtggcttctcctgccatcagaagcaggcttctgggcaccgatgtaggacaaggacaaagggagctgggtgtgagaaagggctgggaagtaggtttaggcagatggagctgatgtctgccttcctcctccagttgttgcttggcttccccaaaccaatgtcctcctcacctgagcttcttacttagccctgttctagtttctttcctttggggcctgcctgagatagatacaagcacaaaggcaggggatcaccaatataacttcacggggtatacatcatcacctcagtattagggttcctatatcctttctgggtgatacattaggaatctactaagccagagtttcctctgggttctgacaacctgtgggagtatgggatattcttagaggttcgagagttttctgtgataattttaaaattgtgggatgtttttcctgtggttttctcttggatatatttaaggtatacaacgcgatgttttgacatacatctacatagtgcaattgttactattgtgaagcaaattaacatatctaatatttcacagtttttttgtagcaagaatacctaaaatctactttgttagcaaatttccagtatacaatacaatattactaactgtagtcctcatgctatacattagcttgctagactccttcatcctacataactgcaactttgtgccctctaacctacatctcccaatctcctctctctgctgcccatggtaactagtgttctactctatttctatatattcagcttttttttgatcccacatataagtgcaatcatgcagtatttttatatctgtttctggcccatttcacttagcataatgtcctccaggttcatccatgttgttccaaatgacagtatctccttattttttaaggctgaataatattccattatatatatacacacacacacacacacacacacacacacacacacacacacgcacacacacacacacaccccagaattttttttccttttttgagttataattatgtttaacttttattttaagttcacgggtacatgtgcaggttctttacagaggtaaacttgtgtcatgggggtttgggagtttgttgtacagattattttgtcacccagttgttaagcctgatacccattagttatttttctgatcctctccctcctccaactctctaccctctgataggccccagtgtgtgttgttcccctctatgtgtctatgtgttctcatcatttagctcccaattataagtgagaacatgcagtatttggtttgctgttccaatgtctttatttatctattgatggtcacttaggttgattccatatcttggctattgtcaataatgctgcaaagaacataggagtgcagatatctcttcaatatacacatttcacttactttgggtatatacccagtagtgggattgctggatcatatggtagttctattttcaatttttttgaggaatgcctgtacttccataatggctgcaccagttaaaattgtgtttttatcacaattaaagtctaaaccgaatgatataagcctattctgtatcatccatctgcaaggccaccttatagctaaagggcaaccataggatttctggactctcatttacatctgcctccatgtattaggatcagattaggctgcatgtaacagaaaaaaatccaaaataatactggtataaacaagatagaagatgaattctgcatcatgtccaaaaagttcaaagataagctgtgcaggtttggtgtggcagctccatgttgttaggtaccacatatcctcccagatctccactatgctgttctgaagccatggccgtcattctcgtgatgcaagctgatagccatagctccaactaatacttgctcattccaagcagtaagatgggggaaagggcaaggaaggaccagcccccttcccttttagaagatccccaagaaatcaccaataacacttccacttgtatctcattgaccagaacttggtggtatggctacaatggaggccatggaatatagtatgtgttttagttgagcacattaggagagaaaggggtgagtagtgggatggataactagcaatctctgccacatttttgtgtaaaagaactcattaccttcacaatgtcctacttgcattgtcaaggactaatgaggaaagaacataggaggacttaatacataaatgatggcttagtcccagtgaaggccaaatgatgtccctcagggctacaggaatgacaggttagcaatagatctgatggggaaaaaagtggtgcgagagctgagtcattgcctggctcacagtaatatagcacgacgaactcaaaagaacctgtattgcagtcagcaccatagtcacgatctgaacagcaatttaattttagcaaaacaacatcatccaccttgttaaaaagaactgttgttcatttgatttttattggttttgtggttttgtttacatttcatttggaactttgtttcagctttataattgtatatcagccataagcatagggagttagcagcttattttctctttgtacccagtttaacaccgtaatgaagatgactcaataattgcgatccatatatatatatatatatatatatatatatatatatatatatttcttttgaaaggggctggctactcagctgggaaatgcttcctgaaaccactggggaccactgtaacaaacaggactgtaggagttagaacccaaactaaggcggggttcttttcacaccaccaccccagtgctggtgaggaggaggtagaattgtgctgcaaaacaggtgttgaacctagacgtagcatatgatcagaggagtctaacattggaagtgctcataaaagtcacatggcatgcctcctgatggaagcttgagcctctctataagccaagtgcctgggtcagtgggtgaggatgaggttggtggtttaagatgacataatggaacattttgaggggaaggatgattcaagcattatgtccctgacaaccaagattccttgggatagtttttgagtatattcatgtgaacatttgataagcagaaaggatcctggggtcaaatatatgaaaatgtataccctcccttggtaacctcattccacttccctgaccatctgccaccgcccaacttggcctggatgatgcccatccaggctctttcactgcattgcaacctagagggcagcctgtttatcatgggggagaggggctgcaagggatggtagggcctcttttgacactggggagttggggtgtgggaggtgtttccaaaagacttgtttcaggccacttatagatgcagggaaggaaagctctttctctctccttctgtggcagcagtaaatcttcctagccccagccactgccaccatcctcaagcactttcttggattctccacctgttgtgagggaattccacagggctcaagatatcctgaaaaccaaataccacatgttctcacttataagtgggagctaaacattggatgcacatggacataaagatggcaacagtagacactaggactactagaggtgggagagagggaggggagcaagggctgcaaaactattgggtactatgcccactacctaggtgatgggttcaatcaaaccccaaacctcagcatcacgtaatatgcccatgtaacaaagctccacaggtacccactgaatctaaagtaaatgttggaagaaaaagaaattttgagaaaggctcttctatcaggatgaaagaagaatcagtgaggggggcatacgatatagagagcaagacagactaaaagagaaagttatttatagaaaaagatggcatatgtgcatacatatatacatgtatatatacacatatgtacacatatacatatatacacatatgtacatatatacatatatacacatatatgtacatatatacacatatacacacatacatatacacacatatacactatatgtgtgtatatgtatatatacagatatacgtatatatacgtatatctgtatatatacatatatgtatatctgtatatatacatatatagtgtatatgtgtgtgtgtatatatatatatatatagatatgcagagatagagatggagagaaggggagatatttattaagagagaaatggagaaacatgaaaaaaagaaccaaagagaaagaagtggaaggggagaaaagaggagagagaataaagagtaagagaaaaaatttaaaagacacatttaaatgtatagaaaagtcaagtacaaggcaagaaagggctttaggcctctgtgttgcctcaagtatcaggaaaaaggatgacaggaggaaatgctgtcatcgagtctgtgctatgcctactgcatggggagaacttcaccagcctgatgctctctccaggaagcttccagtccaaaaggacctgtcgatgagccactgaatttacaggcagcaggacagtggaagagaagaattcataacaagccacagcatacacagtatctggaagagctcagaaaagggccaaagttaactttgagacaaggtggttggaaagaatagccagtacatgtacagacaatgtctgtcatttggagaatccacgctgtgactaaaccaaggaagagtttctagagcagaaggtaatttctagggctgtgggaatgggatgttaggccactggggtgggccaacagccacgcacaatcaaccatgcggaaattcttgctgaagactgattcccagatttctccagcctcctgcccacccctactccctcagactcagtagctggcctctcttctttcacagagaacgtgaaagctatcaggtggaccaccacccccggcaccctctactcacacttacttctccttttttttaaaattcacaaataataatagtatatgtaatacatatggggtacaatatgatgtgatgatacatgtatatattgtagaatgattaagtcaaactaatttttcataatatggaaacaatctaagtgcccatgaatgaataaatggattaaaaaatgtcacacacacacacacacacacacacacacgagtatttttcagtcaaaaaataaggaaatcttgtcactcgcaacaacgtggatgaacgtgaaggacattatgctaagtgaaataagccaggcacagaaagacaaaaccacatgattttacttatatgtggaatctaaaaaagttgaactcatagaagtagagagtagaatgggagctaccaggggctggagtagggggtggacagggaaagggaagatgtgaataagagggtacaaagtttcaattagacaggaggaagaagaagttctagtgatctactgcacagcatgctcactatagttagtaatcatgtattatacatttcaaaattgctgaaagagtggattttaagtgttctcaccataaagaaaggataagtatgtgaggtgatggatgtgttaattagcctgacttaatcattctacatctccttttattatttctcttttccctccgggctctacacactgtcccctagccattctttattcaccattacatgctgaatattccagacttagatggcgtagtctctgaaaagggtgtattaacacatgccataccattttatccccagagcaattttctgagttgggtatcataataccaattttaaagatgaagaaactgaaactcagagaggttaggcaacttagccaagatcacacagcaaggctgaggtttaaacttagacatcccaggctactcagcccattctccttcactgtgccagacaggatcccaggtacactgaagaaaatacttgataaatgaaattctacccatttgggacctactagagccagggtgagggggctgcacaatgcagttctgaggaaataatctttgtgggaacaagattaaaatgtcaggctgatgtgcccactggctgagctatcagaagtgaggagagaacaagcaataaaaattaatagtgcaaggacaagttaatttaaaaacccctgcacatgtatctggaaatattgcacgtcatcacttcctctcataaccgcacaattgtcgagcttggcaggcaagtagctggatctacacctgacacggccccttccagtcctttcaccagggcacagcgcatctgcaggtacagttgaggggtcagtgaaaatttttttctgagacctgttcacccctcttctgggttccccgctcattggtgaccaccccagctctgtgcccaaccatcagctgccagtcaccccatctctactctggttgagtccagttgaggtgtagtatcttctggatacatttatctccaataggaagcatctgggcaacttaactgagggtatgagtctgtactcatggaattttaggcaccactgaagagaggctttgcggtaaagaggatttgttggccttcctgctccttgatttctcacctgcatggtggagctgtcagcttacttaacatgccagccactggactagatcaaatatatatctatatgattataggtgatctcattttatgctcagtgcagtcttgtgaggtatattgttactatttgacacatgataaaactgaagctcagaaaagctaagtaacttgcccaaggtcacagagcaggtaagtggcagagctggaatttgaacccaggtagtctggctgtagagaccacactcatagcaattatccccacggcttccctacaaacaaacgaaacaaaaacaacaatgaaactgaatggaaaagcatgctgtttctgtcccaccaccgaagagatatgaaaatcctggttcaatggcccatggagatcccaacctaaggctacttccttcctaatgacagcatatctgaactgcaaagtaccatggaacatgtatgttattatacttctagaaagctggcttgggaataccaaagtgggattctaacctaggttttcctgacctctaatctcattattttgaacctttagactagctccacttttcacactgggagccctgataggacacaagtgggtactgggagataaacctgggctatggtcagagtttttgcacattagataatattttccattgtgaacatgttttcaatatatgcacatactcatagtcttttgtattcctttttggattatttctgtatccttgtaggttaaaaataatggccaataggcatcaagctcttactctgtgctacgcactgtgttcactgctttatacggatgatcttttactcctccacaatcctatgaggtaggtactattattaactccattgtacaggtgatgcaacagagactccgggaggttgaacgactacctcaaagttacacagctactaagtggcaaagctgggatttgccccttggcctgtgtgactccagatctgaggctgctatccactcctcagggcagaatttttggagcagctaaatgaggtttttattaaataatagagagatctgtctagcaactgttccattgcaaagatgggagaattgatgctgagaaatatccaatgaatggctgaaatcacagcctgtcggggagttgagcagtgacttgaagcctccacagttcttgtccaatcctcagatactgtgaagtctttgaggacagggctgggtctgatccacttatctccccagtgtctagcacataatagggattcagttaatacatttttggcaatgaaacgaatgtttctaatgataatttttcatctggcctgacttcaatcttctcttaatgccaagtcttgccgtgttctaggtcgacaccaacctccctctaacaaatatggaatatagatgagggtctgagccatctgtgctcttttgtttgatttaaggtcattggtggcttcaccatccagatttcaccactggcatctcatacattcatttcttgccattccacttcttacagaagaaaacatatgaagggatagtcatagtaatgaggaagccaaggctatagctaccaaaacaaaaacccaggaaacaaactcacgtaataaaaatagcacctccagcacaccaacatggcacatgtatacctatgtaacaaacctgtacattgtgcacatgtaccctagaacttaaagtataataaaaatatatatatataataaaaataaaaatagcacctcatgggtactgaggactttccatatatgaggcactcttctaagacatttgtatgtactaattcatttaatcctcacagtaatctaatgagatagataagattattatccctatttaacagatgaggaaactgagactcagagaagactggctacggagttaataagtggtagaattagaaagttcactatgtttgaccatgcttgactccagtgtctctgttattaaccataatgctaaactacttacacttattaccaggggacttgttgatggttaggctatggggactgagccaaggaaggggcaataacaattcctaggacagggcttgtgtttgatgagagtgggggtggtcatgagtttggcttttgaatatatcaagtttgaggtgtctttgagatacccagctggagatgcaaagaagacaggtggatatgtagtctgaaatccagaggagacattggggactcttcaccatatagataaaaataactgacatttattacacactcactaagtgccggcactgtcccaagagatttatgtggatgaacgattctaatttaattcccatggcagctctatgaaattggtgctttattatcctcattttaaggataaggaaactaagatacagagaggataatgatttacccagggtcatataactggtaaattctagaggcaggattcaaacccaggcagtctgaatcatctgaggttcagcttccttaattgtaaaatggaaaaaataatttccagcatgcgaggttgttaagaagattatatatgtcaaaaccctggcacatagtaagaattccacaaattagagctgctaccattaatgcatctaatattatgtaatacttatgattgatacacaattacacagttactatcgtaacaggtaggacctaagtgttttctcatcaggatctcctttatttccattttctcagtttccctgagaaaatgagcctgatctcttggcgctacaatgagtatagatactattagtaactatctcagaaagattctgaagaactaatgggccaatgtttgtaaagaatttaacacagtgcctggcacctggtacatgctcaaaaaatattagctatttctgagcctttgtcctggccacaaactgaatgaagtcacacactgagctccaaattccagctactgactatctttcaactttcttttaacatctttcattttaaagcacattagatgccccagctgaacttgtcttcagttcagctcactttaagtcctttttctcagtacttttgtggcaactttgtcctttccactggcaagccctcctgggactacaagcacactaggccccaccaaccacactggacccaaccacgcactgagaatccataaagaaaaaaaaaaaaatcttcaaaatctctgatttacttggtgccaccactctacccacaagggggcgctacctaatatataatccttacgtttttgctgcagagatgaatcaaaacctaagacagtggcagaatatgaaatccatgtaaacagacccccaaatttgtctggagaccaaacccctaatgttggccacagcctgcgacttgtagcctagcctcgagatgagtcgtattctgcggaccgtacagcctaatggttaaggccatggcttctggagtcaacctgcttattttctgattctggctctatcatttcctagctgtgtgcactctgagcctgagattttaactggaaaagagggatactattagcaactatctcaggaagatcctaaggagcaaacaggtccatgtttgtaaagagttcaacacagtgcctggcacctgttacatgctcaaaaaatgttagctctttctgagcccacatcctggccaccaactgaatgaggtcacacactgagctccaaattctagctactgactgtctttcaactggctatctcatacagcacggtcctgggatggtggctggtggttccatgaacctgcattcccactaagggtgacacaatttgaggttctctgatgcctctctcccatgtccaccctggccagcttcctgccatgtgcacccttatgcattcaggccaaggcttcaggtcagtgtgctaattttggatttcagctcccctgctggccttggccttggaggcaggcttagattacatgttcctgccctggagagcaaacctatcctccccaaacaaacaggtacatgtacgccacacagtgaaacagacacacaaacattctgtctcacacacacacacatatacacacatacacactctttcacccaaactccaggagcaaatccctgcccagcggggagggagtgaaaggtaactgagccctgaaagacagctgggcagccagctcagcctctgccaggcacttttcctagtaagggcatcctttgggcgacaatatccaattgaagacacagccgatagggagctccatgactgtttcccttagccctgctagcaatgtccccagaacctttttgggttctgtatttagagagctgctggtactcaatgacccggtcagccggcagctggtgcctgcctgcctgcctcttctctctcttcctctcccaatggctgtatctgtgcccatagagataagtgattcgaattcctccagtttgtggtcttccttagtgctgagtgtggcccaggagtgccctttcccagtgtcgtttgtaagttttgaccctgcatgcttcaatccctcccttgccatttcagttttttccccaaagggctggatgaattctagcttctccagctggaggaatgtgtggataagtcctccagggtcccatcagtttatgaagatgggcttcccctgggtatgattccaaaacacccgtggattcatttcacaaatatttaatgagtccctattatgtgtcaaacattgttctcagtgtaagatacatagtttaaaaaaaaatgaaagaattctcaaaggagctcaagaataagtgggctaacatgccagtatgtgcttactacatgttaggcactgttctgaatgttttaccatctattaacttcaaaaccatttgttggtcttcaaaacctcatgatataaggaatattattatgcccattttacagacgaggaagctaaggatcagagaggtttcatcactgtagtaatttgaatagcatcctccagattcacatccatccagaacctcagaatgtaaccttatttgtaaaaaaaaagcctttgcagacataattgttaagaattttgagatgaaatcatcttggatttggggtgggtcctcagttcaatggctggtgtccttttaagaagaggagaggacatcacacagagacacagagaagaaggcgatgtgatgattgaggcataggttggaatgatgtgtctattagtcagggatcaccaaagactgccgacaatcattagaagctaggagagaggcataagacagtttctccctcagagcctccagaaggaaccaaccctgcagatcccatgaactgtgagagaacacatttctgttgttttaagccatccggtttgtggtactttgttacaccagccgcaggaaacaaatgcagtgacttacagagctaagatttgaacttcaacaatcagcctcctgattctgtactctcaacccctcctgcctactatgcctcactctcaggtagggaaggtggttagggggcctccactgaagaagctagaaaagtaatgcccatggtgaccccagatgagtaatagcctggccccttctaaacctcaattttctcatctgtaccatcaggaattggggctagatggtctttaaggcctcttccagttgtggcatttttatgagtctatgattcatagttttgggggagaggtggcacagtggcagtcatgagagcaggttgtggacgaggggatagagaatacacattatatgtaattgactgattttcaaaaggcctgtggataaaaccctattatggaaaatttttcattatctttccctgttgttctctttatgtctgtttctctctgactcccccgccttgcctgtcttgcacatgcatatgcatccccacacccacacacatgcccagagactcctctccaatcctggagagtaagttcatatttatgaatttcaaactggtgcaaagggaaggggccagtgtatgagtgtccaacagttcctggcaaggggaaaggcattgtggggaggggtggggagggctctagagatttggggctggaaacagtgttattaagtatgttcattaatgagcctaagaaggaaatgactaatacattgatggaaggaggctgatggcaccaaaccacttggttaattaaaaccacagaggtcttagagtgactctgaaaagcccctgaggatggaagtggtcgatagaaggaaaataataaaaccaagaaagaccattcgggggtaatcattgaaggaatgtcttgcacagagaggtatctaagactgggaaaagagaaaaaggacaaaacatcacaattctactcccctgggagcactaaaagctccctagcacttgcttgtttttttacaaatgttgtgatgcctgaacatagctgtttgcctagcagccactgagaaagggtctgggccaaggtccagagcaaatgagaggagctatggcaccccatgaaagcctctaaatattggtcaggtggaagggcatctgagggtcttttccattgtcaacagccaagtggcagagagtctcccaggctagatatagctttctctagattagctcccagaaggtgtttcaaatgaaatgacaggaaatgactttgcaaattgccacagcaataatttaggttctgggtggtcatttgtggagcaatgattgctacctcacaacttgtatacaaagacgtttgccgtagagactgtccttaaggctttatctcttggaagagtggtaaagtacaaacacttagaagtctgaaattagactagactcagcaagctgcccaaccttggtttcttcacccataaaatgggaataattatagtgtctactcatagggttgttttaaggatcaagttagaaaacacagaaaatgtactatgcttggcatataagaaatacatagcagcctttgtcatttctacctagatgtctttcatgtacctcaaatttgacataactcattacttcctcaccctatgtcccttatctcagttaatggcatcaccatttactcagtttcttaaactataaatttcagaatcatcctcagtctccctgttttccttcaacccccacattcaattgaccaccaaggcctagttcctcttcttgatccctcttgccccacgttgcctccacctagtacagatcctcatcatttcttgcctgaatgactgcaacagtctcctaactggtttctatgctaccatctctcccctctgcagcccattatccacagtgtgcccagataagcttttaaaaatatgagtctgattagggaactgtgccttagcttaaaactttttcaggactcccgctttccttaaagattaagtccactttccctattttttcccacaaggaaattcacattctcttcctgtccagcctcctgtctactcctcatatatttgagcctctttgaatctcttttccaaatatgccatgctgtctcactgttccatgcctttgcagatgccgtttcctctactcttacctgttgaatccctactcatccaaagccggttcaaatgtgctctcctttgggaagcccttcctgtccctccaaagtggatattttgctctcctccttataatcccatagcacttatccaggacctatgtccagtacttctcttgttagctagagattgtttaaagatgtacctatttatcccactggtctgagtactccctatccccatgcagtagtgagaacaagcttccatagtccaaggactagaatcatggcatctggctatggccagtctgtgtcctggactctgctcttcttatttctctgctgagtccaaaacaaacactgtcatggtcccccagggaacttgagaaacagagaaaatccaggtgacaggaattgatgttgaacaagctggtgctactggataaaatctcataacaatccctgatcagcttcctgtcattaagataaatggcccagtgctgatggctctgcaattaccagctcttctaattgaatgtcgagaccctgcttttggaaaaccagtggcttaagccctccctgcccaaccctaggtatatgttctctttggtctctattcaaattcaacagacaggtattgagtgcctaccatgtgccaggcattgtgcaaggcattttataaacgtatcttcatttaatcatcataacaatcctatcaggaggatattatcatctccatttgaaatatgataaaaaacctgatggctccagaggtgaaaggatttgcttgagattactcagctaataaagacgacaggtatcatttagtgagttcctactgtgtgtctggcactgtgtaaaatactctatggccactattttaactatacaactctgaaaagtagatattataatctccattgtatagctggggaaaacagggctcaaaaatgaaatgatttgaccaatatctcatgactagtaagtggcagagctgggactattaatccatgtctttctgtctttagattcagtagtctttctaccacaccacatggtctctttgacctccatcacactagagttctccaaattgaaaggctgtattatccatggcaaagagaatctgttcacagtggtgcttagcatgtggcacggacaaattaaagaatgaaagccaggatgctccaacccaaactttagggacaggtactgctgtgaaaacagtcctagggagggccagcccattttgtggcacactgccctgcctcttcaggtccctggggtgagcatctttaattctcagggtcctggaggaaagctactttcctggcatgaaacgagttttcaatgaggaaacatattcccatcacaagcccattgctcgagagacaatctttgttgacaaaaattgaacagaaataggagctgaagctgaagccacaaacttttccatatggtcatcttttgggagacacatggatgatatagctggcacatctgctaagcatccttcctgggagccactagtttcctgtgtggtcctggacttcatttccaccacaaatccaatgaggtgatacaccagaagccctctaaggttcgtctagtttaaacctacagttctgggtcctcaagaagccaactttgattagctggtaacctgttgagtgctgggagtttctcgggccagctcccaggttagtgtcaggagcgccatatacctaagtggccagttttggacatatcatcaagttgggtgcttcatcttcttcctgacaggctcttaaagtaagtggactgatggggtggacaggaaaatgatgactctggcgcagactcagcaagatcctttagtctccccaccaccagccagagccaaagccaaatgaaatggcctttggaacagaactggctcattccattaaggagatgagagttctattaattggaaagaaagtttcaaaggcaggcaggtcagcaaccaaggcccatggctaagcactactctctgggtaggataaatgggggcattctccaggctttgtggtagaggttggagagcaagaaggcagctgagctcaaatggagagcaccagcctggcaaatacaattagaaccagtcagggctgcccttacccactcctcatccctgccacttcaaactccttcacatcgacagaattccatgtcctgttttcaaaccccagcccattccccattactttctgaatttgtcctccctgcttatgttataattccctgatgctgtggaacatttcaagcatgatagaaggctctctcgtgccttttcccagttaatattcctccaagaggtaaccactaatccagaatcatctggaaggcttgttgcacggatgactgagccccaccttcagagattctcattaaatagatctggatgcagctcaagaatctgcatttataacaagttctgaagtgctgctgttgctttgagatgcactgtgctagtctgacttctatcagcaatgttcagcttgcttgttcttcaatgtactctttcatgtctgccttcttttattcatccctacgtctgtaaaattcatccatgttgttgaatgagccagtagtttattttttactgtatttgtagcatttcattgtatgaacatatggcattttatttatcattccactgctgagtggacatttgagtgatttctaattagggactattatgtatgatgttgttgctatgaacattctttctttgtcctttttagaaggtttatttttatttttattttattttaattttaagttcctggatacatgtgcagaaggtgcaggtttgttacataggtaaacgtataccatggtagttttctgtacctatcaacccatcacctaggtattaagtttcgcatgcattagctatttattctgatgctctccctccccgcaccccctgacagtctccagtgtatgccagtgtgtgttgttctcctccctgtgtccatgtgttctcattggctataaacactcttgtacatgtttttaggtgggcatatgcacttatttctcaatatacctaagtatagaattgcttgatcataggttaggttagatcaagtatgtattttactttgttagatactgtcaaacaattttctaaagtgattgttcctatttgtacgcctaccaggagagtatatgaattcttggtgctccttatccttcccaacacttgtactgatatcttttaaaagaatttagccatttttggatgtgtgtgtgtgtgtgtgtgtgttcatggttttaatttgcatttaggatttaactagatttcatagtgtaaaattgtttgtagtgatggaaatgtccagtacagggccttcaaacaagtgacagctggtatggacactgcacataccagctcagatggtatggaggagcactggatgaagaaaggatggggaaatgctcaagggaaaatccaagcttcttcacttttttggttcactattctcccttgtataaacaaggcaattctccccttggaatggagttgaggcctcaaagttggcttttgagcttgggaatactgagactgttaatgccaatcctccagatggaaatgaacttggtatattggaggtatagaagaagggtaatatggtttaaatgtaagaataaaaggggaggatatagataatatcagagagatcagcagggaccatcttttagagggtcttgtaggttttgggaaagagctaggagctcattccaagcacaatgagaatccagcaaagggtttttgaagggagagtgacagaacatgatttatattttgaaaatatcactgtgtttaatgtgtagggcaatggttctcatccttggctgcaccttggacttatctggagagctttaaaaaataccgattccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgacatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgttggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagagttgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcatcctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggttgggggcggggggagggatagtattgggagatatacctaatgctagatgacgcattagtgggtgcagcgcaccagcatggcacatgtatacatatgtaactaacctgcacaatgtgcacatgtaccctaaaacttagagtataataaaaaaaataaaataaaataaaataaaaataaatgaaaaaaaaagaaaaaaaaaaataccgattcctgagtttcacctccttagattctgattcaattggcctggagaacagcccaggaatttcaagttaagacagagagaagtggacatatttgagacatattttggatgtgagacatactgggtttggggagtctctgtggactatagggagagaaaggggtaaaagaagtgacccagcatcttacttgggacttttaacagatggtggtgccattcactacaatggggagcactgagggaagaggagcagattgggggtggggccataagttcagtgttggctatgttgagtttaagatacgtgatctgttcagggaggtagacaggactccataatagactggatttggaaagggcaaagggagaggaagagccgtagaggatttcctgtgctcatgtcctatattctcatcttggtcatttccacttctctgattgggatcctatctctgttctctggatactaatagcctaatcaggtaaacttcttcctgcaaatgtgttaactctattttataaccccttgagatgcctttacccaactaaaatacacaagtcctacgtccttcaaagagtagctcttctgatagaaatttgaagcctctgtggatgattggtggggaaaggttgaaagaaactgtgctagaattttgccccttcaatttcagtgagaaggagatggacttatcaagataaaacagggtgtgccctgacttcctttaggaaaattcaaacgctgagctagaagttttatatctattatctcatttagtatctcaaatcacttgagttgttattattactattttacaattaaagaaaccaaggccaaggaaggttaagcaactcattcagagtcatacaactagtcagatttagaacccagaagcatatttctgccatgagtgctgagagatttttattcattaattcattctcattgtgcactagagtacatgcctctgggagtccagaggatcctgcatagagcccttctgaggagtatcaagggagtaaagagttcctttagatagaaactaggttgactggtggactggagtaggatcaccattagtgagctccatctcctgggtcctgccttgtagtaatctgtcaccacttctgctcctgaaacagagattcccaagagcagcaagagcctttaaagagcaaagaggctcgttctaaaggtagggaaacaggttagagagagacaaggtagtttgcccaaagtcacagagccaattagaggcagaatcagggaaaaccttttggtgggaggttcccaagagcatatatctccaggaggatgcagctttctaaaagaagtaagtaggggaaagagcagaaagaatcctggggctatagcagagaactctgcccagaaccactgcagtcacgtcctactcactgcttgctccctgtgccagccaaccccacagccttcgctcagggctggaaaaagacacgggacagggctccttaatgagaacatttgggaacccgggaaaggttaatgatctgcagcctcgaccatccatcagctgcctagccagggacagtaaacaccgttactcatctaattagccaggaaaggctgggcaggggctgaagatggggccttggagattacaaagtaagggtccacttgcttagggtgctgagagaggctaccagagggcacaggccaccattcctggaggcatttgtaagggggctcactcttagctggtccccctgcagctctggctgcaggcatgtggtgaaaggcatggatatttattgagggcctcttctgtgtcaggcactgtactcatcaattctacgtgtcaatttattgtgtcccccccaacaacactgcaaagttcttacatttattgagcacctgctgtatgccagtcactatatatatatgtatatgtatatatacacacacacatatacactatatatacacacacacatatatacactatatatatatatatatagtgtatatattgcaaatagttgctgcaacataaaaaatagttttttttttcacgagaaataggtccaatcttctgggctactaaagggagtgaatgtgcatataagtgtgtgcctgggtgcttgcatttgtgtgtgtggagttgacagaaaccaccacataggcatgtgtatacttcttcctcacactctcacccatacaagcatagcttcttgcaaagttgaatgcaacccaacacactatacatatatatatatatatatatatatatatatggtgagtgattggcatatatatatatatatatatatatatatatatatatatatagagagagagagagagagagagagagtcatatcttaatccttccaagaatcctaggaagtagttggtattgtcctcatgatatggttttgttctgtgtccccacccaaatctcatcataaattgtaatctccaagtgtcaggggaggggtctgggggaaggtgattgaatcgtaggggcagacttccctcttgctgttctcatgacagtgaatgatttctcacaagatcctgttgtttaaaagagtgtggcacttccgccttccctctctctctctcctgctccaccatgggaagatgtgccttgctcccccttcatcttccaccatgattgtaagtttcctgaggcttcccagtcatgcttcctgttaagcctgcagaactgcgagtcaactaaacctcttctattcataaattacccagtctcaggtagttctttatagcagtgtgaaaacggacaaatacactccattttacaggagagaaaaccgagcatgattggttaatttgctgatctattcagcaaatatgtattcatgcccactctgtgccaggcactgtgctaggtcctagggatataatggtaaaaagacacacattttgcccttgtggggtacctactgtctaatggtggagacaaacattaaacatgagctccacaactagaaaacagcaaaactagatagggatctagtgtaggggaaagctgtaagaaggatgatgaggggcctgaggtgacaggtgctgtggcaatcagaccagtatacccttgctcataactggcctagtctgacttcaggaggctaggccctggggtaaatgatgtatttctgcttggggaagtgggagataccactctagacatatgtgctcattggactctgtgccagtgagtgggagagaattctctagatacatgtgcacatcagacacatgtgctcaaaggttctttgctttcccagctgccatgaatgattccagctccagagaggaggtattggggttagggataactttgtgattgctgaacagtcaatggagtgggccacagctggggaatgggtattctttgagcacctggtgtgtgccaaaccctgtgcgaagtcctgtgaggaggtggctggaagcagtcaaagactgtttttttccagggaggcttttaatataggttgcaaatgggacttatttttgtggaaagattaaggaagatagccagttaagagctgaatagggcagttctgactcatcagcttagaagcctgggactccttgaggacttcttggaagagagagagggagggaagcagagcaacacacagagtgtgaaggtgggtaagcagaaaagtgtgatggagagggagagagaaaataggagacagcaagagatagaggaaagagacagagacaaagtgtgatagagaccagagcaacagagagactgacagacaaaatgagacggtagagggagtgagagagaaagagaaagtctggggcctgcagttggacaggaggaagctcaaatgatgaggtcaccccgcacccaatttgaggccctacagaccattgtggaatcaggcttcaaatggttgctgcatcataaacaaaatagttgtgtgtgtgtgtttttttttcaccagagatggctccaatcttctgggcaactaaagggagtgaatgtgcatataagtgtgtgcctgggcgcttgcaattgtatgtgcggagttgacagaaaccaccacataggcatgtgtatacttcttcacactctcacccttataagcatagcttcttgcaaagttgaatgcaacccaagttgtgaagggaatcccctttttccactaaatgacattttcactccgtttaggaaaggtctccactggaaagtgagttcttgtcatttgaaccataagaaaatgccatccccaaaccagggatatcaaaagacctggactcacatccatacaaaatcagaatttagtcacttatcagatctgtgatcttgagccgtgtggtcaacttctcggggtctcaattttctccccaacaatgaggtagttgtattcagtccttggacactttcccacttgagcaagtgcaagaaacaggtgtagactgggtccccaaggaaatctatcctaatgaccgtaatttgaaagggtagatggggggaggggatctgttgatcagaaggcagcgtggaatgaagcaggggtataaataaagtaatgcctaaataagtcgactgaaatggaatgggcccctggaaactcagcccttggtctggctctcttggcccagttggctggctcaagggaggagccttccacctctcaaaaccctcttggctcccatctgcctcctgcccgtcttccactttctgcttagtagggttaatgtagtctgctttgcagtagaggaaatgccttcacaccctatttttatttacagtggcaaatttctgttgtgtgcaatggaataggccagtgtcaggaaggattaatggggactcccaactgagaacgcagcatgaataatggtgggaggagagacagagtgaaaagcctgatatggggttcttcaggccagttaagggtgctttggggaaaaatggtcatatcttactttattagttatgggcaaagttaatctcctcctctgcacccccaacgcctctgtcccagaccagcttgtcttactttctgactggattattgcaacagccttttcccaggcctctttgcctctagcttcttggctctattccattcaccactcttcacctttatctttctatatcccgacattgatcacttatcccatctacttgactatgacctatacgagagaagagattgagtcatcttgttaattgcctaatttcctttgccaagcaccgtgtttttcatagaggagatgcttaataaatgtttgacaggtgattcaatgaataaataaataccatggaccagtgactatgctcatcattgtaggatagtcctctcatgtgctcccacagtcgacaatgtttgccccatcaaagaacttatgctatagtttgtaactgcttgtttatgagactgagaattctgtgaggacagggaccacatttgtcgggtttaccttcccagacatatgttacgttcacaccctgcacggtgttgaacgaatgcatgaatcagtgttccacgggaaatatattttacctccatttctaactgtacattcagcagttactgattgggcacctactatgtgcaaggccgtgtctaggcattggaaatttttcagtgaacaagacagacaaaagcctctgctttgatggagtttatattttagtgaggaagacagtcaataaatcaatggacacatatttatataagaaaatgtcaagtagtgataagagctatgaagaaaaatgatgcagggcaaaggggtagacaatggtggagaagattcctattttagcttgggactctgaggagagaacatataaaagacctgaatgaggtgagtgatgaggcattccaagcagagaggactaagagtgccaatgccctgatacaggaatgtgtttggcaagtttcaggaatagtaaggaggccagtgtggctaaagtacagtgaacaaggagatgggcatacgagatcagagagctaggcagggtccagatcatgtagggctgtggaggccataataaagttgagagactgctctaagtaaaattaaaagccaacaaaagactttaatgcaggcagtcagcaacaatttatttatttgttattaaatagtaggtctgtgaaccctggtgaggaaaatcctggaggcaagaggagacaacccagttagaaagctagtgcaatagaccaggtgatgcatgatgatagcttggtccactattagtaatgggagtgaggaggaagtggttggatcaggatatattttgagtacagagccaacatatctggatagtttggatgtatggtaggagatagttcaaagccacctcctctgggaagccttccctgacattccttaccttcctaccatggaaatcaatgtctctccctagatactcatgtcacttttcagctctataatgttaatgacagcattccatcttccggcagagctgagatacctgttcacatctactactcccactcgacttagacctcctcagggaccctggtggtcatctttgtagtctttaccagaccctgtacgatgacttatgcagaatagttgaccaataaatactggtgagattgaatagattaactaaattgaagctgtttattattgcttccagtgtatggttgcaaaactctccaatcatagaatgtaagcagaagaattatttcaacatcaccagcttttaattactaaagtccatttgatggatgcctctgcttgaattattgacatcatgaggattaagatgtggtcccttgattaaaaagaagggttgagtgaggggcgtggagagcgccagagggtgggatatttaatgaagccttttctctcagctcatgttcagctagtgaagctgtcaggggaagtgaaaactatctagaggaggatcgagctgatatttataaaaacggcagaagtgagaggaggcagggacatttgaagcataaaagttggagcacatgtacctggattcaaattttagctttctcatttgctacttacggctctctgagaaagtgtttaaaaagttgtttcatttgcttttaactgagatacaacttacatacaaaaatacataaatcttaagtgtacaacctaatgaatttttagagatgtatacatcatgtacccatctcctataaaaatgtagaacatttccagcacctcagcaggctccgatatgctccttctagttagtatcccctgcagaggtagctactatgataacttctattaccgtgtagccattttgtctgtttttaatcttcatgtaaacaaaataatgcagaatgttctctagtgtctggcttctttctgagaaagtcatttaaaccctttaggcctcagtttcctcagtctttataacaggaatactagtagtagcagttatatcaaagaggtatgaagatttcatgagataaatcatataaaatgcttagaatagtgtgtacgggataaatattagtcctttccttccatcctttccttgtaagttcctacagctatgataagcactattgggctacaagggaagtataaagggcagttgatacccttaaggaacttataatctagttagacacaaggatgtaatgtacttggtaagcataaaggacaatattaatatattcttaatataatgaatataatgatgtcaattactaatcccactgctgagtgaagaggaggcaggtgatatagtgaaatggttaaaagatttcaggttttgaaatctttggacttgggttctagcaccagtttccccaattaccagctgtgtgactctggggatgtcacataatgttgctaagccttagtttctttatatttaaaatgggaataacactattttatctacctcatgggattgctgacaacattgagtgcaacatgttaagtgcctggtacaggtcctgaaatatagtatacatttaaacagtggtatttgctgagagctttttctgctttgggataccaggattcaaaaagatccagagctttcaccctaccagggttagctaagtggcttgcaaggcctcatctactgcagttgaataaggtgactgctgaagctcaaagggccacttcttcatttacccctctacagttctccagtagacacttgtggcagtaccagggaccatggagttaaggactctgcctctgccttggggagcccccagacttgctcctttcttgttcataaggctaaatatataatgatccaggcctatagccgggaccctttgcagccctcaggcaggagccatggctagttggtcccagtgcagcaatggggggactcactgtgatggaggagtaaataaacttttaaaaataaagacaatcttttagggcagcttgaagttcacagataaatggacaggaaggttcagagatcttccatataccctctgctcccacacatgcacagcctcccctgttatcaacatttcctcaccagagtgatacatttctttcaattgatgaatcgctacattgacacaccattatccaaagtccacagtttacgctagggttcactcatggtgttgtacattctatggctttgggcatatgtatgatgacatgtagtcaacattatagtgccatacagagtagtttcactgcccccaaaatcttctgcactctacttattcatcccaccttccgcctagtccctgacaaccatagattcttttactatttccatagttttgcctgaggaatgcaattttcatagccattttgaaaccaacatttgaaaatcaaaattctttaaacactgttaagcatcacagtgttttgagaaaatattttcagaatggttttatgcagtctgcttcccactgctcaaaacaaaagtttttttagaaaaaaacttaaaaatcaacatgtcttaaaaatatttttcaaaccaaaacaaatgtctcaaaagctatttgcagatatgatgattggtaagatgattcagccctgaggaatattttctctagtgttattctgatgcttacattttgaggatttgatttagtcagattattttctcaaaactatatttattttctatctatcctgaaactcagctaacagaccaaagaaattcaaaccttaaagctgcaacatgaaacatttattgaataaatgaatcattttttcctttttgtcttggctaccaggaaactcagagttatgttaggtagaggaaactgtttcacctttggttctccctttctctacatgattttcctatcattcttttgatctttatttatctgccctatttctctgaatttttatgttaatctgtttcaaatcgattttggatgtagatggaactacatctacggatgaatctatggaaagatgcccagtttcagtagtactcatataaatgcaaatttaaaaatccacaaaatattgcttaacacacatttgaatggcaaagttataaagccagataatattatgagctgatgatgatatgagaaatcatatattaagttctgttggttggagtgtgaagtggtagagccactcaggagagcaatctgaaggtgcttaatgaaactaaatatgcataaactctatgaatgagtttataattctataacagaaccattaagggacatgtgcaagggtgtttataaaatcattgtttgtgatagcactgaaagcaatatagatttctattactaaaagactgaataagtaaaatgtgacatatgcacatgctaagaatactatgtgaagtcagaactctagtcaagatacacatattagctctagcttccgtaataaaatgccatagactgggtggcttaaacagcagaaattaattttctcacagttctgggggctagaagtccaagattagggtgctagcatggttgagttctgatgagggctctcttcccggcttgcagatgattgctttctcactgtgtccccacatggcgcagagagagagagagagagagagagagagctagttctctgatattgcttcttataagggtacaaatcccatcatgagggctctgtaatcattacctcatctaacacttccaaggccccgttctaactaccaacacattgggagttatggcttcaacatatgagttccggggggacacaaactttcattccataacattttgcccctagccccccaaaattcatgtctttctcacatgcaaaatatatgcagtccatctcaacagacccaaaagtcttaactcagtccagcaacaactctaaagtcttaagtgcaaggtatcatctaaatatcgtctaaatcatgtatgagtgagactcaaggtacaatttgtcctgaggctaaatttctctctagctgtgaacctgtggaaacagacaagttatgactgaacttgttttgtggttttttttttttttcactgggattctggaaaggagatccttagaggaacaggggagaaattggggatattttgcctagggttgagagatgtcttggctgtctttagaagtcagaggatttgtcatttgcagagacagaactgtgccttaaagctccagagaaaatccataggccatagaaataagtcttcaaagagataacattacttaatggtaaaacaaatcaaaagcacagtaatattaatagttgctgcttacatttactgatcacttactaggtgccacgctctgggttgagcattttaaattcattatcttaatttgttctctcagagatgcaatgaactaagtgttcaaaccacctcttcaaaaaaactggcataagaaaaaaacaaaattgactatattgaaactttgtccctagaatttaatcaaattaaaatgaatcttttcagtagtagaattgttttttccactagatttcaaggcatgaaactccattaagacatagagcatcatactataccagcatctaccacccttgtgatgatcatttcctgaactctaaggaccagctcacaggcttccttgacactccaagttctgtcctcatcctgggtgtcctcaacaatatacacacgaaagtcccaccccaaacaccctggcctcacgtctctctgacctttaacttctgagcacctcaaccactcccattcacttgacatcactgggtgtggcttcaactccaatatcccactgaggcccaaatcccctgatgaaggctgggtccatgccatttgctctttggcttcactgaggggccagagcccaagaccttccttttctcttcacttttttccttgtccagccaggatcttggagcatatttatttagtattgactgcctcttcttccccttgccctccaatgaccacatctgcactatttagcctcagttttgagtctctccaaactaatgatttctctgatgtcataatggccactgtgggagaaaggagcagcaccccaagtattggtacctctaacagtcagaatttccaacctcagttggtccttctggccaccctgcaatcctttcacatgccccaagtcacctctttctccagtttttctcccatctatactccaagtttttcatcactcctctcaaagaacagtccctttcactctaccctcaccgcaccccatacaatggctaagactcctaattcataaaggagattgaagttaacttcagcttcttgtccccatacctacaaaggtctctttggcttcactagctctcacttcacatttctcttttagtttcagaagaactggccctcatcctctagtttctccacctttgctctgtacaccctcctctaattttcctcctcctatctcccctagaatcttgcttatactactatccattctctttcctgactctttattccctctctccctaccagttccctaacctcaggttattcatatgctcaactgtccctcttctttagaaatcttttcttgccaccactgtccccttcatctactattaaagctgctctcatcttttaagtctaaaaaatcagtggtctatacccaatctcagttttctcacttcctattcttttttcaactcagtgtgatcaatcatactactccactgtgctacatttaccatgattactctttagtcctgctcttactttttattacagttgtattgaagcatataataaattgcacatatttaaaatatacattttgatgagttttgacacacgtatacacccatgaaactatcacctcaatcaagataatgaacatatctgtcaccaacaaaagtttcgagataccctttggtaaaccaaacagcccacacactgtccctaagcagccattgatctgcttttatcaacacagattagtttgcatttcctagaattttatataaatggattcagacaggatgtactctttttttgtctggcttatttcactcaaaataattattttgagactcatccatgttgtgcatgcatcaacagtttgctcttttaaattgctaagtagcatcccattgtataaatatgccacaatttatttatccattctcctgttgatgaacatttgggttgtttacagtttgtggctgtttttaataaagctgcaatgagcatttgtgggctagtgtatatgctttcatttctcttcggtaaatagctaggagaaggatgaatgggttgtaatataggtatatgtttaactttttaagaaactgccacattgttttccaaagtggatataccattttatattcccatgagaaatgaatgaaaattccagttgttccacatcctcaccaacattggtatggtcagtcttttcattttagacattctaatggatgtgtaatgatatctcattgtggttttgattcacatttctttaaggacaaatgatgttgaacatcttttcatgtacatatttgccatttgtatttcttctttcgtgaagtgtctattctaatctattgcctatttttagtgtattgcttatcttcttattattgagttataaaaattctttatatattctagatacaagtcctttattggatatgtgatttgtaaatgttttctcccatctgtgacttgcctttttattttactaatagtattttttaggaaacaatagtttttaattttgatgaagtccaattattgattttgcttaagtcctcatgcttattgtattctatttagaaaatctttgccaaatgtaaagtcacttagagtttctattaagtgttgtgctggaagttttatagttttagctcttacttttaagtctttgatccattttgagttaatttttatatataacatgagataagggctgaggccctacttttttatacgtgatctttccattgtttcagaagtttgttgaaaaagatttccccattaaattgccttgccatctttgtgaaaaatcaaatgaccttatatgtgtgggtctattttggactctctattctgttctattgatatataagtctgtttttataccaatactatactatcttgattattatacctttactataaatcttaaaaccaggcagttattcgttttttattaaagttatttttgacacatctaggtcctttgaattcctatgtaaattttagaatcaacttgtcaatatctatacagaagcctactgggattttgaatgggattatgatgaatctgtagatcaatttggagaaaactgctatcttatcattattgagctttctgatccataaacataactttccatttgtttaggtcttttaaaatttctttcagcaatattatgtacatgttttccatgttatttgtcgaatttattcctaagtattttatattatttgacggtattgaaaataatatttaaaatttttcaatttccttttgtttgttgctagggtacaaaaattgatttttgtatattgaccttgtatcctgcaaccttgctaaactcacttattacttttaatagcttttttgtagattccttacgattttctacagagatgatcctgtagtctgggaataaaatatctttgttccaaatacatatgtcttttatgtgttttctcaccttattgtattgagtgtggtctccagtaaaatattgaacagaagtggtgaaagtagacacccttaccttactactgaatcttagggcaaaagcattcagtctttcaacattcagtgtgatattagcagcaggttttccatttatcagtttgaagatgctgtcttctatggcaggtttgcatagaagtttctatttttaacaccaggaatggacattgaatattgtagaacgtgtttttgctacattactaagataattatatggattttctttgttaatatggtgaattattatatattgacattttcaaatattaatccaactttgcaatccttgaataaatttcacttaactatgatgtagtatcttttaaatgtattactgggtttgatttcataaaattagttaaacattttcatcttcatgcttgtaagagatattgatatatagtttgctttacttgtattgattacaactggttttagtctcagggtaatgctggctcatagactgagtcgtaaagtattccctcatctttacatttctggaaatgtttgtgtaggattggtattatttctttcttcaatatttggtaaaaatgaccagaaaagccgtctggtcctagaattttttatgtagaaaggttttcaactacaaattctttcttcttgagcgagctttgatagcttacatcttttaagaaatttgctcatttcatctaagttgttgaaactattagcctaaaattgtctataatattctttcattatctgtaaaatctgcagtggtatcacctctctcattcctgatattagtaaattatgtcttctttcttttttttcctgaacagtctggctagaggtttaacaattttatttatctactcaaaaaattagcttttggttttgttgattttcacaattgtatttctgttttacataatattttattgatttctacccttaactttatgcccctctttctccttactttgagcttaatttgcttttactttatagtttcttaaagtggaagtttagattattgatatgagccctttcttcttttctaatatagcctttcatagtataaattgtcctctgagcactacttcatctgcaatctgcaaaattggtattttgcattatcatttttattcacttcaaaatattttccatttcttatgagttcctatttgacccacgggtaatttaagtgtattgtttaggtttttttttaaaatatttgggaacttttcagatgtctttctgttactggtttctaattcaattccatattgatcagaatatatttgtataattttactatttttttaaagtattcaggtttgttttatgagccataatatggtctatcatgataaatgttctatctgtactcggaaaaatatttattccaatactttgggtgaagtgctctataaatgtcacttcggtcaatttcgttgaaagcgcttttttagtcttttccaatctcactaaccttctacttttctatcatttgttgctactatagtttggatatacctccaagcctcctgttgaaatttaatccccgatgttggaagtggagcctaatgggatgtgtttgggtcatgggggctgatacctcatgaatagattcatgtcctccctgagatgagggaaagtgagttcttgccctcttagttcccacaaaagctggtttttaaaaagagcctggaacctccccacaccttggtttctctcttgctatgtgatctttgtacttgctggctcccgttcgccttctgccatgagtggaagctccctgaagccctcatcaggagcaaatgcttgctccatgcttcttgtatagcctgcacaactatgagccaaataaaactaattcctttaaaaattccccagccttagatattcctttatagcaacacaaaatagactaagacagaagggtagtgaaatctccaaccatgatcgtggatttgtctaagctctatcagtgtttgcatcatgtatttttgaacctcattatataagattattatgtatttttaatgaattaacctgtttaacattatgaaaagacccccactggtctgaagtctactttgcatgtattgatatagccactttagctttcctgtgtccattgttagcatggttaacaggtttgtttcagtgcttttaaatatattttttttctgatgtcttataacttgcatcatttccaataagaaatctgctgtctttcttataattgtccctctttaggtaatgtgtcttccaccacccacctaacccaccccactcccagtccccttgtactggcttcttttaagatttatcttaaagataagattttatctttatcactgattttaagcaattgggttatgatgtcccttggtgtagtttttcacaatttttatgcttgggatttgttgagattcttagatttgtgggttcataatttttatctaatttgaaaaatattcagccattatttcttaaaatattttttctgtcctccctcctcctttgatgactctgattatgtctatgaggctgatttcagtggtctcacagctcattaacactatgttgacattttttatttttcctctctttgtttaattttcaggcttctaacgttatgtcttcaaatccagtaatcttttctctgcaagttcctttttcaccatttaccccataaacactgatgttttatcagggatcatttttatgccaccttttcttctcgctctgcacactcatacacttctagggcttcagttaccatttttattttgatcactgccaaaactgtatctttagaccagaccattcagtattctagtatttctgactgcctatttgacatcttcccctgcttaaccctgcactttagcttatatagaaactattatctcctcctgtatgttttatcacagtaaatagcaacacaaaacaactggttacccaaacatgaaacatgggtctcattcaagatcctttttgaaggcttatatattgttttaggcatttatgtatacctaggtttctagcacaatgcttagcatattaaaatgcttagtaaatgtttattgatgtataaagttatttttccatgggtttaaaatttgtaagattcatggtaggatttgaatctagatttttatgaatttaaatccttgtttcatccaccacgtgatattatcttcaaggtaaatagtccaattccttaaatctttatttcttgaaatttctccattcttgtacagtctttccatgtgtattttaaagtatgagacttttaagtctggaaatctatagaaagtgtggaagtttgtattttccaaagacagctacaacaatatgtcatattctatatgctgttttgcaatgccactaccccatcaagaagtagagtctatttctctaactttttgagactggatgggacctgtgactgcttttaccaataaaatacaatagaagtgatgctgttacagtacttggaatagctcttaactgctctggaaattttcactgatttcttgaaagccagccaacatgtgactaccctaagaccatcaacgctatgaaaagctcaagtcatattgagtgggcctggaggatgagatgtcatattgaggtggggtacaaggttccagaccttgaggacatgtaggtgcagaagcgatcttgaaagtggagtgtccagtcccagccctccagccaactccacatgaatgagaaacaaaccactaggcaaggccgtctcaaattcctgatccatgaaataatgaataacataaaattgttgcttaagaccactaaattttggatggtttgtagcacaacaacagataagcaaaatggaagagaaggaaatatgactaacatgcctataatcatggaaggtttagatcaaaatctttttctcctaagccccaaaataccaagaaaaggaagtcaacctagagggtaggaagattgaataaagacatataagagacttccttaataccctcatcaggaaataaatacatagagattgatacacccttgaaatggtaaagaaaaactatgtatgatttccaaacaggaaacaaaaaatagaattgcttttcaatagtacagatggcaaagagcaagaagaagatctagctattttggagggcagaaagagtattccccaaagtcatgactagcttgaataatgggttaaatataaaagaatttagcagtcattaatgaaaagtgaggcaattgagttcaacctgcatatgtatacaaataattaaaatgaccagtgagaaaataatttaggtgccagtaactgctcagagataataacttcttaaaccacattattagaagtggaaaattccaaatgaagaaggctgatcagctttttttactcagaaaaaaacctggaagattgtcctcagttatgtgagcaattgggagaattcgaggacacaaagccataccacgtggaggaactgttgactttttaggtctgtgtcaaccacgaaagtctttgaaactatatatttagatgcattcttgaaattctgaacgtctcacgcaattccttaatacctagtcccagcctggatccactgtaatggtgttcttcaaatctaacttcataatactctaacagggtctggaaaggcagagcccagagggagaattgcttctgggctttctcattgcaagatttgattaaggcaggctttcccgtaagacttctgaggtagactggggtgggtcttgtttggatgtccctgttatttcacaaacaggaaggatttccaatttcccacttagaaagaagaaccagcaggcctggggtcaaggtcagttggacatgacttcaccagagttttgccccgtgtgcttgctttgtgatgtatgactcatcataattaaattttgagctagattaactataattcctgcacttattaggcgatcagtgtttaaagcccttgtaaaagaggatgagctgctcattctgataatgcaattaactacccaacagagctaatattttattttagggaagagtaatttttgattaatgatgcattttatttcccaaatccctgcagcagtgggtcacatctttggtgagaaagccaaagaaaaagggtaaaattagaaaacttggagtgtttggaggcagattagtgtggattctacagagctggctgctctcttggagcccactcccaattcctgaactcctgctctcttaggtttacatgtacctcaggattctccacagcagaatacacctcaagaatatttttggggagcataaatctcccttgttccaatttcttcttacagaaacaggacataacatcagcatttctgaagttctttggctatgagatgctatttaattccattattcccagagcaagatctatgtgaagagaggactggttgagagggatccagagatgcttcctggaagaagtgatatttgaaaagagtactgattcatggcttgtgtgagaattggggcgcattatttggggtcaaggacatcagttagaaggctattttaggaatccagttgagatatcagcagggagataaagagaagcagacatagtcggctaatattaaagaagtagaaatttcaagacttgcttgttgattagatatttaggggacagtgggtggagagtgtcaagaaaaaggtctaggtgcctaatttgcatgatgaagcatatgatagtagattaggtggaaaagcatgtttgtttcttctagaatggtggaagagatttcttctagaagtttatttcttctagaatggtgaaagagatttcgagttggagttaactgtggtacatcaaagtggagatgtacaatgaggcaactggatttgtgggacatggactcagaaaagagaagataaagatttagaggttattggcaaagaagttgcaaccatgagtgtggaccacattgctcaggaatggcatcttcaaattagactatgagaagaggaccaggaactaaactaaaaaagactaactccaaagaagtaagccaaggaggagccaggaagaagactgagcagaaataggtatcagtggctttaactatggggaagtgaggaccactgaagcaaagggcaggaaaaataccttgaacaaaatgaatctgcatcctcaacaagtggaattcatgggagataggctgaggatgacactacaggtttaaagtttagcacaagtaaaggcatagaaggtgaactggggaaggtgccaaggccaaaatttcagtgaacaaaattgagcattttccagcatggagatttctcaaagaactaaaaatagaactaccatttgattcagcaatcctactactgggtttctcctgaaatgaaaataaatcattatttttttaaaatgcctgcactcacatgtttatcacagcactagttacaatagcaaagtcacagaatcaacctacatgtccatcaacggatgactggataaagaaaatgtggtgtatgtatacaccatcgaatactacccagccataaaaagaatgaagtcatgtttttttgcaggaagatggatggaactgggggctattatcttaagtgaaatagctcagtatcagaaagacaaataccacatgttctcacttagaagtgggagccaaacaatggatacacatgaacatacagggagaaataacagacattggagacttcaaaaggtgggagagtgggagacggatgaggattgaaaaattacgtattggctacagtgtttactctttggggggatgggtacactaaaagcccagacttcaccactaggcaatatatgcatgtaagaaatctggacttctaccccctaaatatataaaaacaattttaaaaaaccaaaattgagcacattttctctgaaagcaacttgccattatttgctaccctgccaaaaagacttagtgtggctttccctcttttggaaccaatgtaagcatcactattttttcccttggcctgtggatccgagggagcagcgtccatcctttgtgccttcctcaaatccttcctgcacagccactgctggcctctgagaaggatggaaactgatgctgggcccacagtattccaaacttaccatgatctggcccaaatatatattcccatcttatctttttctttcttgtatccaatcccagctccatcaaaatagaattattcactgattcccttctaatccgtctggtttcttaccactgtgcctatatcatgctgttctcttcctggcagtccctacacccacccagctcctatttcttcaaattctactcatccttccttggtcagtttcatatagcatgaagtcatcccacatcccccaaacagcaaacagatctgaatcttttctctaggctaccagagcattttactctttcatggcatgaatcctactttgctatgtatttggaattagccatgtctgttttaaattcctccctcttagaccatgatgaattccttgaggctctggaccatatcctgcctttctttatatcttatccatcagcactaagcacagtgcctggcgcatatgaaatatttaataaatgcttatatactgaataaatgaatgaagaaatgaatgaagaaatgattcgtggaagagcccagtgataatctcagacagagaactttctcttatctggcttccagattccaaatggagtcttattacaagtcgtggatcttgtcttattccagtaagaaaaaggttttgcaaccatgtcatgttgaatctctcaatggtcatgtgcatagttactcattttctgtgttttcctttctccatatccaactgtaagctaatgctatgttataggagaaagagcctggcttgggtatgggataaagttggatttgaattctgatactatcttttactcactctctgtgattctagaacaggtcacttgccctctctgtgttctgtaaacaggagtgtccatctctgacttgcctcccttccaatactgctgtgaggccccagaaagatacggaatatacagcttctttgcaaaccatagactctgggcataggtgaggaattatcatagtgaggtaattaatatggcttgaaagaaggaaatgtagatcctgtcctggttggaccaggctgcatttttagtcactatgctggctcttgcagagctctgggacatggctttgggttatgtagatgacacttgttaatgacaacagtctatagggggaaaaactcagttacgctggggaatccaaggtagctagattggctagtggcaagcagagaacagactctgcctggaattggtaatgagatcgccgaaatggaagagaaaattgagccaaagtgtaaatgttcaagcagtttagggaaggggtgtgtgtgtgtgtgtgcatgcatgcatgcacacatatgtccgatggggagcaggggtctttaagagcaatgagtcttgtcatttgcataatagctcttgacaatttgcaaagcattatcatagccaccatctctgaggtcagagaacagtatctccttttccaagataacttcaactagaccaccatcttagtcttgacctttccttcccttcctttctcttctcttcccttttccttccctttgttttctttctcttccctttccttccatttcttttctttccctttctctcagtcaatatctccatccaatctcagttccctgaggatggttgtagaaactgagtctcagagagtgagaggagcagagatggaacatgaattttaggctgatgccctatttttctttagtatttaccttttttattgtgtataaaaccagtaaagcccattgtaaaatgtttgagaggagaggaaaacccagacacgtatgaagaagaaaacgtcagtcatccataatgatcaatattgggtccatatttccttccagctttttttctatgcaatttgacatgcttgagattctgctaaatgtaaatttataaattccagtatactttccactgcatcatgatctgttggtttccttttctacactaggcattgcctcttccaaacttctgtagcctttaaagccccacttgtcaaatagggtgtgtagtaatgcccccttggcttcttgcagctgaagtgagaatcctttgagattctaagggcaagggtattttggaaatctcagcatgtgatttgtggagggggtctcaagtgcagggtttggggttgaacagcaatagcctactctggctccttctcaagtaagcgcccctgtccactcactggagatgaatgtttccaggagcctccctgctaagcactcctttgagcagtctggctatgtcttcaccctctcatcctttccccctttgtcctttctctcctgtctccacttcgacctcaagtgacccttaagcaataacctgcaatggtgagtgggatttgatgatattaaatataacttgagagcacaagcaggacatcttgtacttttccaaactcatagtttaaaaaacacataataacatttattctctcatatttgtttttgtcgctattgggttaattcttgttctgcagatgtttgtgttacaaactgactattcttaggctgggcgtggtggctcacacctgtagtcccagcactttgggaggccgaggcgggtggatcacctgaggttgggagttcgagaccagcctgaccaacatggagaaaccctgtctctactaaaaatacaaaattagccaggcgtggtggtgcatgcctgcaatcccagctactcaggaggctgaggcaggagaattgcttgaacccaggaggcaaaggttctggtgagctgagatcacaccatagcactccagtctgggcaacaagagagaaactgtgtctcagagaaaaaaaaaaagaaagaaagaaaaagaaagaaagaaagaaaagaaaagaaagaaagaaagaaagaaaagaaaagaaagaaagaaagaaaagaaactgactattcttaatgtatctgtagatgagagaaactgaaaaaaagagatcccaatagtaagagttagaatatgcatggaatattaacttactgattaatggattttaatctattattatcttatactttcagtagtggcaagttcttcattgagggaggtggagaggtgtgatggttactggtggcttagtctcctgggaacttagctcactggggatgccagatcaatgcatccttgatgtgggtttctgacattggagtgaataaggttctgatgattaggtgacctgaggagggaagggaaaagagtgtttctctctcccagctactcatgtctttgatcaataaaactgtggttatgtagctactcatattcattttatacatcaaatattaatcccatagcacacagcagtatttctcaatgtgtgatctataaattatccatatcagaagcactttagtcgaggcctgggggtctgcatttgaaaagtatcccagatgatgcagatgcacaccaaaatctgatccccaatgctccagtctctcaagtactctgtgagaaaaaaaagatgccatggttagggaagtttcgaacacattgcctactatatccacctctgaagaggttcataatgcacattagcatattaaaagctctgaaaaatctttcagtaacagaacaatcttatgtccactaacataagattaattaaattatgatacacatacaataaactcctatactgtatttttttaaaatgaggtagccctcaaagaactaacaggcagcttggtgtagatgttaagagcatagattctggcaccagatagacctgaactcaaatccaacctctgccattaaataactgtaatcttaggaaagtcctctgagctgttttcttttctctacagtgggaataataacaatagtcttcatctcatggaagttattatgagttttaactgaatgaaaatatgaagtatttatagaattgtatttggtacgtggaaagtgtacagtaattattagctcttatgatcactgacatgggaaaatgcccatgatatattgttaaatcaaaagcaaggccaagaacaatacatatagcttgctttcatttgtgttaataaattgtacatcataaataatttcaaagataagtgtggaaggatactcagtattctgttaacagtgattacctttggggttaggtactgggagggaggaacgctgtcaattttcactttacatactttggtaagttttttttgtatttttctccccagctttattaagaggtaattgacaaacaaaattgtatatatttacaatgtacaatgtgacattttgatatatgcctacattgtgaaatgattgaatcaagctatttaacatatccattacctcacatagttagtatgtgtgtgtggtgagaatatttaagatatactcttagcaattttcaagtatacattattaataactgtagtcactatgctgtagaatagatctccagaatttcttcttcctaactgaaactttatatcctttgaccaacatctctccatttcccctccaccttttgtttttatttattttttaaagataacacacatcagggagataaaaggaattttgcccagaatggaacccagtatggcctggataatggaaaataatcaagtgttagcacggttctctcttgtttccagagaggcacattcagctacatttagcttttattgtttaaatttttttatttttgccagcctcaccattcttctgactcatccagctgtctgcctactgatctcctctgccttctgtatgctgacggctgctctgtatataagcctgtctttgtacatgtgaattttgaattcctaatgctggacattgcatttcacagaggtcagcccatgctccagcctactgagattgttttggatcctgagtctcccatccaatctgttagctagatcctctagcttcccagcatcctcactctcagagagcatgccatctgtctgagctgttggataagaatggtgacttgactgacactgatgtaaagatctgtgacctatcactagagacactgatccacatatcagcagccacctgctacctctggtgtctcacctgcagtctgtatttcttcactttatctataaaaggctcatgagagtctaagtcaaaagccttgttaaaatccagatgcatcctgtctacagcattctcctgatctacaagccttgtaaccttatcagaagagtaaattaagttagttctgccatgacttgttttcctaaaggccctacttagtgttattactaaaaaagatttgatttgagcccaattgtggtttcaatttagacatatttactgtatttccctacctgctcagtgtccctccctgtccctccaaggcttgcctggtggctggagttaattggatgcataaattcatgcaaaaggactaatggaaaacaagggcttatgtgtactgtttgcaatgtagtagcaagaaagaattgctcaaaaagtagaaatgttgacatatatgtgtgaattttggattcctagtccttgacattgcatcatgatagattgagggcctattttggctagaggaggattttgatgctctttacaatacaacaggaaggttgtttatcattctacctatgacctgggcttagtaatggagatctatattagtttcctagggctgctgtaacaaacgatcacaaattttatggcttaacacaatagaaatttattatctcaaagtccggaggccaaaagtccgatatgtttcctgagccaagatcaaggtgctggcagggctgagctccctttggaggctctaggggagaatgcatcttttgccccttcccacttctgatggttgctggcattctttggctggtggccacgccactccaatcactgcctccatggtcacattgccttctcttcttctgtctgcaatctctctctgacacacttataagggcacttgtgattgcatttagggcccagctggctagtccaagataatctgtctatatcaagatgcttaatttaatcacatctgcaaagtctcatagaagataatattcacatgttcttgggaatagaatgtggattttatgggagggggagcattattcagcctaacacaaagactaataacaaattactaatgccttcccctgacatactctcctcagccccttggtttatctaagtatgaaggagacaactggaatagagaaaagcaaaattttgcagaagatgccactagactttctttcctcttctggcccctggtggtatatccagctgcagatctgttcatgtacctgtccggtttctgaccatacacactctgctgggaaacagtgcagtataatccactcctgaaattcatctttgccagttttcactcatttgggtggctttcgacctccacagcataattgctgacgcaggttgaaactttaacggggggaaagattgattggctcaccaataacatttgtctcttgggctggcattgagcgcagaggaaccatttatgcaatctaattattacgtcaattgggggatggagtaatgtttcccagatgccatttggcacctggaaagctgcaaatcagcactatcatataagaaacattaatatagaccattgattggattcattgatcctatcccttccccctaccgcctttagcttcttactttggtttggagtgaaacgcaaaagctttgctttgcttctcctagctgccatgttcagacaggtgatcggattgattagatgtattttacaattaaatgtacttaaggaatcatgtgcatttctgaatcattttcccctttcctgaccttgaatcattcaaaatatctgtggccagtaggactgagatctaggctccaaaggaagccaaaacaggagggaagagcaaggggcaaagtgctgtttgcaattcctgcatcctgagcctgtataatatgtcctcagaacttttcactaggcttttcaggttcattgttggaacagtttcttggtgttagatcattgtaagcccccaagagggcttaattttttatttttaatgattctttttattagtaactaagtaatctgttgggattaacctcaacagagtgcagggccctagagcccaaggaaagaggatgttaggatattggggaggtttattataacctctttaatcttcatttcccttccacaaattcttttccctcttgtaggcagatccctgcaatatttttaagtgacaaagtctttcattccacaattggaaacaaagcttaaaatgtagctaatccagggagaaggaacatagctacttaaatttatactaatgagtaaatgactgctactacagacgcctagatgatctattagatttggaaagggcttcacagccccgagcctaaacttgttattttaaggaagggaggactgagaattgacttgcccaaggtcttacataaattttgaagtatagttttttttctgaaagaaagttttaatagaggagcaccttaaggggcattgtaaacagacatttgtgaccagttttaccaagggctaggtctgggggattccaaagccaactataatctcaggtctatttttaaaggtagtctatcaccagtgcttaaaacacactcttccctttggctctgccctggtgggattcaccaaaagttcatgtgtcttattcctttttgttatcttagtatctagttgagtgtctgcctcacaaaaggcattcagtgagtgtttgatgtaagactgaatgtttccagaaacagggaaggcttttcactgtaccctccatactctctcattctgcctcctgtgtacacattgcttaaatagctgttcaggttagagattttgcccttgggtgggactaataattgtgtcaatgatcagagaccaaagtgaagaaggctatccaacttacccaggatcgaacccacaaccctagacttccttaaagcatatgaggagatagtcagactatagtctgagatgttagaagtgaatattatggaatccatgtatctctgaaggccagagtcaccaagtctatatctctgatcattgcgggcatcctaagtcagggaatgcaggttgcaagtgggagccggcacaccttctccaataagcttctcttactttcttgggaggaacccctccctggttgtggttggggctacagagaaagagtaaagagggaaccatagggttgtggacaagctactcagatactcatggcttgtgggaaggaagggtttgatcggtcaggatcagcccttagctttaatctcatagtgcccatgcccaccaattctacttgcttattgtctccttcgctggttcacctgcactcacctgcagggactgggcccaggcatggcccctggccccaagcatgcctacctctctctgagctgactcgattaagtcccactgctcatgccttctgtgttcatggcaaaagttttcagtcagggatgacaatgaagagacaaggcagcccttggggcagggctacccatcagccctagacgaaaacaagatccagcagcaaagcccattcctgttggctgatggcttggcattggctgagagtccagagagccttcagttggcctgaaccaatgaaaaggagccaaagatacagtctctcttgccattaaagagatatttccacctatgattggccccaggatacttcacctcagggttctcctattggcctggaatagcatgctggcagctagggcaccctgtggtgagcaggcacctacgtaggcatgcagtaaagcacagcctgctgctgggcactcaggggacaggcagatagaggaggaggtatcaagatcctctctctgcttaactggtgacatcttggggtccaccaacttctcctttttgtgcctttcccctctggctgggcctgcttgctctcctggtcccattccccaaaggacttcgattcccaggtatggtggtgactggcaacacagggtaagatgtagctttttcttagggttatttgcattgttgtaggggatcctgaaatctgaaaagtggtggtggtccaaagaaattataggttcatagaattttggtgccaaaagggaactttgaaatagttcccattttacagatgaggaagaaaactgagatggactccaagaagtaatagaatttagtcaaaatcatgtagctagttagtggcaagtctcctgaccataggcaaggacatttctgatgcatcccaaatgaatcttaaactgtggtatttcatgtacatttctactgtttttcaaaccactgattttctgtcctaacgaaactcctagcctcactggggagatcttcagatcacaaattaatggcttaattaacatttacaacaagtttttggctgtgtcttcagtgtatgaagaagggggcttgtgacatgggctttctctctgtttaccctcttcttgtaccaacccacagtagtcagatgactgtgaccagggctctggagtcatgtaatctgctatctagctaggaagttgtccaactggtgactctgtgatgtttgagccatcactgtgcaagatgcagcagagaagcaagtcagttactaaatgcaaaaaggtctgagtctaagctactgccatattaataccagtgcttcgtttttcatgcatttagcctccaaatcccctttaagttagagacctgggtttatttgttcatatattaggtgggaccctgaacagtcctgaaatcctggccctgggtagctctgtattatcaacaacaatgataagtataaagggtttgggattactcaatccagctttcccccattgtgtctgttttcttcatgcttctacctttctcattccccttttccttatcctttaaaggccaatttaagtcctgccttctccaggagcctccccttactagtgctgcccacatcagtctttccctcttttggcttcttactgtccttccagcctatccctcaaagtgacatttcattatattccatttgtatttatcactattggttccatatatatcaacctcatcttctcaacaagagtataagttccataagggcagggtacacattttatccttgctaagtgtgccccacaatgtctgatggatgttcaaattagactagaatgatagcttttgtggtgacatgggaaatgctcacaatatacttaagtgtctaactcaaaatacaaaagtctatgatcacaattttataaagacatggaaaataaaagcaagcaagcagaaaggtaatacacgcaaatgtgtgagaggtgggtgggatgataggcaagtctaaatatttatatatttacctgacttttcaaagtttcaacaaggagcatgtattactcttatgagaaaaaaacaaggtggggtggggggaggggggagggatagcattgggagagatacctaatgctagatgacgagttagtgggtgcagcgcaccagcatggcacatgtatacatatgtaactaacctgcacaatgtgcacatgtaccctaaaacttaaagtataataaaaacaaaacaaaacaaacaaaaaaaaacaaagattatttaaaagagaatcatagatttatgagctctggaaagcagagcagaaacagatgaaagagctcacgtaagtcctgtcttattgttttaagattgaaaagcctggggcagagctatgggagatgcctagctggtaactcagtttccatcttctaggagcaaacaacccagtttcctgaagctctaaggctgagcctcctaacctctcctcaaatccaccttcccctgagcttctcctctaggcatcggtcctggaactgcgtggttttctcctgatgaggtctcccatgactctttggtgtctcctgggttgggaagcctgaaggtttggctttgactctgttctagtcccttgctagcctctcctggaactcactgctttgcctctgaagcatcccaggacaataagctatatagtatccacactcccaggtggctggaagtaaaaaaacacctagctgtaccctttcctagaaatatatacttactgcactctgagtacttgctgggaagggtgatctcgaactaattccactcaatacctttgcaaagccttgctgagagcaatactatttaaggagggccacctgaaattggtgcttgaagcccatccattcctttccaactggacccaaaagactagccccaggtacctgccatgcccataactttcccttctagttaggcctacctcactcatagccaggaaaaagggctggatggatgttttatgcagaagagtggcccagggattgccacttaaccccaggcaggccatccatgatctggtagcagacctatgtggtggatttttctattagtgttcctcttgccagcgatgga

SEQ ID NO: 915 - DNA, 106075 bp, Homo sapiens
acctgtatgaaaacttcacagcattttcataattttcccacttgactgcaaaccaaaaacaaacaaacaacaacaacaacaaaaaaaacagaatcctttattaggaaaacttctggcaatggtgaagaagcttctatcagaccaaccctgatgcagataacaataataaacagtggaccaaatatataataaaacaatttaaatgcacaggaaagcaacccataaacaggcaaaaattgaaagggaattaataattgaaaggagggaacaatactaagtgagtttttccttttctggaaatttttgtctgatggcagcccccaggccaaagcagtgaataaactctagagaaactagaatcaatgttgcaactgttaaatgtttaacaactggatcttgaggaaaattaataaaaaacaaattcatagtatttgccaatttcaatggtgtaaatacttctaccacggaccattccatgaacatggagttgaatagagatatgcacagtaggcattcacaaaccagtgttagccagctcccacacacaactgctcacagtccaagtgtctgaaagaaccagacggcagaattcaggatgaccacggtagttgaaaagccatgagagaaattcaataatttaaaaaactagggagaggaagccccaaattctgtgtataaactacccagctgtctggtgaaaccatgaaatatttatgtgggaacagattccaaaaagcctaaataaagctgaaagaattaaacagagttttcagtgctgccaatgagggagagtttggagtttcacttcagccccattaactgtctactaaaacaaacaaaatcaatgctctagagaaaaaaataaaggtatcctacaatatataattcactattttcagggtacactcaaaaattactaccaaagcaaagatataggaaaatattactcatatccaaggaaaaaataataatagagaccagccctaaggtaaaccagatgtttgaattaggagaaagaattttaaatcacatatcataattacactaagggaaataaagaaaaacacatgtgtaataaatgaacaaataggaagtcagaatatctgaagtaaaattcagtgagttggtgtttaatggcaggttgaaaatggcagaagaaagagtagtttcactggaagaaaaatctagtgatattatctaatctgaagtacagattagagagagaaagattgaagaggatgagcagagtgttagaaatacataggataatatcaaagttataaacataattggagtcccagatggcaaacaataagagaagaggaagaaaaaacatttgaaacaaaagcctaaccacaagacaatatccctgataattattgatggaaaaatcctcaacaaaacattagcaaaccaaattcagcaatacactaaaaagatcattcatcatgaccaagtgggatttatccctgggatgcaaggatggttcaacatacacaaatcaatcaaagggatacatcatatcaacagaatgaagaacaaaaatcatatgatcatttcaatagatgctgagaaaacatttgataaaattcaacatcccttcatgacaaaaatcttaaaaactgggtgtagaaggaacatacctcaacataataaaaaccatatacagcagacccacagctaatatgatactgaatggggaaaaactgaaagcctttcctctaagatctgggacacaacaaggatgctcacattcaccactgttattcaacatagtactggatgacttagctagagcaatcagacaaaagaaagatataaagggcatccacattggaaaggaggaagtcaaattatctttccttgcagacatgatcttatatttggaaaaacctaaagactccacaagcacaggaaatcaaagcaaaaatggacaaatgggatcacatcaaattacaaagcttttgcccagaaaaggaagcaatcaataatgtgaaaggacaacccacagaatgggagaaaatatttgtaaactacccatctgataagggattagtaactagaatatataaggagctaacacaactctatagaaaaaaatctaaaaatctgattcaaaaatgggcaaaaaaaaactggatagacttttctcacaataaaacatacaaatggcaaacaggcatatgaaaaggtgcagaacaacactagtcatcagggaaatgcaaatcaaaactacaatgagatacaatctcacctcagttaaaatggcctatatccaaaggataggcaataacaaatgcaggcaaggatgtggagaaaagggaatctttgtacactgttggtgggaatgtaaattagtacaaccactatggaaaacggtttggaggttcctcaaaaaactaaaaatacagctacctcatatggtatccagcaatctcactgctaggtttatacccaaaaggaaggatatcagtatatcaaagagatatcttcactccctggtactgcagcactattcacagtagcatagatttagaaggtacctaagtgttcatcagcaaatgaatagataaagaaaatgtggtacatatacacaatggaatactattcaggcataaaaaagaatgagatcctgtaatttgcaaaaacatggattaaactggaggtcattgtgttaagtgaaataagccaggcacagaagataaactttgcatattctcacttatttgtgggagctgaaaatcaaagaattgaacccatggagatacagtgtagaaggatgattaccagaggctgggaagggtagtggggagggatggttaatgggtagaaaaaatagaatgaatgaataaggcctagtatataatagcacaacagggaggctataatcaataacaatttaattatacatctagaaatgactaaaatagtataatcggattatttgtgagacaaaggataaatgcttgaggggatgaatacctcattttgtatgatatgattattatgcattgcatgcctgtatcaaaacatctcatgtacccataaatatacctactacatacccacaaaaataaaaattattttaaaaagaatggctgtatatttgcaaatatgatgaaaaaccatcaaattgaatatattaaatatgtgcaggtttgtgtatatcaactataactcaataaagctgtttgaaaaaaaaacaaatataataaaacacatacatttacagattcaacaagctcaataaattccaagcaggataccacactcaggcatatcatagtcaaactattgaaaaacaaatttaaatagaaaactttgaaagcattagggagaaaaaatgcctactgaggaacagaataaaactgacctgtgacctttctttctttctttcttttttctgagacggagtctcgctctgtctcccaggctggagtgcagtggcgccatcttggctcattgtgcaatctccgcctcccgggttcacgccattctcccgcctcagcctccagagtagctgggactacaggcgcccgccaccacgcccggttagttttttgtatttttagtagagacggggcttcaccgtgttagccaggatggtctcagtctcctgacttcgtgatccgcccgtctcggccttccaaagtgcagggattacaggcgtgagccaccgcacccggccaacctgtgacctttcataagaaaaaaagacatctttaaagtgctgaattttttaaaaactctatcaatacagaattttacatttatcaaaaatatcccttattaataaaggcaaatactgacattttcatttaagtgaacattaggacaatttgttatcagcatgttcatacgataagaaatactaaaggaaattgttgagtctgaaggaaagtgataccagatgaaaagctggatctttaggaaggaataaatagcatcaggaatggtaatatgtggataaacataaaataatattttgctctttatttgatatacatatgagaatacaaaagaaaaatcataacattataatgtgcagtgtgtagtatacatagacatgatgtgcatgaaaactataatatgaaagagggcatagcggcaaaccaaactagacattgacaaggtccttaaattttatgtgaggcaatacaatattaaattgtagtatactttgaaaagataaagatgcatggaggagtggagtggagatgcatggaggagcaagatggaataataagccccagccccaaccctcatttccttacagaaacacctatttaacaaaaatatattaatcaaaatacctccaagagatgtccagaatccagttaagatgttgaataccccagatgagcacaaaacactagaacaggcccactgaaacagtaaaaaagagcaatttcattttacctgtgtcattccttcccccaaaccagcaaaatttggcaccaagtgagatcatcttggcccatgatttctctctcaggagaaagggagagtggagcacgcatctaatatttcaggtctgtcatttcactgccttaggaactagtgtcttatggtggttgccagaggctaggagcaggaaggaatggggacttactgtttacggtgtatgaagtttccattttacaagatgaaaagaatgatggaactagatggtggtgatggttgcacaacattataaatgcatgtaataccactgaactgtacacttaaaaatggttaagatggtaagttatataatatgtatattttatcacaataaaacatttggaaaaacattgaaggagagataacaaacaaaagctgagggactccataagcactagacctgtcttataagaaatgttaaagggagtttctcaagttgcaatgaaaagatgctaagcagcaacacaaaagcgtataaaagtctaaaactcactggcaagcctgaatatttagaaagatacagaatactgcaatattgtaatgattgggtttaaatcacttttggtataaaagttaaaaaataaaagtatttttattttttattatttttattttgttttattttaaaaataaaaataattaaaaattttaactatttttaaaataaaaataataaatacaaaagtgagttagtggctacacaatacaaaagatgtaaactgtgatatcaatgacataaagtggggaggggagaattcaaaatgcagagttttgtatgcaattgctgttaagttgttatcagcataaaatgaaccattataaccggaggatattttatgtgaacctcatgataacctcaaataaaagtatctattgaaaacacacaaaagaaaaagagaagagaatctaaggatatcactattttaaaaaatcaatttaaaaaaccgacaagaagaataaacaaaaggaacaataataaaacaagatagaaaacaataataaaatggcaatagtaagttcatccctattgtattagtccgttttcatgctgctgataaagacatacccgagactgggaagaaaaaggggtttaattggacttacagttcctcatggctggggaggcctcagaaacatgggggccagtctttcctgtgctattctcgtaatagtgaataaagctcatgagatctgatgcagcaaaagcagtactaacagaaaagtgaatagcaataaacgcttacatttaaaaagaaaaaaaaagatcataaataaacaatctaactttagaaataataaagattggggcaaaattaaatgaagaaaatagaaaaacaaaatttaaaaaatcagtgaaactaacagttgcatctttttgaaaagatcaatgaaatcgacaaaacattaactgaaataactaagaaacaaagagaaaataaaggaggagacattacaaatagtatcacagaaatacaaaggctcagaagagactactatgaacaattatacaccaataaatagaacaacctaggagaaatgactaatttcctagaaccataacatgtactaaaactgaatcataaagaaatagaaaacatgaacagaaaattaacaagaggattgaattagttatcaaaaacaatccaacacagtaaagcccaggacctgatggcttcactgatgaattctaccaaatatacatatatacgtatatatgtgtgtgtgtatatgtgtgtgtgtgtgtatatatatacatttttttcttttttgagacagagtgtcactctgtcacccaggcttgagtgcagtggtgcaatctcggctcactgcaacctccacctcctgaggatcaagcgattctcctgcctcagcctcccaagtagctgggactacaggcgtgtgccaccacgcccggctaatcttttgtattttttttagcagagatggggtttcaccgtgtagccaggatggtctagatctcctgacctcgtggtctgcccgtctcagcctcccaaagtgctgggattacaggcgtgagccacagcacccggccagaattctaccaaatacttaaagaattaatactaatccttctcagactgttccaaaaagcagaggaaatacttccaaactgcttttacaaggccagtagtgccctgataccaaagccacaaaagaacactacaagaaaagaaaattataggaaatgacccctgatgaatatagatgtgaaaatcttcaacaaaatatgagaacctgaattaaacagcacattaaaaggatcatacaggctgggcacggtgactcaggcctgtaatcccagcactttgggaggccaaggcaggtggatcacctgaggtcaggagttcaaggccagcctgaccaatatggtgaaaccccatctctactaaaaatacataaatcagccaggcatggtggtgtgcgactgtagtcccagctactcaggatgctgagacaggagacttgcttgaaccctggaggtggagagtgcagtgagctgagattacaccactgcactccagcctgggtgacagagtgagaatcaatctcaaaaaaaaaaaaaaatatatatatatatatatatatatacacacacacacacaaatttgtttaagttccttgtacattctggatattagacctttgtcagatggatagattgcaaaaattttctcccattctttaggttgtctgttcactcttatgatagtttcttttgctatgcagaagctctttagtttaattaaatcccattcgtcaatttttgcttttgttgcaattgcttttggcgatttcatcataaaatctttgcccgttaaaaagtgggcaaagtacatgaacagacacttttcaaagaaagacatacaggctgccaacaaacatatgaaaaaaagctcaacatcattggtcattagagaaattcaaatcaaaaccacaatgagatactatcccacgccagtcagaatgatgattgttaaaaagtcaagaaacaacaggtgctggcaaggttatggagaaatagcaacacttttacactgatggtgagaatgtaaattggtccatccattgtgggagacagtgtgatgaatcctcaaagatctagaggcagaaaaccatttaacccagcaatcccattactgggtatatacccaaaggaatataaatcattctgttataaacatatatgcacatgtatgttcattgcagcactactcacaatagcaaagacatggaatcatcccaaatgcccatcagtgatagactggataaagaaaatgtggtacgtatacaccatggagtactatgcagccataaaaaggaatgagatcatgtcctttgcagggacatggatgatgctggaagccattatcctcagcaaactaacacagaaacagaaaaccaaacactgcatggtctcacttataagtgggatttgaacaatgagaacacatggacacagggaggggaacaacacacactggagcctgtcaggggagggtgggggtggggagagcattagggaaaagatctcatgcatgctgggcttaatatctaggtgatgggttgataggtgcagcaaaccaccatggcatatgtttacctatgtaacaagccagcacatcctgcacatataccccagaacttaaaaaaaaaattaaaaaggatcatacagcatgaccaagtattatttatttttgagataaaaagctggctcaatatatggaaattactaaatgtgatacaccatattaacagaataaaagataaaaatcacgattgtttcaacagatgcaaaaagtttgataaaattcaacacaacttttttattattagtatactttaagttctgggatacatgtgcagaacgtgcagatttgttacataggtatacacgtgccatggtggtttgctgcacccatcaacccgtcatctacattaggtatttctcccaatgctatccctcccctagtcccccaccccctgagaggcccggatgtgtgatgttcccctccctgtgtccatgtgttctcattgttaaactcccacttatgagtgagaacatgtgatgattggttttctgttcctgtattagtttgctgagaatgatggtttctctcaactaattaggtatacaaggaatatacctcaaaataaataaggtcatatatgataagcccacagctaacatcatactcaatggtgaaaaactgaaagcttttcctttaagatgagcaataacacaaggtttacccttcttcccacttccacatgtcacaggactagaacccctagtcaggaaaattagacaagaaaaagaaataaaatacatccaatcaagaagtaagaagtaaaattatctctgtttgcagatgacatatagaaaatttaaggaccaaaaacaaaaaaactgttggaaataatacatgaattcagtaaagtggcaggatacaaaatctatatacaaaaattacttgcatttctatacattaacaataaattaacctaaaatgaaattaataaaacaatcccatttacaatagcatctaaaacttcaatacttgagaataaacataactagggaggagaaagatttgtatgatgaaaagtataagacactgataaaaaataaggatgacacatgtaaatgtaaagacatgttgagttcatcatttggaataattaatattgataatatgtccataccaccaaagcaatctacagattcaatactatccccatgaaaatttcattttttttcagaaatagaaaaaacacttctaaaacttacacggcaccataaagaccccaagtagacaaaatactcatgagcaagaagaacaaaacaaaagtcatcacacttcattatttcaagctgtaatacaaagctgcattaattaaaacagtacggtattagcataaatgcaggcatgtagaccaatggaacaaaatagagcacctaaccttaacccacacatatatgctcaagtgatcttctacaatagtggcaaaaatacacaatggggaaaaatagtccctttaacaactagcattggaaaaagtggatatccacatgcaacaagataaaattggactcttataccatacacaaaaattaactcaaactggattaaagttttaatcataatatcggaaactgcaaaactcctaaaagaaaacatggaggaaaagcttttgactttgttcttggcaatgatttcttggatatgacaccaaaagtataggtaactgaagcaaaaatacataggtgggactacataaaactgaaaagcttcttcacagaaaggaaaacaattaacagagtaaagagacaacttacagaatggaaataggaaatacagttgcaaaccatacattggataaagggttaatatctgaaatatataaggaactcaaacaactgagtagcaagaaaatgacccaatttaaaaatgggcaaaaaacctgaatagacatttctcaaaagaagatatacaaatgtataacaggtgtatttaaaaatggtgattcctcaaggatctagaaccagaaataccatttgacccagcaatcccattactgggtatatacccaaaggattataatcattctactataaagacacatgcacacgtatgtttattgcagcactgttcacaatagcaaagacttggtaccaacccaaatgcccatcaatgatagactggataaagaaaatgtggcacatatacaccatggaatactatgcagccattaaaaaggatgagttcatgtcctttgcagggacatggatgaagctggaaaccatcactctcagcaaactaacacaggaacagaaaaccaaacactgcatgctctcactcataagtgggagctgaacaatgagaacacatggatgcagggaggggaacatcatgcaccagggcctgtcggtaagtggggggcgaggggagagatagcattaggagaaatacctaatgtagatgatgggttgaatgggtgcagcaaaccacaatggcacatatatacctatgtgacaaacctgcacgttctgcacatgtatcccagaactttaagtataataaataaaacaaaataaaataaaataaaattaaattaaaaatggtcaacacctctaatcatcagagaaataccaatcaaaaccacaatgagatatcacatcaaatctgttaggaaggctattaccaaaacaaaaaaagataaaaagtgttgggtgcccttgagcattgttggtgggaatgtaaattggtacggtcattgtggaatacactagggaaattcctcaaaaattagaaatagaactaccatacgatccagtaatcccatctttgggtacgtatcagaaggagagagtaaaatgatgtttgccagggcctggggggaaagggaaaattggtagttcactgggtatgaagtttcagttctgcaagataaataagttcaagagatctgctatacaacatagtgcctatagttaacaacactgtattgtgcacttaaaaattttgttgagtgggtagatctcatgttaaatgttcttacctacctctcacccaccaaaaagaaggaagtaaatttaaggatacctgtagaatcactggagcagtcactaaaaaataatgcaaagtgagctggctggaagcaatagataaattaaaatgcaattctaaaacaatatctaattaacccaagttaacacaggaaaagagtaaaaggaaacaagaaattgattctccaaatagaaaatgaatattaaatgatagatctgagtaaatgatccaaccatatcaataattatattaaatgtaaatctatcaaatactccaactaaaggatataaattatcaatatggaataaaaaatgcaagaccaaactatatgctatctatttgcactttatatttaagacaggtaggttggaagtaaaagggttgaaaaaaatactatgccagcaataagcataaaaacgctgaggaagcgtaaagtcagcaagacggcagactacctttcagcacttatcccctctcagaacatcaatttgaataacaatacatacatgaaaatatctttataaatcctaaggaatccaaatgatagattacagaacctgggtggagcacagaaataagaaaagatgcatagatgagggtaataagaacagttttacattactccatcaccccttccccatgtgtgtatagtgcagtttggatataccctcaatatgtgggaaggagactgaagtgagcacatgacttcactgcagaccccagcaccaggaccaccccagtgttcctgggcaccaggtcaacccttacaaacccagacttcaggccctcccgactgccacatgtacccagtctccagaaagatctccacaacctaggctccaggcacactccagtgccagacctgcctccatggccccaggctccaggcccactgatgagaactaataagccaatgtagtaaagttgcaggaaacaaattcaacaggaaaaagcagttaatagttctacagagtaacaacaaactatctgaaaaagaaattaagaaaataatcccatttataatagcaaaaaaaatacttaggtgtaaatttaactaaggaggtgaaatatctggacactgaaaattatcaaacattgatgaaaaaattaaagaagacaaaataaatggaaatatatcacatgctcattatttggaagaattaatattttaaaattttccatacattcaaagtgatctacagattcaatgcaattcctatcaaaattccaatgccttttttttaaagaaatagaaaaaaatcctaaaatttgtataaaagcacaaaagaccctgaatagccaaagcaatcttgaggaagaagaacaaaactggagtcatcacactacctgatttcaaaacataccaaaaagctatagtaatcaaaacagaatggtactggcctaaaagtagacaaatagaccaaaggaacagaatagagagatcagcgataaatctgcacatttatagtcaattgatctttgacaaagcagccaagaacacacaatggggaaaggatattctcttcaataaatggtgcttggaaaactggacctccacttgtagaagaataaaattggacacttatcttacaccatatgcaaaaatagactcaaaatagaatatagacttaaatgtaatacccgaaactgtaatattcctagaagaaaacataggaaaaaattttcttgacagtgttccaggcaatactctcttggatattacctcaaaaggacacaacccaaaagcgaaaatagacaaatgaggctacatgaaataaaaaaagcttctgcatagcaaatcaaattatcagcagaataaaaagactatggaatggaagaaaatgtttttaaaccacatttctgagatggggttaatatttaaaatgtattaggaatttaaacaactcaatagcaagaaaacaaataacataattaaaaatgggcaaaggacatttctcaaaaaaacacatacaaattgccaataggtgtaataaagtatgttcaacaccaccaattatcagggaaatgcaaatcaaaaccacaataagatatcaccacacctgttaggatggcaattatcacaatgacaaaaaaaaaagagttggtaaaggtgtggagaaaagggcacccttgtacactgttgatgagaatgtaaatgggcagtttcattgtggaatacagtatggagttcctgaaaagctaaaaatagaactactatatgatccagtagtcccacctctgggtatataaccaaaggaaatgaaatcagaatctggaagagatgtcttcattcttatgttcatttgagaattattaacaatagccaatatatggaagcaaactgagtgtccatcaatggatgaataaagaaaatgtggtgtacatatatatagtgttcatttatatatgattatatattatatacacatgtgtatatattgtatatgtatatatacacacacatatataatggcactattcagttttttaaaaagaaaatcctctcgattgcaacaacatgtatgaacctggaggacgttatgttaaatgaaataacctagggacaaaaagacacatactgcctgatgtcacttacgtgtggaatctaaaaagtcaaactcgtagaaccagacagaaggatggtggttgccaggatacgggtgagggaaaatggggcgacattggtcaaagagtacaaagtttcagttatgcaagatgaacaagttctggggatctaatgtatggcatggtgactgtagttaatagtactatatatgtactcaaaattaactgagagtagactttaaatattttcacctcaaaaaaattgtaactatgtgagctaatggatacgttaattagctttattgtggtaatcatttcacaatgtatacatatatcaaaacatcacatggtgaaatttaaacatatataatttttgtcatttatacctcaataaagctggaaaaataaatgagctaatacacagggactggggagagggaagagttacaggcagagaacagaggaattttagagcagtgcaactactctgtataataccataatggtggatacatagcattacacatttctgtccaaattcatagaatgcacaatatcaagagtaaatcctgtctgggtacagtggctcacagcactttgggaggctgacgctggtggattgcttgagcccaggagttcaagaccagtctgagaaacatggcaaaaccccatatccacaaaaatgagccgggcacggtggcccgtacctgtagtctcagatactcaggaggctgagctgggaggatcacttgatcctgggaagcagatgctgcagtgagccgagatcttgccactgcactccagcctgggtgacagagccagatcctgtaaacaagcaaacaaacaaacaaaaacacacagagtaaatcctaacgtaaattatggacttgaggtgataatgatgtgtcaatgtaggtttatcaattgtaaggaaggtatcacttagatggcagatgttgataatcaagaaagttttgcatgtgaggaggcagagggtatataggaactccgtaccttctgctcaatattactgtgaccctaaaacttctctaaaaaataaagactatttttaaaagtctggatttgctacatggatatcaaagagagcaggcttcaaaacaaagtcttaacagacttatttattgctagatatataaaaagtgatttcataataataaaatatttaattcatgaagacgacaaaataatcaaatgtgatgaataacagagcttcaaaatagaaaatgcaaaatttgacaaaattagagagaaaaaatccacaggccgaagtgcaaattttagtatgtctttctcaggaaatgatagaagaactgatcaaaagaaaacagtaacagaaacactatagtgatcaacactctcagcaaatttgaacttactggaatttataaaatagtacactagcagctacaagatatacattattttttagaattatggcatatcaaatatgaaagaatattactgggccaaaaagtaattctcaagattagtcaaaatactgaaatcctacagagtatgttaactgataacaattcaatgaaatattgtttttgtccaagagaaatgaaagcataagttcacaaaaagtttcatacaatacacgatgaaatactattcaaccttaaaaaaaatgagaaaatcctgtcatttatgacaacatgaatgaacctgaaggacataatactacgtgaaataagctggccacataaagacaaaagctgcatgatctcacttatatgtaaaatctaaaaatgtcagcctcattggagcacagaatagaatggtggttaccagaggctacagagtgaaggggggatagcaaaagtgaagatgttggccaaaggatacaaagcttcagttagaaaggaagaataaattttagtgatctattgcacaacatgataaccatagttgataataatgtattctatattttttgactgctaaaagtggattttaaaattctcacctcattaaaaataagtgaggtgatgaatacgttaattagcttgattttctatttctacaattgttgcatatatgaaagtgtcatactgtaccccataaagacatacaattatttgtcaacttgagattttaaatggggaagtaaagaaaataaatgtatgaaaacatattgaaaactaaaaaatgattatattggtcaaataataaacacttagaaagtacaaaatttttaaaatccataattacacttataattgtacattaagttcataattttatatatacagtcgtcctcaatatccatgggcagttggttccaggacccatcacagataccaaaatccacagatggtcaagtccctgacctaaaatagtatactatttgcatataacatatgcacatccttccatatactttaagttatcactagtttatttgtaatacctaatacaatgtgaatgctatgtaactagttgttatactatattgcttcaggaataatgacaagaaaaaatatctacatgtgctcagtacagacaaaaccatcatttttgtttttcaaatatttttgatctgcagttggttgaatccatggaggcagaacccacagggccaactgtatttgtacatgaaaattcaaataaatctacaatataataccaacactaataagtaatatagcataaaaggtcaatatacaaaaatcaattgtgttttagttattagaaacaaccattgaaaaatgaaacttcaaagaacaagactaataacaacagtatcaggagtaaatggcattgaaatacatttaacaaaagatgcacaatactgttatatggaaaactacataagtttctaagaaaaattaagaaagatctaaataaaaagataataccatgtttgtgattgtaagacttaatgttaagatatcaattttccccaaatttgatgataaattcaacacaattacctagcaggatttttatagaaaaattttttttcaaaattatgatgctgagtaaaatttttatataaattgataaatttattctaaactccataaggcaacacaaaattcttaattaatgtaaagatacattaactaagacagtgtggtattagcataatagaaaaataaataagttgaacaaaatatagagtccagaaataaactgacacatataccatcaattgattctcaataaagtcctcaaagcaattcaattggagataagaatgtctgcaataaatggtgctgaaacaactggatattcctgtggaggaaaaaatgaaacttaaccttccctcacaccatactcccaaattatgttgagaatgattatagatatcagtgtggaagctggaattataaagcttctgaaagaaaataggaaaatgtcttcaaggctttgaggtaggctaaggtttcttagatacgcataagggcaatatccataaaacaaaacaaatgataaattaggtctcaacaaattttaaaacctttgttcaacaaaacacaccattaagaacgtgcaatagcagtcacaggatggaagaaaatattttaatatatatatgtgacaaagacctcatatctggaaaatataaagaattctacaaaacaataataaggttaataaacaacaaaaattggcaaaatatttcaatatacactgcactaaagaatatagatagcttaaagaaaaaaacaataaaaattcaggaaactgtggacacacttttagaaacgcataatgctctggaaagtctcagcaatagaatcaaacaagtagaggaaagaaattcagagcttgaagacaaggtcttcaaactaactcaatccaacaaagacaaagaaaaaagaacaagaaaatatgaacaaagcctccaagaagtttgggattatgttaaatgaccaaacccaagaataatcggtgttcttgaggaagaagacaattctaaaagcttggaaaacatatttgggggaataatcaaggcaaacttccctggccttgctagagacctagacatgcatatacaagaagcacaaagaacacctcggaaattcatcctcaaaagatcttcatctaggcacattttcatcaggttatccaaagttaagaggaaggaaaaaatcttaagagcggtgagacagaagcaccaggtaacctataaaggaaaacctaccagattaacagcagaaatctcagcagaaaccttacaagttagaagggattggggccctatattcaacctcctcaaacaaaacaatcttcagccaagaattttgtatccagtgaaagtaagcatcatatatgaggaaaagatagtcattttcagacaaacaaatgcagagagaacttgccattaccaagccaccactgtaagaacttcaaaaaggagctctaaatcttgaaacaaatcctggaaacacatcaagacagaatatctttaaagcgtaaagcacacaggacctataaaaaaatagaagttaaaaagcaagaacaaaaaacaaagtatgcaggcaacaaagagcatgatgaatgcaaccctacctcacatttcaatactaacattgaatgtaaatgtcctaaatgttccacttaaaagatacaaaactgcagaatggataagaactcaccaaccatctgctgccttcaggtgactcacttaacacataaggactcataaaaacttaaagtaaaggggtggaaaaaggcatttcatgcaaatggacaccacaagcaagcaggggtagctactcttatgtcagacaaaacaaattttaaagcaacagcgagacaaagagggacgttatataatggtaaaaggccttgtctaacagtaaaataccacaatcccaaacatatatgtacctaacactggagctcccaaatttattaaaaaaattactaatagacctaagaaatgagatagcaacacaataaaagtgggagactttaatactccactgacagcattagacaggccatcaagaaagaaagttaacaaagaaacaatggatttaaactacaccttggaacaaatggacttaacagatatatacagaacacttcatccaacaacagaatacagattctattaaacagcctatggaactttctccaagatagaccatatgataggccataaaacgagtctcgataaatttaagaaaattgaaattatatcaagcactctctcataccacagtggatttaaactggaaattaactccaaaaggaaccctcaaaacaatgcaaatacatggaaattaaataacctactcttgaatgagcattgagtcaaaaacgaaatcaagatggaaatcaaaaaattattcaaactggatggcaataatgacacaacctatcaaaacctatgggatacagctaaggtgatactaagagaaaagctcacagccctaaatgcatatatcaaaaagtctgaaagagcacaaacagacaatctaaggtcacgcctcaaggaactagagaaagaagaacaaaccaacccaaacccagcagaagaaaggaaataaccaagatcagagcagaactaaatgaaattgaaataacaacaacaaccaaaaaaagtacaacagataaatgaaacaaaaagctggtcctttgaaaagataaataagattgatagaccattagcaagattagccaagaaaagaagagagaaatccaaataacctcactgagaaatgaaacaggagatattacgactgataccactgaaatacaaaagatcattcaaggctactatgaacacctttatacacataaactagaaaacttagaagagataaataaattcctggaaaaatacaaccatcctagcttaaattaagaagaattagataccctgaaccgaccaataacaagcagcaagattgaaatggtaattaaaaaattaccaacaacaaaaaaagtccaggaccagatggattcacagcagaattctaccagtcattcaaagaattggtaccaatctttttgacactattccacaagacagagaaataaggaacccttcctaattcattctatgagccagcatcaccctaataccaaaaccaggaaaggatacaaccaaaaaagaaagctacagactgatatccttgatgaatgtagatgctaaaatccttagcaaagtactagctaaccgactacaatgacatatcaaaaaaataatccaccatgaccaagtgggtttcataccagagatacagggatggtttaacatacacaagtcaataaatgtgattcaccacataaacagaattaaaagcaaaaatcacatgatcatctcaatagatgcagaaaaagcatttgacaaaatccagcatccctttatgatcaaaaccctcagcaaaattggcatacaagggaactaccttaatgtaacaaaggcacttatgacaaacccacagccaatataataatgagtggagaaaagttgaaagcattccccctgcgaacgagaacaagacaagaatgcctgctctcaccactcctcttcaacatagtactggaagtcttagccagagcaatcagactagaaaaagagataaagggcgtcgacattggtaaagaggacgtcaaactgtccctgtttgctgacgatatgattgattaccttgaaaaccctagaaagctccagaaacctccagaaagctcctagaactgataaaagaattcaggaaagtttccagatccaagattaatatacacaaaacagtagctcttctatacaccaacagtgaccaagtggagaatcaaattaagaactcaaccccttttacaatagctgcaaaaataaataaataaataaataaataaataaataaataaataaataaaatacttaggaatatacctaacaaaggagtcaaaagacctctgcaaggaaaactacaaaacactgctaaaagaaatcatagatgacacaaacaaatggaaacagatcccaggctcatggacgggtagaatcaatattgtgaaaatgaccacactgccaaaagcaacctataaattcagcacaatccccatcaaaataccaccatcattcttcacggagttagaaaaacacaattctaaaattcatatggaaccaaaaaagagccctcatagccaaagcaagactaagcaaaaagaacaaatctggaggcatcacactacctgatttcaaactatagtataaggccatagtcaccaaaacagtgtggtactgatataaaaataggcacatagatcaatgaaacagaatagagaacccagaaataaaccccaaattcttaagccaactgatcttccacaaagcaaacaaaaacacaaagtggggaaaggacaccgtattcaacaaatggtcctgggataattggctagccaaatgtaggagaattaaactggatcctcatctctcaccttatacaaaaatcagctcaagatggattaaggacttaaacctaagacctgaaactataaaaattccagaagacaacattggaaaaacccttatagacattggcttaggcaaggatttcatgaacaaaaactcaaaagcaattgcaataaaaacaaagataaatagctgggacttaattaaactaaagagcttttgcacggcaaaaggaacagtcagcagagtaaacagacaatccacagagtgggagaaaatcttcacaatctatacatctgacaaaggactaatatccagaatctacaatgaactcaaacaaatcagtaagaaaagaaaaacacacaaaacaaaacaaaacaaaatcaatcccataaaaaagtgggctaaggacgtgaatagaaaattctcaaaagaagatatacgaatggccaacaagcatatgaaaaaatgctcaacatcactaatgagcagggaaatgcaaatcaaaaccacaatgtgatactaccttagtcctgtaaaaatggccataatcaaagaatcaaaaaacagtagacgttgacgtggatgcggcgattagggaacacttctacactgctagtgggaatgtaaactagtacagccagtatggaaaacagtgtggaaattccttaaagaactcaaagtataactaccatttgatcaagcaatcccactactgggtatctacctagaggaaaagaagtcattgttccaaaaagagtcttgcacacacatgtttatagtagcacaattcacaatagcaaaatcgtggaaccaacccaaatgcccatcaatcaacgagtggataaagaaactctggcatatatatacgaaggaatactactcagccataaaaaggaatgaattaacaataatgacctggatgagattagagactagtattctaaatgaagtaactcagcaatggaaaaccaaacatcgtatgttctcactgatatgtgggaactaagctatgaggatgcaaaggcgtaagaattatacaacggactttggggacttggggggaaaagtgcaggggggcaagggataaaggacaacaaatatggtgcagtgtatactgctcgggtgatgggtgcaccaggttgtcacaaatctctattaaagaacttatgtaaccaagtaccacctgtaccccaacaacctatggaaaaataaaattttaaaaataatatatataaagatatacaaatgcccaagaaacaaggagaaggtacattacaagtcatcatagaaaatctaattaaaactataatcaaatatcactacacattcacaagaaagggaaaaacgtcaaattacattcactgattgtcaatagaaagtgttgtcaaggatgtgaagcaactggacctgtcatacatgaaaggtggaagtttaaaatagtgcagccactttgaaaaagtctgcgtcagtttctcaaacatacctacacctataatccagcaattctactcatatgtatataaccaatagactggaaatcatatgttcacaaaaaaacttgagcaagaaagttcataacaactttattcacaatagctaaaaattgggggaaaaaacaaagtccacagcagtgtaatcgataaacaaactgtggtacagtcatacaggctctatttagtactaaaatgaacgaactactgataaatgcaacaacaggtatggatctcaaaactgtgatgatgagtgaaagaagcgacacaaaaaggaatatataccctatgatttcatttatatgaagtgcaggaataggcaaaattcatctatgatatgagaatggtcacttaaaggatgggatagtgactggaaagggcacaagggaactttctggggtcatggaatattctttacctcgatcagggtgatggtcacattaatgtattcatttgttaaaattaatctttttgtttaagatttgtggttttcattacatgcgattatatctcaataaaacagtgagaaaaccaaaacaagaggatcacttgaatattcctataactatcaaagaaactaaaaactaaacatctcccacagagaaaatctaggccaaaatggctttgctgcaatttccagcaataattcaagaagaaagtaattacgatctaacaaaacctcttccatagaataaataaaggtataacactcccaaaattattttttttgaggctagcataaccttgagatcaaaacctgacaaggactgtatgaacaaataaaattatatgccattctgactcatggccatgaatgaacaaatcctttaaaatgttcataaatcatatccaccaatatctaaacagcctaatacatcacgacctagctggatttatcccaggaaggcaattctggttaaaatttttaaaatgtaattcagcacattcatattttagagaacaaaattttgattatataaagaggcataagcaaaaagttcttgataaaatttaatatataccaaaaaatacaaaacaaaggatacaagggaacttaatatgatacaatgtatctagaaatatctattcaaaatattacacttatctgtaatatattaaaatactggcctttgagattggggatgtaacaaaatggctgccatcatcactactattcaccattatagtggaggtcctagacaattcaacacattaataagaatagaagtatgcaaaaagaagtgtaaaactgtcgtttatatattatataattgagtacataaaaattctttaaaaatctatggataaactgttacatttacagtgggactttagtaaaattgctggatacaaaaacaatatatgaaaaataattttttagtcctataagtgaataagaaacatttaaatcattgaaagatcctagttataatagcatcaaaaatatctattcaaaggccaggtgcagtggctcacgcctgtaatcccagcacttttggaggccgaggcgggtggatcacctgaggtcgggagttcaagaccagcctgaccaacatggagaaaccccgtctgtactaaaaatacaaaattagccggggtggtggtgcatgcctgtaatcccagctactcaggaggctgaggcaggagaatcgcttgaacccgggaggcggaggttgcggtgagccgagatggcgccattgcactccagcctgggcaaaaagagcgaaactacatgtcaaaaaaaaaaaaaatctattcaaatatgcttctgaataaaagtatgtgagaggcaacaatcttctacaactacaaaaaactggatgatttacaaaaatcatcatgttaaaggtaccaaatagtggtggaaacaaagattaaataaattaaaatttcaaggagagagaatcttttccactataagctgacaatcttcaactatttttctcctttggaaaatttaccaactctgagaataggctgaggaccaggcttattcagacaaagagcctctgctcgcagagagaaaaaacagcaaagcttttagcagtttgacaaggctggtatgacaaatacaaaagctgatgatactcaagtgctcagcagattttccccactgaacatttgctgacttctggcatagttgggtaaaatacttgtaaaaaggtgaagcaaaatcttcagcaatcacccagttcttaggaaacaagcatgtgccagaatttgaaactccaggaggctgcaagttgtgaatagcagatctggattttccaggctttcagagattacaaaatagaaatctaccatgctcttacatcctagggaaaagaagcaaaccagacgtagactgagttttaataaaactgcactctagccctcatcatgaataatttctgactggattaaattaagcatatgctcaacttatgtgcctaaaaggggaaaagtggaactgtctctggaatatctcatctgaagcctctacaattttttatacatggtgcgtgacatgcaataaaaatattactagatacacaaagaggtaaaaaatatgacatgtaaatcaaaataaaagatgaaaaaagatgcagaaacacacatgatctggatagtatctggatagtgaaatcacgagaaaatgactttaaaattaactatgactaatatttttaaaagaagtaaagaaaaagttaaataaaatatgtgaaagaaccaagaactgtaatagataatttgaattaatggaactaaaaatcaactggatatcttacaatgaaaaaactaggaactcagtgcgtgggattaatgggagatgtgacacaaaagaacaggtttgtataactccaaaattatagaaaatattaaaattgaagcacaagaacaaaaataatcgggaaaaaaagatagagcataagacatatgtaggacagagtaaaaaaacaactaacaaatatggaatgggagaagagaaagaatagggcaggagcaatacctaaagaaataatattcaaaaagtttacaaaattaataaaagacatacacccacagaatcaaaaaactcagtgaatcataaacaggataaataaaaagaaaaccacacctaggcacatcatagtcaagttgttaaaaaaaacaaagagaccaagaagcagcttctctgctccttctggaatctctgcctggttcagcccacctgcctccactcctgcctccaccatgtccatcagggtgacccagaagtcgtacaaggtgtccacctctggcacacgggccttcagcagccgcttctacacgagtgggcccggtgcccgcatcagcttctccagcttctcccgagtgggcagcagcagcttctggggtggcctgggcggaggctatggtggggccagcggcatcggaggcatcaccgccgtcatggtcaaccagagtctgctgagccgccttaacctggaggtggaccccaacatccaggccgtgcgcacccaggagaaggagcatatcaagaccctaggcaaatttgtctccttcatcgacaaggtaccgttcctggagcagcagaacaagatgctggagaccaagtggagcctcctgcagcagcaggagatggctcagagcaacatggacaacatgttcgagagctacatcaacaaccttaggcggcagctggagactctgggccaggagaagctgaagctggagacggagcttggcaacattcaggggctggtggaggacttcaaggacgagaatgaggatgagatcaatatgcgtaaagagatggcaaatgaatttgtcctcctcaagaaggatgtggatgaagctgacatgaacaaggtagagctggagtctcgcctggacgggctgactgacgagatcaacttcctcaggcagctgtatgaagaggagatccgggagctgcattcccagatctcggatacgtctgtggtgctgtccgtggacaacagccctccctggacatggaaagcatcatcgctgaggtcaaggcgtagtacgaggtgatcgccaaccgcagcctggctgaggctgagagcatggaccaggtcaagtatgaggagctgcaggtgctggctgggaagcagggggatgacctgcggcatacagactgagatctccgagatgaaccggaacatcagctggctccaggctgagactgagggcctcaaaggccggatggcttccctgtggaggccgccatcgcagatgccgagcagcttggggagctggccgttaaggatgctaacgtcaagctgtccgagctggaggccaccctgcagcgggccaagcaggacatggcgaggcggctgcgtgagtaccaggagctgatgaacgtcaagctagccctggacatcgagatcgccacctacgggaagctgctggagggcgaagagagccagctagagtctgggatgcagaacatgagtattcatatgaagaccaccagcggttttgcaggtggtctgagctcggcctatgggggcctcacaagccccggcctcagctacggcctgggctccagctctggctctggcgcgggcttcagctccttcagccgcaccagctccaccagggccccggttgtgaagaagatcgagacccgcgatgggaagctggtgtccgcgtcctctgacgtcccgcccaagtgaacagctgcggcagcccctcccaccctgcccctcctgcgacttgcccagagcccgggagggaggccgctgtgcaggggagcacagggaacagaagacacacctgaggctcggctctagccctcagcccaccctcggcggaattcactgcctgaggaccacccttgcccatgcctccaactacaaaacaattcaattgcttttttttcgtccaaaataaaacctcagctagctctgcaaaaaaaaaaaaaaaaaaaaaaaaagatacagaatctttaaagcaaccagaggaataaaagacaccgcatttagaagaacaactggaaaacggaaggcagaattcccaaaagaaacaaggtcagtcagaaggtaatgttataacattttttaagtgctaaagtaaaaataagcacatagaactaccaacatataattctacacccaaagaaaatattattcaacaatgtgggtgaaataaagaggctttcatatgaacaaatattaaaggaattcctcaccagcagaccaacactgaaagaaaacaagacaaaaacaaagaaaattcttcagtcaaaaggaaaattatgctagatggaaacatgaaaatgcaaaagggcatgaagaacaccggagagaataaatacatgggtaaaagtaaatatatatttagattgcataaaacagtaattagaatattttgtacagtctatatgcaaaatgaaatgtgaagtgaaaatacttgacaaaaataatgcaggagggtgaaaaaaggggtaagcactgtttaaagtttctagtagcataaagatgtggtataaatagtttgtatttgactgtaataagtcaaaaattcttgctgtaatttctaaggtcgctactaaaatagcggaagaagatataactgacaaattaatagaaaaaaacattctaaatagaaacattgactatgctaaaagaaggcaagaatggaagtaaaagggaatatgaaacaggtgattcaaatagaaacttgatgattttgtggcaaatatattctaaaccaaattatatatcagtaattaaatttaataaaaataagtcaaatatttacaagtaaaatattaagatggtcagaatggatttttaaacccaaatatatgctagttacaagaaatatagcttaaatattaacatggcaaaagtttaatataaaaggaatgaagagaagtcatgaaccaaaaaaacagataatgaaactgtaatcaggaaaatcaagaagcaatactagagaaaaacaaagttatttcataattataaaaggatcaataaaacaagaagacattatcatagtcctctgtgggaagtgttaaagactttgtggacatcttcaacctacctcaagtctcaatcaagataacagcagagatttttgtggaaactgacaagctgattctaaaatccatgtagaaaagcaaaaagctaaaatagtcagaggcaatcttgaaaaaaaaagaacacatctggaagacctacactaccatatatcaagctatggtaaataagaactgtggtattagtgcaaggatatactaactggaatggttatagatataatggaataaagaattcaggcaaatattatcacccaatttttttttcataaaggtgacattgcagtgcagaggtgaaagtgtagtctttcaaataaatagtgccatattaaatgcacacttatatggaaaaaactgcaattatatcacaaagtcacaccatacgaattgcaaatgagttgaaaaattttatgtcagaagtaaaataataaatattttatagaaaatatctttaaggataacctctttgtgactttggtataggcaaagtttttttaaaaaaaaataggacacaaaaaacactaaccattaaagaaagaaatggtaacttagaccacactaaaattaagatctgttcatcaaaaacaccaataaaaaatgaaaaggtaatccacaggataggagatgacattagaaatacacatatctggcaaagaacttctaccatgaatatataaacatacatacatatatagatagatagatagatagaacatagatagagataaaaagacaacctatctaaaaaactagacaaatgaacataatgaaaaggatattaaaatatccaacaaatatttgaaaagctgtttaacttcattctcatcagagatgcaaagcagcaaattaaaaccacaaaggatagtactataccaccacctgaatagctacaatgtagacaaaaagtattaaataccaaatgttgacaaaaatgtctagatatgagataatggtcaatgttgaacacctggctctcttagaaatgaatatataagatccctgatttatggctttttttccagtctccatactgtaaatactaccaccatagccaatttcaggcagccatcctgagaccactgaatgcagaattgagaagagatgcccacaattggtccttgaaagccagtatgacccagctccagaacaccaccaatgtgcagcaacaataattctcacatattgttggtgggagtgtaaattgatacaaccggtttagaaaatcggcagtttctcctaaagttgaagacatgcatacctttattccacagcacttctactctggggtatgtacccaacagaaatccatacatgtgttcaccaaaagacatgtttgaggattctcataacagtgttcatatgtaaaagctaaaatctggacactacccaaatccccatcaacagtttaaaggataaacaaattgtaatatcgtgatataatggagtactatgcatcatcagtcaatgaactgcagcccacaggaaaaatgtgaccagtcccttatttttttatagccccttagtgaagaatgtttgttacatttttaaatggctacatttttaacagttatacaattacctacataaagtcatcaattttgcctcttgacctacagggattgtgcaatttgctatctggccctttaacaaaaagtttgctgatctttgctataaatcagtgagagtgaatgatttacaacagtgatctcaaagtatggcccctggatcagcagcattagcagcacctgaaaactggactcccagcctccaccccagacatactgaatcaaaactctgggctgtgacccagcgattcgtgcttgaacaagccctcttggtaattgtgatagatgctaaagtttgagaaccaatgatctacaattctaaacatgaataaatatcacaaacataatgttgagtgcaagaacatagatgcaataaagaacatactatataattccatttatataaaatttaaaaacatgtacaagtattctgtttaaaaatcaagacaatggctacccatggaaagggaccagtgactggaagggagcatgaggtgagtttttgcaatattaaattggcttgcagattgctgccttccggctgtgtccttaaatggcagagagagacaaagagagagggagagagagagcacgccagagagagagagagcaagcacactttggtgtctcttcctcttcttataggggcaccagccttttcaaatgagggtcctaccattacaatttcatttaacctttatcacctcctcacagaccctgtctccaaatacagtgacattgggcgttagggcttcagcatatgaactttgagaggacgcaagcattcagtccataatatattctaaaggaaactggaagcacattcttcaggcagaagaaaagtaatcccatatggaagcttgggaatgcaacaacaacaacaaaatgaaataaaatggtaataatattaaagagtactgataggccgggcgcggtggctcacgcctgtaatcccagcactttcggaggccgaggcgggcggatcacgaggtcaggagatcaagaccatcctggataacacggtgaaaccccgtctctattaaaaatacaaaaaaatagccgggcgtggtggcgggcgcctgtagtcccagctactcgggaggctgaggcaggagaatggcgtgaacccggaaggcggagtttgcagtgagccgaccagcctgggcgacagagcgagactccgtctcaaaaaaaaaaaaaaaaaaaaaaaaagagtactgataatataaacaataatgtcttgctggaatacaagaatgtaagacaaaaaataaatgataggtcatagataaagcattcatgaagcaagtaaaagtgtcaattcatattaaactcttatgagttaatgaatttccatttttatagtaaacactaaaataatagcaaaaaggtataaaatcttcaagctaatagagtatatatgtgtattttagaatgcttgaatatactcaatctatattcattctaaaataaggcaagcaagagaaaataagaatataggcaggtggaatgaatagaaatcacttaataagctgaacatttttaatgcaaatgtatttgtaattatagtaactatacatagagtaatgctccaattaactaaatactgtccaactggatcctgccaagtctcaactatatgctatttatagaacacaacttcaaaacataaagggaaaagagtgaaagtaaatgaatgggtaaagaccatgcaaactctaaccaacatgtggctggtatagctatgacaacatcagataaggaagactttaaagcaaaaagaattaccagagaaaaaaatgacaatagtaggtaaaaattaagaattaaatttatgaggaaatattaactattctaaatttatatacttagtaacatgtcttcaaaatatctaaagaaaacactgacagtagtaaaagaagaaaaagaaaaacccagaaacatggtaaaatttaatacactttcatcagtaaatgatggaataaacacaaacaagttagcaaagacaaagaatatgcaaaagaacattaaaccaagtaactatagaatacatattctccaaatacccacacaacatgtagagaactgtccattttgctgggccataatacaattatctacatatttcaaatgaacaaaatcataaaataattttttagctataatataatcatattaggaaacaataatgaaaaagtaactagaaaagtcccattgtttagaagttaagcaatatgcttgtaaataatccaacggaaatcgaaaatattatgaactgaataatagcaaaaatactatttagtaaacttactatttattaaaacttacaggatttgacttctacttctgagtaaaatggaatagttcatggcaggtcaatatttccactgaaaacaattagaaaaaagatagatttcaaaaattatatatatatttatagacacccaataactgtagaagtaagcaagactagagggaatacaattccagaatgaggacagtctttcggaggtaaactgaggctccacagctgtctccgagaatatgtcctgattctgaacatggatctgagcttgagaatttgagctaggtctaggtggagagctgctgctgatggactttttgacagctacacagagctgaagtaaaaaaatgtagattagacaggcctcaaatagacaatttatttctccttcaagatatttgctaaactccaaagctaaactgaagaggaagataaagagattaagccaaaacttaaagcaaagtagaattatttccacagtctctaggtgattaggaggcaaaggttgggggtacaggattggcaggactaagaacaaataacatatgaaagcattagagggagtagtaaattaacacccacatcttccaaccaccttttgcagatctggaacctgctgaaagataagaatccacacttggtccttggcagaacttttggcagacggtaatgacaaaattggagtcttgaaggatgctaaatgcacagctggtctctccctcaaaagatttgccaaattctgaatcttcacagggcaagaggctaaagaaataattcaaaaacctctgaatcacacaggaaaaaaaaatgcccatagtctcttagcactgaggttacaaagacctgccatgtactcaaataaatgtcctggggtacaagccatagaaatggtaaattgagattcattaaactaaatgccagcttccaccagctcagtctgtgattaaagtataatatttagctccctactctatctgcctagcaaaggagatttggataattacacaaggctgaagcggcagaacttagattagacaggcctccaatagatgactatagacaaattatagatcatgtgaaatctataatagctggtgagggggaaatcatgtgagataataagtataaaagcgcaataaatgatatgtattcagatatcttaattttacaaacaaaatgttgaccaaaaagacatcagctttgaagacagacaggtctgtgtataaaccacatactcagaaatagttttttgaccttaaaaaagttatttaaccttctaggcttcagtttatttatttgtaaatggaaataaataatagcaagcagagaatatgctctcataagaattacgagataatacatttaaagtaattaaaacaatctctgaaatgtaaaaaataatggtttcattattattgctgtcgtcattactactgtgacaaagaaatagtagcttttagaatactttccattttgccaaatgcctttgcatttattatctcacttgattcctccctgcaattaatataaatgaaccaaagatcatgttctgcatatttcaaataatgaataaactgagactcccaaaagagaaatgacttgctcagagacaggcaacaaggtactgaagaaccaggactagagccctcagctattcacacttgtcccgctttgtacaactccacattacctgcaaacaggatatgaatctattccattacgcatattgaactcaaatgttgtctgctgctgaatggggcttaggagcattttctcaatatccaaggatgacacaaacattcagctgattgagtactaagataaatcttacagttcatttattctatcaactttcccctgccctcactcatgccatcacattcctccatagccaacttaaagtccatggcatggtccatcattctaatcacttccttgtgcacacaacacaataaacttccttgtctctatctcccttcatcatactaaattagcaaaacaaaattctggttaaatctaattcattgcctactcttaagccgtgcctgactgagcagctgaatatgtgaatgtaactggaccaaaaatacataaccaagttggcttctccaaattcaagctgatctttggtgctgttcaacaatcctaccacatgtcctttccatctattttcccactctccaagaagaccatttctcaccttctctttactgaaattgcctcacctccttcctatcctccctctcaattgatgcccttgctttctatttcattaagaaaatctaggccatcagaagagaatgtctatatgcttcccacatctccttgcccaccagtatcgtgcatacatattatgctttctttttagtgactatggataaactgtccttgctcttacccctccacttgtgaactgtgtgtcaacttctctgtccttttaaggataacactatagaaattctactctcttgtgaatcactacttatttctttttactggagaatcctcatcagcattctgtgatacatctcatttttgaaacctttctcttaaacccacgtcttctcccagctacaatctcatttgctgcctttacagcaacactcttttaaaaagtcatctaaactcactccctatccccgattttttatattttccaagttttattgaggcatgattagaaaattcaagttgtatacagttaaagtgtatacaatatataatttggcgtagtatatattgtgaaattattataacaatcaagctaaattaacacaccactacctcacatagtttctgctttttttctttattaggaggtgtgaatgcttaagatctacagctttaacaaattttaagtatacttattattaactatattcaccattctgtatatcatattgccagaacttattttgtaagttaaagttttgaccgaaatctccctacttccccaattccacagcctctggcaaccactgttctactgtcttctttgactgttctagattctacatataagtctttctttgtctggctagttttgcttagcataatgtcctccaggttcatccatgttgtcacaaatgtcaggattacttttttatggcttaatcgtactccattgtctatatgtgcaacattttatttatccattcatctgttgatggacagagactgcctctatatcttagctattgtaaataatgctgaaatggacataggggtgcagatatttcttcaagataattgtttcatttcctttgggtatatacccagtagtgggattagtaaatcatatgatcaagtctgcttctgaagctctgtcttgaatttgtcttttctgtcacattcttcagctgtttggtcattttttacagtttatgtttcttcattaaacttcttattttgctcatgtattgtcctcatttcatttagtattctgtgttcttgatatggtttggctgtgtccccacccaaatctcatattgaattgtagttctcatagtccccacatgtagtgggagagacctggtggaaggtaatagaaacgtgggggtggtttttcccaggctattcttgtgatattaagttctcacgaggtcagatggtttcataaggggcttcccccttcactcagctctcattcttctccttcctggcatcttttttttttttaaaaaaaaaaggagaaaatttttgcaatctactcagctgacgaagggctaatatccagaatctacaatgaactcaaacaaatttacaagagaaaaaacaaacaatcccatcaaaaagtgggcaaaggatatgaacagacacttctcaaaagaagacatttatgcagccaacagacacatgaaaaaatgctcatcatcactggccatcagagaaatgcaaatcaaaaccacagtgagataccatctcacacctgttagaatggcgatcattaaaaagtcaggaaacaacaggtgctggagaggatgtggagaaacaggaacacttttacactgtcggtgggactgtaaactagttcaaccattgtggaagtcagtgtggcgattcctcagggatctagaactagaaataccatgtgacccagcaatcccattactgggtatatacccaaaggattataaatcatgctgctataaagacacatgcacacatatgtttattgcggcactattcacaatagcaaagacttggaaccaacccaaatgtccatcaatgatagactggattaagaaaatgtggcacatatacaccatggaatactatgcagccataaaaaaggatgagttcatgtcctttgtaggcacatggatgaagctggaaaccatcattctcagcaaactatctcaaggacaaaaaaccaaacaccgcatgttctcactcataggtgggaattgaacaatgagaacacatggacacaggaaggggaacatcacacaccggggcctgttgtggggagtggggaggggggagggatagcattaggagatatacttaatgttaaatgacgagttaatgggtgccgcacaccaacatggcacatgtatacatatgtaacaaacctgcacgttgtgcacatgtaccctaaaacttaaagtataataaaaaaaggatgtgtttgcttctccttctacaataagtctaagtttcctgaggcctccccagccatgctgaactgtgagtcaatctaacctcttttcttttaaattgcccagtctccctcatgtctttattagcagcacaagaatgaattaatatagtagattggtactgctagagtggcttgctgctataaggatacctgaaaatgtgaaagtgacttaggaactgggaaacaggcagaggttggaacagtttagagggctcagaagaagacaggaaaatgtgggaaagtttggaacttcctagagacctggagggctcagaagacaggaagatgtgggaaagtttggaacttcctagcgacttgttgaatgactttcaccaaaatgctgatagtggaatggacgatgaagtccaggctgaagtggtctcagatggagatgaggaacttgttgaggactggagcaaaagtgactcttgttatgctttagcgaagatactgctggcattttgcccctgccctagagatctgtggagctttaaacttgagagagatgatttaaagtatctggaataagaagtgtctttttttttatttttttatttccataggtttggggggcataggtggtatttggttacatgagtaagttctttagtggtgatttgtgagattttggtgcacgcatcacccaagcagtatacactgaacccgatttgtagtcgttttttcctcacccgcttcccacctttctccctgagtccccaaagtctattgggtcattcttatgcccttgcatcctcatagcttggctcccacttatgagtgagaacatacgatgtttggttttccattcctgagttacttcacttagaataatagtctccaatctcatccaggttgctgtgaatgccactaagtcattcctttttatgactgagtagcattccatcatatatatatatataccacagtttctttatacactcattgattgatggacatttgggttggctcctcatttttgcaattgtgaattgtgctgctatgaacatgcatgtgcaagtatctttttcgtatcatgacttcttttcctctagttagatacccagtagcagaattgccagatcaaatggtagttctacttttagttctctaaggaatctccacactgttttccatagtggtcatagtagtttacattcctaccagcaacgtagaagtgttccctgtccactgcatccatgccaacatctatcattttttttttccgattttttgattatggccattcttgcaggagtaaggtggtatcacattgtagttttcatttgcatttccctgatcattagtgatgttgagcattttttcatatgtttactggccatttgtatattttcttttgagaattgtctattcatgtccttagcccacttttcgatggcattgtttttttcttgctagcttttttgagttccctgtagattctggatattagtcctttgtcagatgtatagattgtgaagattttctcccactctgtggattgtctgtttactctgccgactgttccttttgccatgcaaaagctctttagtttaattaagtcccagctatttatctttgtttttattgcatttgcttttgggttcttggtcatgaaatccttgacaaagccaatgtctataagggtttttccaatgttgtcttctggaatttctatagtttcaggtcttaggtttaagtccttaatccaccttgagttgatttttgtataaggtgagagatgaggatccagtttaattctcctgcatgtggcttgccaattatcccagtaccatttgttgaatatggtgtccattccccacttgtatgtttttgtttgctttgtcgaagatcagttggcttaagaatttggggtttatttctgggttctctattctgtatcattggtatatgcctatttttataccagtaccatgctgttttggtcactatgaccttatagtataatgtgaagtcagataatgtgatacctccagatttcagtgtaataaaagccatctgtgacaaacccacagccaacataacactgaatggggaaaagctgaaagcattccctctgagaactggaacaagacaagtttgcccactctcaccacttctattcaacatagtgctggaaatcttagccagagcaatcagactagagaaagaaataaggggcatccaaatcggtaaagaggaagtcaaactgttgctgtttggtgatgatatgatttacctagaaaaccctaaagactcctccagaaagctcctacaactgaaaaagaacttggcaaagtttccagatacaatattaatgtacacaaatcagtagctcttctatacaccaacagcgaccaagctgagaatcaaatcaagaacttaaccccttttacaatagctgcaaaaataaaataaaatatttaagaatatacctaaccaaggaggtgaaagacctctgcaaggaaaactgcaaaacactgctgaaagaaatcatacacaacacacacacaaaaaaaatggaaacacttctaatgctcatggatgggtagaatcaatattgtaaaaatgaccatactgccaaaagcaatctacaaatttaatgcaattcccattaaaatacaaccaccattattcatagaactagaaagaaaatcctaaaattcatatggaaccaaaaatgagcccacatagccaaagcaagacttggcagaagaaatttctaagcagcaaagcattcaagaggaagcagagcataagagtttgaaaaatttgcagcctgacaatgcaatagaagagaagaacccattttctggggagaaattcaagccagctgcagaaatttgcataaataacaaggagctgaatgttaatcaccaagacaatgaaaaaaaatgtctccagggcatgttagagactttcatggcagcccctttgatcacaggcccaaaggcctaggaggaaaaatggtttcctgggtcaggcccagtacctcctgctatgtgcagcctagggacttggtgccctgcatcccagctgtttcagtgtggctaaaagaggccaaggtacagctcgggctatggcttcacagaatgtaaaccctaagccttggcagcttccacatggtgttgagcctatgggtgcacagaagtcaagaattgaggtttgggaacttctgcctagatttcagaggatgaatggaaacacctggatgtccaggcagaagtttgctgcagtagtggagccctcatggagaccctctgctaggacaacatggaaggcaaatgtggggttggagcccccacacacagtccccactggggcactgcctgttggagctgtgagaagagggctaccgtcctccaggccccagaatggtagatccacctacagcttgcccccatgcatctagaaaagccacaggcactcaacactggcccgtggaaacatctgggagggggggctgtaccctgcaatgccacaggggtggatctgcctatggccatgggagcccacctcttgcatcagcatgacctagatgtgagacatggagtcacaggagattattttggagctttaagatttaattactgcctcattggatttcaaactggtatggggcctgtagccctttgttttggcaaatttctcccttttggaatgggtgtatttatccaatgcctgtacctccattgtatctaggaagtaattgacttgcttttgattttacaagctcataggtagaagagacttgccttgtctcagatgagactttttacttggacttttgactaatgctggaatgagctaagactttgggggactgttggaaaggcatgattgtgttttgaaatgtgaggacatgaaatttgggaggggtcaggggtggtatgatatgatttggctgtgtccccacctgaatgtcatcttgaattgtagttcccataatccccatgtgtggtgggaaggtccaggtgggaggtaattgaatcatgggggcggttttccccatgctattcttgtgatagtaagttctcgtgagatctgatggttttataaggggcttcccacttcgctctgctctcattcttctctgtcctgatgctttgtgaagaaagatgtgtttgcttgcccttccaccataattgtaagtttcctgaggctttcctagccatgctgaaccgtgagtcaattaaacctattttctttataaattacccagtctcaggtatttctttactagcagtgtgagaacagactaacacagtcctcttgcatcccattaagcttccgtatgatgattatttcaaattcttgtcaggaaatttgtagatcttctcatttatttggaatcagttactggtgatttaatagttccctttagtgttgtcatgtttatttgattcttcatgattcatgcatgtagccttgtgttggtatctgtgcatttgaaagagaaaacacctcttccagtctttacaaactggttttggcaggcagtgactttctcctgttgggccctcaggctgatgggatttcctctggtatcacagttaagtgtggttggagctgggtcacatggatgctgctggatctgtagtgaagtctacagttggtaggccttttacttgaggctcagttgagcatgaatcctatgtggtccctgggaagacaggactgcctccaggaaattggtcagtggggttggtgctggaacaagggcctacaattggatctgcagttggatccacaaacaagaagtctgttaccaggtgcataaaccagtgtggttcccactgcatcccttagaaagctctcactggttcactgagcatgtctgaattagtcagttttcacactgctaataaagacatacctgagactaggtaatttataaaggaaagaggtttaataaactcacagttccacatggctggggaggcctcacaatcatggctgaaagcaaatgaggagcaaagtcacatcttacatgatggcaggcaagagagcttgtgcagaagaactcccatttataaagccatcagatctcatgagacttattcactaccacgagaacagtatgggggaatcgcccccatgattcaattatctccacctggccctgcccttgacagtggggattattacaattgaaggtgagatttgggttgggacacagccaaaccatatcaatatcctttggaaggcaagactgaccctggattgcagctaagcagtggtggaattaagtcacggggctgtttcaagttgcacagacaggaccaaggtctgcaggcctgcctccattggcatagacattgtgtctctctctgggaccttgagaagacaggctctctcctggaaaatggttgagagagggagcaaagtctgaaggtctgcctctggggataagttggatgtgactcctcccatgtcccttagaaaatagtactggtggcagaaccaaggctaaatggggcttacgctaaatccaaaaggggatgaggcaatatccaggtttgtagctgggaccataaacagtaagaaggcagggcacaggcctgctctctcaaaacagcccctcccagtcttaggctccactcagttttcacaaactcctacctcaatcccaaaggtcctacagaaacacttttttttttcctgtggatggctgacaaattattgttgctgcagggggtatattcaagtgaaaacctcctattccaccatcttgcttcccaatttctatctttgtacttcctgttgaattggctgtactgatatttttatatagcataccacttaactccaccttcgctgaattatttggcaaatccagatcctatggataattaatgtgacttttcagcaacatttgatagaagtaaccactcattccttcttgaaagattttatttatttagattcctggatactacactctcccttttttatttttctcccatcccctggctagtcatcattagtctcctttgctagccatttattgctccgcctcaggtgttggaaagccctagagcttagtgcttaaaccttatctcttttctctatgctcactccttaaacgatatccaggctgttcactgtacttatgttaatatgccgatgactctagaatttctatttccagaccagatctcttccttaatgtgaacctcaaacttaacacatccaagaccaaactccagatttttaccccttaatctgttcttcctatagtcttcacaatctcattaaacggtaattacaacctttccattatggatgccacaaataacttgagagttatctttacttcactcttcttctcacaccctatatccaatccatggacaaatattggctgtatttcaaagaacattcataatctggccacatccatttacactgctaccactctagttccccacctccatcttcagcttggcctattttaatagccccatagtttcctgcttccatctttgaacccctactgcctattctttacggtgcaaccagagttagcctttcaaaacacatgtaatattgcatcactcatttattaaaatgtttacaatagcttactaaatcactccgagtgaaatccaaagtcttcattttggcatacaaaacgctaaataactttttgaactttaactcctactgctgtttttctacataatttcacttaactccttgctattcccaaatacatcaagtatgttcccacctctgcctggaatactctctcagtgcacagttctctcccttcttccaagtatctatttaaatgtaaccttaatataaaggacttcactatcttactaaacgaaacattagcaaccctcacacccccatacaccttcccctttacttcgttgttttttcttcatcacacttatcagatcaactttttgtctattttctacccctctaccagaatatcttcatgagggtaaacagtttgcctgattttcacactgttttgtctccagcaaatagaacaactcttggtacacaaaaagttcaccatgaatgtttaatacatctgcaaagtcacttttgacatgtaaggtaaaatattcacaggttcatagaattaggacatggacatattttgagggacattattcagcctactataagattaaagaacaattcaagtaaaataggtaacatttatatagtgcttactacgtacaaggccatcattctgagcattttacaaacaattatcttagtgaattctcccaaaccacactaattgattgttactattgttatttccattttacagctatttagcaaggatctttttttctttccagggcagcagtgtatcaaaaaggagtttgggttaggtaatcaacaggatatttttcaaatctaaacttccaggattctgatattttgctggactaatttagttcataaggagggcaaaaagtggttctgctgctcttactggcacaaaattcaaaatgatctagaataaaactatctctctgccaactgttcatacctgtcactaccatccaaccctctgtcatgaggctccaccttaatgcaataattcaccaccacccactcaaactctcatatgctttttggcttatctctgcagacagtaaagttcatcaaatattccttctgctctcctacatttttcagcccccataatggtaggcagaaccatactactagttctggctcattcaatgtgtgtgaaaggagcatgagccacttctaggctgaggcagtgaaaatccactatttcctttcttctaccatgagaatataagatgccctcagcctgtgtccctgaggctctggaacagagctcctcatgccaaccagacttagaaacgtacttaaagaaagaaagaaaggaatgttagttttgtctggacatcaagatggggcaggggaaatctgttaccacagcattgtctagacaaacctcactaacatagtatcactgacaggtatctccaaatcatttgctaagcagctcagactgcatttagtctctctactgtcaataagatatgaatagtatctatctgagtaaggtagaaagaaagccacctggagagctatttattctataagaaatgaacaggaaattttgttgtgctgatctccttggaaagagcaatatggggcctgaccatatctcctactgagaccagatgctcagatatgattagagttcagtgtcatctcaaattgctatgaatgaaggcgacttataggtctagaattgatttcgtatagttaacagagctgatttttgcttgtttgttttccttatattttttcaactgagcattttttgagaatacattatgggagacaattcagttgaaagtcatagtccatttcatgaaggagttgacagtctaatggggaggtagaaatgtattcacctaaatatgatataaggcagaatcaagtcagtgcccgttatgaatgggaattctctggtagagtcaattattcaagacgactgggtcataatgaggaaaggatcaaagatgaatgtcattgtttgactccccaccacccagccctgcacttcatccaccaacaacagcataatctcaggccttaaaacctggatattacatttatttgcataagattcttagaatgagataactagtattttgctccccattaaactttaaacattttaaaacattttttcatgtgcttttctatgttttcagattaaaataactttgaagagttgtagtcaaagtatatcctatagcaaaacaatatgcaatactcgtagcaaagacttaagggactaaaacacatacgcaatagtgataaatttggttaaacccatatcatctaagaattgctacaaatttgtcatgaggatggatgacaatctggccctagagctgagaatgtgaaactttctacagaggctaccagaagaaactggcatgccctaaacgtattaccagtgttaaaccgtgctatccatgcctgctctggccctggggacagctgtgagaggaatgctgcttcaaccatctttgtagtaggattaagttggctgacccaccttctatagtaaagtcaaacacggatagaagtttagtactagaaagtgagtcccaagttgaggagggggacagctgagcataaggtaccagctctacatttccctgactctcacttttctctcagtgaatgcgatttactcagggaagtggttaagtgcatagactctggagccaaaattggttgggttgaactcccagttttatcattttccagctctctgacctcacaaaagtcattgaactcctctgtaacactctaacaaacctcaacttaacatttttatctaacaaactatttcacatttttgtccacttagcataactgatacagattggatttttttcaaagaaagttatttttctaaatactaagagagaaaaaaagaagcaaatacaagaagtgcaaaagacaaaaaggatatgcagttcagttatataaggcccacctactccatctgctgccttgctgtgaaaagctggcaggaccttgcaacactccgccttgattccttctttactgtatgattactgcgtcattttgttatcactgaaaagatgtcaaatcccgactactacccaaagttctccccctgagcaagctaataccatctgtgatatgaaagagagagagagacagagagagagagagaatgcaaaagaaattgatttcccctgtgttgattatatattaagatcctcccactcaaatctggcattctgatctttaaactgacgaatacacttctctcccccggtgaatgacctcacaggtgatattcagcaccttcataaaggccatattcctatgccaaatatagatagaacattaccataatgcagcacccatatgcctagatgtacacatatttagagagaataacagggcagatgtggagggaaagggaatttcatcatacatagtgcttctcaaactatagttttagaattatctatagtagaatctcttgttaatggaaatttctgtgttccacaagagacttctgtatcagtattggggtgggacaaacaaatctgcacttttaaaacagactagatgattctgatgtactgaaagtctgacagtccttgtaataaaggcttgggcaaggttaggttattaaattcaaattatgttaacatcaaactccctttatgtgccctgagcaatgctatatgctttatgtaggagaactcctacaaatctcacaccagccctgttaaaaatgtcccattttgcttacattgaaacagaggcacatagaaataaagtaactccccaagactattacaactacttgaagcatagctattaaaagtgtagttaacaaaggacaatgtgatagtctcaaagagaagtattgcaggaattgagtaagggaagaactgagaagccgttaagtgcatggactctggggccaaagttggttgggatgaactcacagttttatcactttctagctctctgacgtcacaaaagtcattgagctcttctgtaccccagatttcccaactctaaaatggaaatgagactgtctcagtctgctttctgttgcttataacagaatacctgaaactgggtaatttataaagaaaagcacttaatccatcttgaattaatttttgtataaggtgtaaggaagggatccagtttcagctttctacatatggctagccagttctcccagcaccatttattaaatggggaatcctttccccatttcttgtttttgtcaggtttgtcaaagatcagatggttgtagatgtgtggtattatttctgagggctctcttctgttccattggtctatatctctgttttggtaccagtaccatgctgttttggttactgtagcattgtagtatagtttgaactcaggtagtgtgatgcctccagctttgttcttttggcttagaataacacttaaatgttagacctaaaatcataaaaaccctagaagaaaacctagggaataccattcaggacacaggcatgggcaaggacataggcatgggcaaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaacaggagaaaatttttgtaacctactcatctgacaaagggctaatatccggaatctacaatgaactcaaacaaatttacaagaaaaaaaaaacaaccccatcaaaaaatgggcaaaggatatgaacagacacttctcaaaagaagacgtttatgcagccaacagacacatgaaaaaacgctcatcatcactggccatcagagaaatgcaaatcaaaaccacaatgagataccatctcacacctgttagaatggcgatcattaaaaagtcaggaaacaacaggtgctggacaagatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaaggatgagttcatgtcctttgtaggcacatggatgaagctggaaaccatcattctcagcaaactatcgcaaggacaaaaaaccaaacaccgcatgttctcactcataggtgggaatcgaacaatgagaacacttggacacaggaaagggaacagcatacaccggggactgtcgtggggtggggggaaggggcagggatagcattaggagatatacctaatgtaaatgatgagttaatgggtgcaccacaccaacatggcacatgtatacatatgtaacaaacctgcacgttgtgcacatgtaccctagaacttaaaatataataataataaaaaaaagaaaagcggtttattttgctcatggttctgcaggcagggaagttcaaggggatggccctggcttgtggggaggatctctgggctgcatcataatatggtggagaaggtcaaaggggaagtggacatgtgtgaagagacaaaacccaaggagtatcctgactttgataacaaactcgcttctcacgggagctaatacatttttgggagaactaatctagtcatgccagaataagaactcactgactatcataaaaaatgcaccaagccattcatgagggatccacccctatgacccaaacacctaccactaggccccacatcacatcactgccacactagggatcaaatttcaacataatattttgtggagacaaacaaaccatgtccaaaccatagcattttcctcctagcccttcaaaactcatgttattcttacatacgaaatacgatcattccatctcaaatagtcccaagtcttaactcatttctgcatctgctcaaaagtccaaagttcaaattctcatctgagacttaaggcaagctccttccaggtatgagcctataaaataaaaacaagttatttacttccaggataccatggtggaacagacatttggtaaacattcccatttcaaaagggagaaataagccaaaagaaaggaatgacaagccccaagcaagtctgaaacccagcagggcagacattaaatcttagcactctagtatagtaattcacactatgtgctacctcctgggcacactgatgtgaggagtgggctcccaaggtcttgggtagccttgctcccatggctttcccgggcacacctcacatggctactcttacaggttggagttggatgcctgcagtttttccaggctggcattccacaccagtagttctacaattctgcagtcccagtggtagctccatccctgtggctccactaggcattgctctggtggaggtggctctgcccctgtagctttggcagctctgtccctgcaactgatttccatctgggtacttaggctttccaatacatcctctaaaatgtaggtggaagctgccaagtgtccacagctctagaccaaaatttactttgtaggtttaaatgcattaatataggtaagttacttaaaacagtactctcagcacatagtaagctctatataagaggcagctattattgccattattttattgctttgattataattgtatacattagactcagatctcctttagcagaaattgatatatccaaagagctgttcttgtactattccaccaccagcctccataaggaactgctcaccatcagtatatacatcttggggtacctgaaaatttaaggaagtgaatactccaattctctgccatgggaggactctgtcctcacagttctgttacagtggctgctgtgttcaccattagaaccattccactatatttatacattgaagagctcagacaaattataagtaacttagcagggttgagaggtaacatatgaacctgctaagtctttgaaaaacagccagctgaaacttagataagagcaaagttccaaggaaacagaaaaccttttgaggaaatttcagaacacagattatcacaatatgtgacacttgggagaggctctagcaccaatttatctcacagtgactgaatcctgagcaaaatggcaccaacttaaggcctgtctgctttgctataactaaaactggtttgtttactaaaagcagtggcagactttgttgctctgggcttcactaaaatacttactatagatatcataaaagcaaacacctgcacaatggataggtgggaaagaggagaaagggcaccataagcaaaacacaattatatttgtcttctcctccctgccccaggagaggggagttggagaacagcccatgatataagtcatatctctatgcttctttttctcagtggcagagggtgatactagacaccatgaagcagctggggcagcagtgaagaggaagattggccagaaaagacagtgcctgtttttctctacagaactaaagcaggacacacatatgccccatgctgctaactcagctgttcaaaagatatgaaacttcataattcaaataagaatttttacaacagaaaggactagttccatcaaatccaaacacgcatactccaagtagctgctgccagataaggagctgttcttcttggaagaatctttaagtaatgactatttgctctcttttgtcacttaggttataaattttagaatcttcatattctagagctggaaagattatgctgtgcagtggccaaataagatgagagaagactaactctattagtccattctcacactgctgataaatacaaacctgagatttagtaatttataaataaaaagaagtttaatggactcacagttccatgtggctggggaggcctcacaatcatggtagaaggtgaaagtcatgtcttacgtgaaggtagacaagaaaggaaatgagagcaaagagggggaaatcccttataaaaccatcagctctcatggaaactcattcactgtcacaagaacagcatggaggtaaccacctccatgattcagttacctcccaccaggtcccttccatgacacgtggggattctaggaactacagttcaagatgagacttgggaggagacacagccaaaccatatcattctgcccctggcccatcccaaatctcatgtcctcacatttcaaaacacagtcatgccttcccaacagtcccccaaagtcttaactcattccagcatgaactcaaatgtccaagtccaaagtctcatctgacacaagtcccttccacctatgagcctgtaaaattgcaagaaagttagttacttcctagatacaatgggggtacaggcattgggtaaatatacccattccaaatgggagaaattggccaaaacaaaggggctacaggccccatgaaagtctgaaattcagtagggcagttattaaaccttaaagttccaaaatgacctcctttgactccataaatcacatccagatcacactgatgcaagaggtggtctcccacagccttgggaagctttgcccctgtggatttgcagggtactgcccctctcctggctgctttcttggctggcattgagtgtctgtgacttttccaggcacatgatgcaagctgtaggtggaactaccattctggggtctggaggacagtagccctcttctcacaggtccactaagcagtgccccagtggggactctgtattggggctctgacctcacatttcccttccacactactctagcagaggttctccatgagggcactgcctctgcagcaaacttctgcctggacatccaggcatttccatacatcctctgaaatctaggcggaggttcccaaaccttaattcttgacttatgtgcacccacgggccaaacaccacatataaactgccaaagcttggggcttgcaccctctgaagcaatggcctgagctgtacattggccccttttagccatggctggaaatgaagcatctgggatgtagggcaccatctcctgaggttgtacagaacaggggggcccagggcccagcacagaaaaccatttttccctcctaggcctccagacctgtgatgggagaggctgccatgaaggtctctgacatgccctggagacattttccacattgttttggtgattagcatttggctcctcattcattatgcaaatttctgtagcaggcttgactttctccccagaaaatgggtttctttcctattgcattgtcaggctgcaaattttcccaacttttatgctctgtcacctcttgaatggtttactgcttagaaatttctttcaccaggtaccccaaatcatctctctcaagttcaaagatccgcagatctctagggacggggcaaaatgcctccagtctctttgcatagcacgagtaacctttactccagttcccagtaagtttctcatttccatctgaaaccacctaagcctggatattattgtccatatcactgttggcattttggtcaaagccattcaacaagtctttaggaaactccaaattttcccacatcttcctgtcttctgagcccaccaagtctctagaaagttccaaactttcccacattttcctgtcttcttctgagccctccaaactgttccaacctctgcctattacccatatccaaaatatcttccacattttctggtatctttacagcattgccccactcctggtaccaatttactgtattagtccattttcacgctgctgataaagacatacctgaagctgggtaatttataaggaaaaagaggtttaatggactcatagttccacgtggctggggaggcttcacaaatatggtggaaagtgaaaggcatttcctttatggtggcaggcaagaaagaaaatgagagggaagtgggggagaaccccttataaaaccatcagatctcatgagaactcactcactatcatgagaatcacatagaggtaactgcccccatgattcaattacctcctaccatgtccctcccacagtggaggttacaattcaggatgagatttggatggggacacagccaaaccatatcaccaaccatgggctaagaagcaagggatgctcagtaaatatctatagatttgaaccaaagtgaattacagtgggttatcaatcttagaaacatgacttttgataattaatgagatgtgattacaccacattgagacttgactttcttgtttggatactaaattggcttctcttccatctcctatttgcaataattcttccaaggatatagacaagggctcaaacataatatcataaagttcttttagtgttctgggatgcaatttacctgtcgtacaaactgaattcatttatttgtttgttgtccaaactcttttggaatataattccttctcttcaaagcttattctcatatattgcaatgacagcactactggcatttgaggtggggcaattctcttataagacttcagtacatctgtctcctacccactaaataccagcagcatgctcccctccgccagttattgtgtaaccaaagaacccactcgcccaataccaaatgttccctcatgggacagtacctcttctggttatgaatcaatctatcatttccaatttgatggcccttctccttgttggaaaacatggacataaaaacgagctgagtagctctgctttctgtctgatgcctgttaactttaaaccacctgctccaaactgggtggcaggtaaaggtaagttcatagataatttaaatacagtgaatggagggtgtagagagtaatgaatatacataaaagagatgacattcaggcatttagacatggcaaaataatggggagatggggatcaggagccattcattaaataaatattttagttcctaatgtgtgccatgtatttgctgttacaaacaggaatgaacaaaacagacaaaactttttatcatcaaggagcttatattattattggggaaagactgacaataaacatgtaactcatatacctgatggtataaaatgctatggaaaatggccagagaaggcctctctgtaatgatgacattaaggcaagtaaaagttaggaggaggttacaatatcccatatgatgatggtggtgtagtcttgtgtgaaagcaagggaggtggtataattccaaaggaagctgacagaagttgctgaaatttggggtatgtgagggaggcataaattattactgcagggttagtggtcttatacactggggcaaaaaagtgagagtaggatgacatttactgagctggaggaggaggtttactgctgatggggttttggttttcattataggagaagacaggcactcaagaattttgtttgggccatccatctgagtggagatgctgaaaataaatcagttagaaaagaagttaaggctggaaatacgacagttgttaccatatagatcatatttatagtcattgacaagatcccctagggaaagaagggaagggcttaggactgagcctgagggcctcccccaaagtttcgtaggcaggaaaggaaaggagtgaagaaagctgaaagtagccagtgaggtagaaggacaattaagagagaatgggatgacagaagccaagggatggtaacatttcaagaagaaaaggaaagcaaacagtttcaggtactgctgaaagatttggtatgatgagcaatgagatttgaccattggatttgataaagcagaagtccttggcaaacatggcaagaaaagtttcagtgaagtgatgaaatggaaaacttgactgcaatggatttattagtgaataagaaaagggaaacagtgagtatagaaaattcttctgagaaattttgctgtaaagagaagcagagatacacttcaaaaagcagaaaaggaatgggaagtcaaaaaagttgttttgcatatttttatgatagaagatattacagcatgtttgtcaacagagggaaatcaattggtagaaaaagaaaggttggtgaagcaggagagagaggtgagacttgttgaagggctgctctttagtagaatgcaaggtacaaattgagagattaacatgagttcgcagtacacagctctgagaaatgggaggcaagttatatgagtacagattatgagaggtagataaatgacatggtaagagcatgaggaatttgccttctaattgtttctgttttcccagtgcaaagtaagaatggaggagaagatatcggatgtttaaacagaggtgactgtgaattagttgtctaagaatgtggggaagtgagtgaaaagggcacttagcttaagaccttaaaaattattccctcgtcttcagacatggataaaaccatccaataaaaaattaaactatttctttttgttgttgaatttttatggctaccatcacaaattaaaataaaaaaattaaaattaaattaaaataaaataaaataaaaaataaattaaaaataaactaaaataaaaaaaaaattttgcaatagttggcccatctgcagctttgagaaaagttcatcgataactaaaggtgcctcatctgataccaatttaaaaaacgaacccttatccatcattttatgagactggagaatatggcttgatcttggttttgacacaaagaggaaaatgcttaataattcagtaagtgcttaggaaaatgtttagaaagccaccttgtcccccagtatggccgtgtctccaacactatgcttcagaaaataaaactttcaacatgtgctcagtcagtcaaaaacacctctcggaatcaagttctgtgccaaaccagacacttaaaagtagaaaagagaggccaagaaaggaacatggagacaaactcaacctgctccctgatgtgtcagctccatctttgcttatattctagcaagggaaatagcattagtataagaacaactaatgtaagacaaatagcatcacttaaatactagcagatttataaccttttgtttggctgaacccctgcctagaatacaaaaagttcaccactggatagccaggcacagtagaaagagatatgattaaaatgaaaataacaccaacaaatatggacaaaatttcccccagtctctccaagtccctccaatgctctctggactctaaagattacgtaagtatactccagtatctccaagtgtcgagtagtagtacctaccgtaacttatagcctctgaaggtaagaattctctgtagcattttcccactattgccccactcaactaccatgtcatcataggcatagtcatgttattggacagaaccaatcacagttctcccttcaggaataaactggtcaccattatcagactcaaataattttgtgtcctctcttcaagggcctacttgatctactcttagaactttacccagataatgtctactcacaattagacaggacatcagacttaaccaggaaattattcatatccacaaggggaactttccagatccatttctgttctctccaacagttagccagttttagtgactttctcttccagattcctattctttatgagaagaatattgacccagtcctgaaaatgacactgtgtccctcttttcatcacattatgatgaggtaatgtgactccttcatactccttggcacatgattactggtgaaagaggcttattgtcactccaaagggaccatcataaaaaacactccaatatatgctaaagctcacaggttttgacaagaaccataaaatacacttgaaaaataccataggaacataaacgtgggaatcattgctgatgactgggaaaggccaagaaagcttcatgggacccaggtaacaaagtggcatatgtagcccttgaatctaaaataaaagtcaaaaataagaaaagaaagcttcatgggagacatgtccctgaatgatgaataagaattaagcaattgattgatgaaggggaaaagatattcataaaagaagagaaaaccataccaagagacaagttcaaaagtagcagtccagtttgctggagaaataaatgtagctgaaaaggtgataaaacacagacggggtcacattatcagaaaatttgaaagccagggaattgactttggacttgactttggtaacctgaaagaacagagttcattgtcatcatcattttatggtgagaagcataatgttatagtgcaaaacacaaatgaactaagacatactcttggttctatccctaactagctgtgggaactgaagcaattcatttaactcagtttatcccacatatgtataatgatggagttagaatgaatggtctttaaaggcccattttgctctgatacaatgtaatcggaagaatcctacctattcttcttggtcaagcttttatgtgacatctattatctaaaatttatattaaatagttgtactaaaagttttaagctaataactctgatttaccagaaagaaaggttgataataaacaatattttagaaattctccaaacctgccatggattatagaggattgctacatggggaaaaataaattaaattaaattagcgcaacaatttggaaaccaggaaatatctaccacctccttgcaactcaggacaagcaagagaaaaggttcagtagtaaagggaagcaaagaggccactgttagaaagatatatgaacttttattttgagactgtgaaatgagtgcaaccatttaactccttaaatgcccaaaattactactgaaattgaaataatagaaaataaaaagaagataatatatttcaatacaaaaatatggaaaggggaactataattataccaaaacactgaagaatttctgcaagatatagttataatattgatagagcataaacagtgccatgtaaaatagaggagggagattactgtcacagaggtaagagacatgctttaaaatggttcttcataggatgaaattcaaagctttggggaagcaaaaacaggaagcacaagcaggtaatagaaaaactgttatagtgataaaatattggagaacaggtgaaagaatcatttacaccttccaacctcagtaccaagttgtaaataaagagtacatggatacggtattttagtctaaacatcaattatttttttaggagatagagtctctttctgtcacccaggatggagtttagtggcatgatcacagcttactgcaccctcaacttcctgggctaagcaatcctcccacctcagcctcccaagtagctgggactgcaggtgcataccaccccgcctaactaatttttgtatctttttttttttttttttgtaaagacagggtctcattttgttgcccaggctggtctcaaactcctgggctcaagcgattctctcacctcagcttcccaaagtgctgggcctacaggtgtgagcctcacacctggccacatcagttacttttaaaacacagagtatattccataaggaatatctattatgtgtgttgggactctagtgatatcttcaattctcaataaaaatgatgtgatgttggtcaaagcacacaaaatttcagttagcaagaggaataagttcaaaagatctattgtacaacaatagtgactacagtgactgcagtgcacaacaatgtagtgtatactggaaaattgccaagaaaagtagattttaagtgtttttgccacaaaaaagtctgtgagagaatgcacatgaaaattagcttgatttagacattccataatgtatacaaatttcaaaacatcatgttgtacaccataaaaacatacgctttgtatttacaattaaaataattaactaaccaaaataaatacataaatgcatgaaaagaaagaaatggggggaaatggggaaaacacaactctgcataggcgttaatacattaaagtgttctacttcaggataatgactttttttgccaataacaacaatatctggcttgtctagaaatttcataccaaaatactcttgagagaagtctgtcagcatatatactcctgtgtacacagggcaaattactcaatcctccattcagcaaagaggtttattgtgacaatgtgctcctataactactaaggaaaactgtattggatccaaatgatgagctaagatcttctttgataaatatgaataggcactcaagaatcatcaaatccttgaagaaaaccatgacaatgaaaaagaagcaagatgaacatattaaacaattatccccaggagaaagaggctcatttagtcaccccagaaaaagtcaacaggatgttaaaacaataaaataagaacacactactatgaaaatacatcagtctgatctataagaaatttaaaactttgtttttagaattttttttaactgaaggaaaattgagagaaaaaaaatggccaaatattaaattagtgatctggaagccctcgctaggatattctcccagaaatctctaagaaaggaaaatcaaaacatcaagacaaaaacaatggatttagtagattatttgattagtcctataacgactaaaaagtactctgtaattaacatcttcccacaaataaagcttcaagcctagatgtctttggagacttcaaccaaacatttaaagcaaaaataaggacaacgatacacaatctctttctacaaagagaaaatgagaggatatttcaaccacattataaggccaacataactttgataccaaaatctgattaaaacattgtaaagaaaagagaactacaagtgattctcacccatagagatgtaaacattcaaaacaaaagatttgcaaagcgaataaataaatatataggaacatggaaggatctggaggccattatccttagaaaactaacacaggaacagaaaaccaaatattgcatgttctcacttataaatgggagctaaatgatgagaacacgtggacacatataggggaacaacacgcactggggcctattggacggtggacattgggaggagggagagaatcaggaaaatataactaatgggtacaaggtttaatacctgggtgatgaaataatctgtacgacaaacccccatgacatataacaaacccgtacatgtacccctgaacttaaataaaagtgaaaaaagaaatatatataaaagaaaacatcatgaacaagttggagttatttcaaaaatgcaagcgtggcttaaaattttaaaatcaacataattcatcacattaaccaaataaaggggaaaagaatcatataaatatttcaatcattaagaaaaatgttacattactgggcatgctcacatgcacctgtagtccagctaatcgggaagctgaggcagcaggatcacttgaatccaggagttcaagaccagcctgggcaacatagcaagatcctgtctcaaaaaaaatgttctattgctaataaaaagtcttaaaaactaggaatagataggaatttccttcatctgatgaagagtagctacaaacaagactacagcaaacatcatactgaatgatgtaattttagtagtttcccctttaagatcaggagtgagccaaggatgacgactatctaaacttttaatcagcatcgtactagagatcctagccaaaaaaaggaaagatagaaatgcaattgaaaaggaaaaattaaaattgtcattttcaggggtataattgtgaatatagaaaattcaaaaggatctatagattattcaaattaataagttcagcatagtttctgtatttctatatatcagccatgaacaattacaaaacaaagtaaaatagtgtttacaatagcatgaaaagtaaagaggctcagaatcaacgtagcaatagtttttctcaatagaggattgccttaatgctgagaaagtcactctagatgcagggttgttatagatctgcctagcaaagcttaaaatcaaggcttaacttagcaaaatttttctaagtaacttagctttgttccagaacaaagcgcaaaaacacataaaggaatacaaaaacaaccaacacacaacaatctgccacaaaatgtctgcagtccaataaagaactaccaggcatgcacagccataaaaaacgatgagctcatgtcctttgcacggacatggatgaagctggagaccatcattctcagcaaactaacacaagaacagaaaaccaaacaccgcatgttttcactcataagtgggagttggacaatgagaacacatggacacagggaggcgaacatcacacaccggggcccgtcgggggttgggggctaggggagggatagcattaggataaatacctaatgtagatgacgggttgatgggtgaagcaaaccaccatggcacgtgtatacctatgtaacaaacctgcacgttctgcacatgtatcccggaacttaaagtataataaaaaaaaaaattaccaggcatgcaaagaaataagaaaatgtgatccataataaggagaaaaatcagtcaatagaataaaaacataaataacacagattacagaattaatagacaaaggccataaaacagcagttataaatttctgccatgtatacaaataggtagagaaaaacatgaagacaatgaagaaataaacagaagatattaaaagacttaaattaaaattctagagaaaaatacagtatctgagatgaaaaaaattcaataaagtaacctaacaacagattgtcattgcagaaaaaaaacgaataaacctttagacagagcaacataaactatcagaataaaacagagagaaaatggctaaaaaatgaaagagtaccagtgcacatcaagtggcctaacatatttgtaattggaggctgaggcatgagtaagattatttaaagaaataatgggcaaaatttataaatttgatgaaaactataaacctacaaacccaaaccaaatgaatcctgagcataagaaaaatgagaaaacattaactacaatctaattatgaaaacagtaataaaaagaacaaatctttaaagcaaccagaagtggagaaaaagatatatgatacagaaaatgaataaaattaaatcagacttctcaccagaaacaatgcaaacccaaacacagtggggaaacatctttgaagcattgaaagtaaaacaacaaaaatcaaccatcaatctagaattctatacccagtaaaaatatctttcaaatgtgaaagtaaaataaaaatatgtccagacatacaacagctaagaaaattcatcatcaacacaccagcattagaatgaatgctaaaggaattgcttcaggcagaacaagaaaagataaacggaaatttgaatatacacaaaagaataaagagccctggaaacttaaatatgcagataaatataaaacactttttaaacttattccttagtctcttaaaaagataattggctttgtttacagttgacaaagctactttatgaaatcagctgacagagataaactgtaagagcattatcagcttgattagtgcataatgttacagtgggttgctcatctcaggccttaaagctttttgaaaaccaacagcatcacaatttgttttggactttattacactattattctcattatgaaaatttagttttgtagggtttttcattcttcaaagaggcacagggccaaattgttagaggaagaatgcagaacgtaaatttgtatattattactttaatatgcccacattttccttaaaatattaaaagaaggaatcctgcaaaatagaaagatttgtttgtaaattctgatagtgagataatgagctagtgacgggtaatttttcttttcttggacacttaattctgttatgaaactcaattatcacattgctttttggcatcatatctggaacgccaccatttaaaagttaagattcttggtatttgggagtcttctagatgctactaagaaaacaggaatgagtttctttactgaaagttttttgatgtggtgtcatagaataacgtgttgtagacacaaccagctgctttattaccttaaaactaggcatttgtaagtattaaaatttaagaatatggcagatgatgtcccttaagattcagactatacttaactagctcttcagattcgacaacacaatttttcctcttttaaaaaattataggagacttgtaactcaatactgctattttctgtttctaatttgctgctgataatgtatatgcatttaacatgctgtgtaagctgtgtcctagttactaaacagcttatgcaatgttactttgctaaatagtcaaaagaaaggaaaaagataactgtataaatcaaaagtaataacaacatagtatgaggcataaaacatatgttggagtaaaatgtacaataaaaatagcacaaagtcttggggagggaaatagaagcactgtatactgttgtacagttcttatatgacacgaaaagtggtataatgttatttgacattggtacaatgttgttcaacattgtactggaaatactatccagtggaataaaaaaagatacagggaaagcaagcatgaagcttggaaaggaaggaataaaactgcatatattcacagaagacataatcatttatgtagaaaatcttagataatccacaaagaagccactcgaactaatatttgtattttgaaaaatttagagagtatatgaggttaattaatatacaaaactgattgcatctctgtatactagttatgaatacacagaaatcgaaatttaaaaatttagaagttaccatttaggataccatccaaaaaataaaatacatccaaacagcatccaaaaaattcaaatgaaatattgaattttaaggaagaaattgacaatagattatcaagagatgtaaaacagaattacaaagcattgttgggagaaatcaaagaagtcctaaataaaatgcaaagatatactgtactgacagatcggaagttttattattgttaatattcatttctacagatcgacattcaatatgaagtcaatgaaaactcttgcagacttttgtaaaagttgacaagctaattctaaaattgatgtggaaatgcaagaaacctaaaacagtcaaaacaatttaaaaaaataaaataagaattgtaggactcacactactaaatttaaagataatataaaactacaataaagacagtatagtattggtgtaaatatagatatatagatcaacgaaacatagtaaagcatgtagatatagaaccattcaaacatggtcaattggtatacagaaccaatgaaacggcaattatttcaaaaaattgtactggaacaataagatatctgtatgcaaaaaaaaagaacactgaccattaccacacaccttacaaaagtattaacttgaaattgattgtagacctaaatgtaagggctaaaacttttaatgttctagaaaaaaaaagaaaaaatttgagtgactttagaatagaaaaatattgttttaaatagaacacaataaccatgacatgtaaaagaaaggtgataaatttgtcttcactaaaattagaggctttggctcttccaaagacactgttaagaaaattaacaggcacggtggctcacatctgtaatcccagcactttgggaggccaaggaggatggatcacgaggttaggagttcaagaaaagcctggccaagatggtgaaaccccatctctagtaaaaatacaaaaactagctgggcgtggtggcgggctcctgtaatcccagctactcgggaggctgaggcagagaattgcttgaacacaggaggcagaggttgcagtgaactgagatcacgccactgcactctagcctgggtgacagagcgagactccatctcaaaaaaaaagaaaagaaaaaaaaaaggaaattaaaaggtaagccacagactgatagaaatatttataagatatatatctgacaaaaaattgtatagagactatattaagcatgtacacctcaataataaaaaggcaaacagcctaatttttttaatgggcaaaatatatgaactgtcactttaccaaacataaatgaatcttagaagtatcatattgagtgaaataagaaaagcctcccccaaaataaaacatatacactgaattgcatttatatactgttcacaaacaggcaaaattacacaatattgtgtggagatgcacatatgggtagtaaaactacaataaaatcaaggtcattctaattatgaaactaaggatatcagtttcttccataaaggaattagatgggagtgattttcaagagacacacagtgggccttaaggtgctggtaatttcttgagctgaatcatgactatgcaggtgtttgctttataatcacaggtgttcactttttataaaacttatgaaaaattttaagtaacacgagtagaataaaaatagaaagcaaaaattgccagccactagagaataaaaagggattaaagaagccttagtaaacacatcaaaaacccacaaagatagtgattccacagaaaacggcagaatagggaattcacagtcccctccctccataaaagcaacagataaactagcaaaaactgtcagaatcaactttgcaggactctaggaactagtcaaaatttacaataaccaggagaaagtttaatgaaaaaggaagctgctgcgttgtagtaagagaatgttgtggactttacaatttcccaccgatcatcttccacttcccagatcagcagtggccatgaagatgacatcctgcattcctggttcaggttgctagtgccaaagggagcaacaggaattttattctcaaatagctgtgattgtctttcaactagttgggtagcattatgaagcatcagcgcaagggtttgcatttgttttgctcaatttacaccattcccagggtggagtggcttcctaggtgatttttgcagaaagtgtttaaagacaaacattggctaaaggaatcttgagcaagaaataggtatgagaaatagacaaaggaaaaatcatgggaaggaggaagttggtaaaggagatatggggagggaagtgaataaaaacttttgaagctcttgcttataggtgggaattgagaaggcaatgcagttgcccagggctaaacatatgctcaggaaaggcctgagaaaaccctaagctttcacctttgagtgaccctcaggcttctctcaaaccggaagtgaaggttaaggcctggctaagcagtaagagtgccacaacagaaagccaatctaactaaatagattttttttcctgtttaatatttctttctttctttttttggcttcaggcttttacagaaaccatgtaaaacactatctgaccattaaactaatgcaatacagatttcaatggccacacatgacaaagaatacagactttatggaaataatttagaagagtcactaaacaaacaaacagccagtagcaagcagcaacagcaagcccagggagggtaataatctgatttccagagttgccacattatactattcaaaatgtcctgtttttaacaaaaaaatttacaaagcatgcaaagaaacaagaaaatatgacccatttacagaaaaaaattactaatagaaactgttcctgagaaagcttacatattgggcttacgagacagtgatagtaagtcagctgccttaaatatgctcaaagagctcaaggaaatcaaagacaaagaattaaagaaaatcaggagaatgatctctcaccaaagagaatatcaataatgagagagaagttattgaaaagaaccaaattaaaattttagagctgaaaaagtacaataactgcattggaaaatttaccagagaggttcaacaacagatttgagcatacagaagaaagaatcagtgtactaaaaagatagattaaggaaatcatctagtctgaggagaagaaaaaaagaatgaagaaagtgaacacagcctaaaagacctataacatcaagcataccaatatatgcataatgaaaattccagaaggaaagaatagaaggcaaaaaagtatatttgataaaagtgtggccaaaaatttcccaaagttttcaaaagggataaatatacacatccaagaaaattctacaaatttcagatagcataaactcaaagagatccacaccaagacacattacaatgaaattattgaaaagcaaaggcagagaatcttgaaagcagcaagagagaagtgactcaccatgtacagaagagcctcaataagattaacagcttatttctcttcagaaatcttggaggccagaggcagtaaagtgctgaaaggaaaaacttgtcaacaaagaattccatatctgacaaaactttccttccaaaataaaagagaaataaagacctggtcaagtaaacaaaagttgatggagtttacaacttgtagacctgtcccacaagaaatgctaaagcgggtcttcaaagctggaaagagtaactcattagatagttattcaaaaccatatgagaaatgaagagcaacataaagctatctacatagtttaatttaaaagccagtttcataactattctggtttgtaactcatctttttccccacattatttaagaagacaaatgcttaaaacaataattataaatctatataaatggacacacaatgtataaagatgtggcttgtgacagaaacaatatgggaggctggagatgtaaatgagcagagtttttgtatactattgaaattaagttggcattcattcaaatttgatagttacagacaaactactaagataaaaattaaaaaaaaaaacagaaaaggaaataaggaaggaatcaaaatggttcacaagaaaaaaatgaactaatcacaaaatatggcagtaatggaggacattaccaacaaacatatgaaaaaagcccaacatcactgatcattcaagaaatgcaaatcaaaaccaccatgagataccacctcacaccagtcaaaatggcaattattaaaaagtcaagaaaaaatagatgctggcaaggctgtggagaaatgggaacacttttaccctgtgggtgggagtgtaaactagttcaaccgttgtggaagacagtgtggtgattcctcaagaacctagaaacagaaataccgtttgacccagaaatcgcatgactgggtatatacctaaaggaatataaatcattctactacaaagacacatgcacatgtatatttattacagcactatttacaatagcaaagacatggaaccaacccaaatgcccatcaatgatagactggataaagaaaatgttgtacatatacaccatggaatactatgcagccataaaaaggaatgagatcatgtcctttagagagacatggatgaagctggaagccatcatcctcagcaaactaacacaagaacagaaaaccaaataccacatgttctcactcataagtggaagttgaacaatgacaacaaatggacacagggaggggaacaacacataccaaggcctgtttggggggtggggtgtcgaggggagggaacctagatgatgggtcaaaaggtgcaacaaaccaccatggcacaggtatatctatgtaacaaacctgcacgttctgcacaggtatcccggaactcaaagtaaaataaaaataaagaaaataatcaacaaatcaggagtagaagagcactgactcaacaggataaaggacatgtatgaaaactccaaagctaacaatatactcagtggcaaaaaagtgtaaacttccccctaagataaaggacaaaacaaagatacccactttcactgctgcaatgcaacactgtagtggaagttctatgaacaacaactaggcaataaaaggcatccaaactggaaatgaagagggaaaatcatctctttttagagatgccatgtagaaaatcctaaagaatcccccagaaaactattaattaataaatgaattcaagttgcagaatataagattaaaagacaaaaatttattacacttttctacatcagcgatgaacaatgcaaaaagaaacttaggaagataatttcatttataatatcattaaaaattaaataaatgttttaatgatttaaccaagtaagtgcaaggcatgtgttgaaaattataaaatattgccgaaataaattaaagaaaaaaaaatttttaaattaaataagatggggaaaggcgtgccatgttcatggattggaaaattcaatattgttaagacaccagtattactcaaagaaatctacatattcaattgaatccctatgaaaatcttaaaggacttctttttttgcaaaaatgaaaaactgatcctaaaattcatatggaattgtattggactctgaatagccagaataataggggaaaagaaaaacaaagtttgaggacttacacttccttctttcaaaccttactacaccaatcaaaatagtgtggtactagcatgatgacagacatatatatatatatatatatatatatatatatatatatatatagatagatagatagatatatagatatatagatatagatatagatatagatatatatgatatatatctgtatgtatagctgtatatgtacatatatcatttatatacctaggttcaattgattttgaaattgattttaatccattgatttcgaatggcacaaatatcattcaatatgaaaataatagtctcaaaaatggtgctggaacaactgggtatccatacgcaaaagaattaagttgggcccatttatcataccataggcaaacagtgacccaaaatgggtcaataatctaaatataaaagctaaaaccataaaactgctaaaataaaatatagggtaaatcttcatgaccttggatttggcaatgggtttcttatatgaaaccaaaagcatgagctacaaaataaaaatagacacattggatttcaaaattaaaaatggataaatttgactacatcaaaattaaaaatttttctctttcaaatacaccatcaagaaagtgagaagacaacccacacaatgggagaaactaattgcgaatcatatatataacaagggcctattactcaaaatatacaaggaaattttacaaattgacaacaaaatgacaaacaacctaactaaaaattgagcagattatttgaacagatattgctctaaagatattcaaacagccagcaagcacatggaagtacattcaatgttattagtcactggaaaaacacaaattaaaaacacacctcacatccactaggatgctcataatcaaaatgtcagacagtatcaagtgttgacaaggatgtggagaaattgaaacccctgtacattgcttgtgaggatgtaaaatggttctgttaattaagaaagcagtttggcagttcctcagttaccctgtgacccagcaatttcattactaggtatatacctgaaatacttgaaaacaggtactcaaaaaaagaaaaaaaaaaaaacacagacacaaacgttaatagcagcactattcacaatagaaaaaaaaaggtggaaacaacccgaatgcctgtcaacagatgaatggataaacaaaatgtggtgtacacaaacaatagcatactattcagccataaaaaggaatgaagtactgatacatgctgtggattaacctctaaaacatgctaatttaaagaaaccagacacaaaaaagcacatactgtatgattccatgcgtatgaaacatttacaaagggtaaatctactgagatagcaagcagaatagtggttgccaggggctagtgaaggggtaaatgaagaaggactaatatgtatgaaatttcatttaggggtgatgaaaatgttttggaactacacagaggtgatgattacacaacattttttttattattatactttaagttttagggtacatgtgcacaatgtgcaggttagttacatatgtatacatgtgccatgctggtgtgctgcacccattaactcgtcatttagcattaggtatatctcctaatgctatccctccccccaccccacaacagtccccagagcgtgatgttccccttcctgtgtccatgtgttctcattgttcaattcccacctatgagtgagaatatgtggtgtttggttttttgttcttgcgatagtttactgagaatgattggaaatcatcattctcccaccttctaaatatgcttcatctatggtcttcccaatctgggtaaattgttccaccataagccaagcccattcattataccttctaaatgtcttttaactcttccctcttctttctggctccattattactgcacaagcccaaacgccatcccaaaaagcaacagcaatgtactttgcaccacaagtcaagcttaactgacttagggctcactgttttctgtctgaagctactgttctttgttttcctactacttcctgattctatgctccagatccatacattaacttgcctacttgacatcttcatttgaatgtcccaagtgcacctcagtgtaacatgccctggacttttaccatcatcttttgccaggattatttcaaggcatactaatcggcctccctgcttttcacccttggccctttaattaattctctgcacagcaaagagtaatatgttttacaatgtaaatcagaacgatatcactcctctgtttaaaacctctcatcagctccttttccttttatgacaaatatcaaattctattcgtgtggcttactggggtctacacactctgaacactgcctacttctccagttctgtcatatgttgttctacccaaatctcattggacatactatttcctttgccaactcaggcctcagcttattctatttcctcttccagaatataatttatccactaaccccaactcttttcacttggttaacccctatccttccataagttcatcgtttaaacttcacatcctttagataaacatttatttccctcacctctaacaatggcaggtcccttcctctggcttccgcagaatcatgtgcttttcctttgaaacacttagaacatgtctaactatttactgctacatatttaatatctttcccacccctaaaaggctaagttccaagagggcagagatttttatctttttattcaacattatatccccaatgcctagtacaacacttggaacatagctggagttcaataagtatctgtgaacttacttcaacagtcctacaattgttccccttgcctttatttttccctttctatctcccctaaggtgcaaaatttgaacaaaacaattaactggttgcccaatgcccttgatataaaggctaaacacctcaacatgacatagaatatcgcatgatcaagatactgcttgtcactagagattcatctcccaacactccctattcccacaccaggctccatactgaactatttgcagtttccctgagcacttggcatatgcctgctacaaataaatcaaatattttcaaaataaataaatatttcttccaaacagttctaaaatccacatatctctctctattccactatcactatcctagtctagacactcgtaatatctcatgtattcttcttcagcaacctcttaacagacttactcccaagtctgccctttatgccactgccagaaagatcttactaacatataagtttcaatatgacaatctcctctctctcttaaattccctcaaagagtctagccacttataaaatgaaatctaaattcattagtatgacacacatgattggttatatgaggtcatcagtttacgatgcttggcaaaatgtctgtcatactaaaagtactcataaatgttagtcactgtgttcttttgctgcaggaacaaacaaaccccccgcatcaatctcaacatttgttgctcagggtcttcaggccagctgtgatttgatagggttcacctgggctcaggttcaaatgtgctccatgtagtctcattctgtgacccaggcagaagaaacagcagtctcattctacaacccaggcagaagaaacagcagctatctggggatatgttcttctcatagatggtggtaagagcacaaaaggccaaagcaaactgtgtgggcacatttaaaacctctaatgggacatggcatatttcttacttgctcacattacattggccaaaactctccactcatcacatgactaaactgaaagtcattggggcagggaagtaaactgcacccactaagtggcacggtaaagtcacatggatgaaaaacactaatatagagagaaactagaatagttgaaaacaacattctaatccactagagcttccattattattcaaagaacttcaccaacttattcctacctacttttgcggttacatcttctgctactgccaaacttgaaatttacattgcagtaatactgtggtagctagtctctaaaaatgagcccccaatgatgcgtgccttttggtattggtggtattgtataggctccatcccttgaatcttgggtgaatatgttattcattagccaccaatagaagtagaagtgacactgcatgacttcttagccaggtcagaagaagtcttgcagcttcaaccttgctcccttagaaaagcacacttgtgattctgtctctcaggaagctccctcttgaaactagttattatattatgggaatcccaagccatgtggagaccatatgtgtgcacttcagtcaactaccccagctgaactctcaatgaatggccagtatcaactaccagtaatatgagtgagcaatattgtacatttactccagttgagtcttcaaaagactgtagccccagctgaacaactaactacaactgccaaagataccttaaaaaggaaccacaaatctgaatctggtcaactcacagatttgtaagagaaggttataaattgctttttaaaaaaatattactttgttttggcatcctgtgtttatttcagttgtggcaaaatacacataacatagaacgtagcatcttaactatttttaagtgtagagttcagtggtgttaagtacatttacattggcatgcaaccaatctccagaactgttctcatcttgcaaaagtgaaattctataccctttgaacgatattcttttctctcccctgcagcaaccaccattctaccttctgtttacatgaattttgctatgctaggtaactcatataagtgaaatcatacaatatttgtctttttgtgactggattatttcactgagcataacatcttcaaatttcattcaagttgcaacatatgccagaattatcatcctttataaggatgatataatagtccattgtgtggataaaccatgttttgtttattcatttatctgttgatggatacttgggtagcctgcacctctttgccatttttaataatgctgctataaacataagtgtatatatatacatatatatatcttcaagatcctgctttcaagttttttgaatatgcacccagaaccgaaactgctggatcacatgataattctatttttattttttaagaactgctttactgttttccagagcagctgtgccatttgacgttcaaaccagcagctcacaaggtttccaatttttccacatccttgccaacacttgttattttctgtttttgtttttttttttaaatagcggtcatcctaatgtattttaaatggtaaaatattaaattatgaagtggtttctcacacagcaatagaaaactaaaaaggaacttaggacctaaagtgaagtgatgtctcaccaaaaactaacacatgtggcttcagcattgggaccagacagcaggcagaaactaaaaggacattaaatagactattagttaaggttggaagagactcaggaaaactgttatgaaaagctagaagggccttgagaagaccatggcttggaaaacagtgagaaaagcattattggaggaaagataagggggcccttgccaacactcacctgggcatcattgaaaataaatctggggcccaatcaactcattaatatggctgggaagatttccaggcaggatataaaaaatagcaactagtttcttcctcttcatctagagtgatcaactaaaggatgaactgttcagttttcaagcagatgtggaagaaacataaagcagccagggtatgctggttatagaaataactgtttaaggaagggtattagttcattctcacactgctataaagatactacctgagactgggtcatttataaagaaaggaggtttaattgactcacagttctgcatggctggggaggccttaggaaacttacaatcatggtagaaggcaaaggggaagcaaggcaccgcttacatggtggcaggagacagagagagagaccaggggaaactgccacttttaaaccatcagatctcatgagaattccctcagtatcacaagaacagcatggaggaaaccattcccatgacccagtcacctcccaccaggtcccaggctaaatacatgaggattataattcaagatgagattttggtggagacacagccaaaccacatcattctcccctggcccctctcaaatctcatgcccttctcacatttcaaaacaccatcatgccttccaaacagtcctccaaaatcttaactcattccaacattaacccaaaagtccaagtccaaagtctcatctgagacaaggcaagttccttctgcctatgagcctgtaaaatcaaaaagaagttagttacttccaagatacaatgggggtacaggtaatgggtaaatgttcccatcccaattgggagaaattggccaaacaaaggggccacaggccccatgcaagtccaaaacctggaaaggaactcattaaagctccaacataatctcttttgactctatgtctcacatccagggcacgccgatgcaaggggtgggctcctacagccttgggcagctctgtccctgtggctctgcagggttcagcccctgtggctgctttcatagatgggtattcagcgactgtggcttttccaggctcatggcaaaaagttgttagtggatctaccattctgggatctggaggatggtggccctcttctcacagctccactaggcagtgccccaatggggactctgtgtgggggctccaatctcacattttccctctgcattgtcccagtagaggttctccatgagtgctccacccctgcagacttctgcctggacatctaggcatttctatacatcctctgaaatctaggtggatgctgccaagcctcaactcttgacctctgtgcacccgcaggcccaataccacatgaaagccaccaaggcttggggcttgcaccctctgaagcaatggcccaagctatacttttgccccttttagccatggatggacctggagcagctgggacacagggcaacctgtcccgaggctgtacagagcaccagggcccagggcccagcccacaaaaccatttttccctcctaggcctctgggcctgtgatgggaagggctgccactaaggtctctgaaatgccctggaggcatttttcccattgtcttgactaacattcagctcctcattaattaggcaaatttctacagccagcttgaatttctgcccagaaaatgggtttttcttatctaccacatgatcaggctgcaaattttccaaactttgatgctctgcttcccttttagataaaagttccagtttctgataatctctttgtgaatgcatatgactgaatgctttcagaatcagccaggtcataacttgaatgctttgctgcttagaaatttcttctgccagataccctaaatcatctctctcaagttcaaagttccacagatctctagggcaggggcaaaatgccaccagtctctttgctaaaaaaatagcaagagtgacctttgctccagttcccaataagttcctcatctctatctgagaccacctcagcctggacttcattgtccatatcactatcagcattttggtcaaaaccattcaacaactctctaggaagttccaaacttccccacatttttatgtcttcttctgagccctccaaactgttccaacctctgcctcttacccagttccacagtcactttcacattttcaggttatctttataggagtaccccactctgctgataccaattctctgtattagtctgttctcatattgctacagagatactacctgagaatgagtaatttataaagaaaggaggtttaattgactcacagttctgcatggctggggaggcctcaggaaacttacaatcatggtagaaggcaaaggggaagcaaggtacatcttacatggcagcaggagagagagattaggggaaactgccacttttaaaccatcagatctcgatagaactccctcactgtcatgagaacagcataggagaaactgccaccatgatccaatcacctcccaccaggtccctcctttcacacatgaggattacaattcaagatgagatttgggtagggaaaaagagccaaattatatcaggaggaaagattaaatccttggccagatgacaggatttcagtaagatccttagttaagacctcagaaagatctgtgcttataaatcaatctataagttccttatagaaaactcaaggtaccaacaaaagaccattctaaggatcttaatggcatacctctagacccctgtcataaacaacagagattttaaaaatcttcacagtcttgttccacagcagcccagaggtccaagatagaaaaaagcctgtctcaaagagatttgtggatacagttttgtctaattatactctttactatatactgcttcaaaggtgtgacatgctcatactctttcctcttttcaccattcccttcttctctccctgattaaaacctactcaacattcattcaatgaaaacttaataagctacagttaggtacaaggcactattactttaaaaatatacttaaaaaatgtacaagatcttttgtaaaaaagctaacagaatttgactactatagttggactataggattaggaataatgttcattttttcttctcttttgacccacctatatttctaaatttcttacagtaaactatattgactatttttttaaagatagagtagaagattctcttccctagcagaacccatattttgttggaggtgacaatgtgtccaggtaaaaaactcacttcatcaagctcacttgcagtaactgttggccatgtggttttattctagctaatgaaacaaaagctgaagttttctgggaaagcttttcatttttctaatgaagacaccacatcttcctgctatcctagttcttcttcctgctaggaatgcaggcataatgcctataaatgtagcaggcaacttgcagccataatgatgaaagaaaaagttggattaaaagtttgagcctgggttgatgatactatcatggagcaaccacaccaactatagattacctacctcaatatttattttatttttattttttaagtttattgtggtatggtacaatttacataaaattcaccctttataagtgtacaatgatgtgatttttgacaaatatatacaaacagatatacattaccaccagcataattaagatgtagaatgtttccatcacccccaaaaagttttctcatgactttcatactcaatcctctccccaagctcccggcctctaacaaatgctaacctattttctgcctctatagatttgtcatttcctgaaaattacataaattgaatcatatagtatatacccttttgtatgtggtttaacttagcgtaatgctttcttgattcatccatgttgttgcacatatcattagtctgttcatatttatttcttagaagtatctcattgttttagatataccacaatatgaccattcattcaccagctgatgtgcatttggattattatcatatttgtctatttagaataaaccagacgtgaacattcatgaggtctttctgtggacatatgtttgcatctctcttgggtgaaacacataatcacatctctttatggattatctattccattccatttatctatatgtccatctttgtacaccatactgtcttcagtacagtaaatttacagtaagacttttttaatatttaaattttaggttcagtgggtacatgtgcaggtttgttacatgagtaaattgcatgtcactgaggcttagtgaatgaatgactccatcaccaaggtagtgaacatagtacgtgataggtagccttccaacccatgcctctcgccccaccatccctcctcaagcagtccccaatatctattgttcccatctttgtttccatgtgtattcactgtttagcccccacttgtaagtgggactatgaagtattggttttccgttcctgcttaatttgcttaggataatggactccagctgcatccatgtcgctgaaatgaacatgatttccttcttttctttggctgcatagtattctatggtgtatatgtaccacattttctttattctgtccagcatggatgggcatctagattgatcctatgtctttgctattgtgaatagcactgtggtgaagatatgagtgcaagtgtctttttggtagaaaaatttattttcctttgggtatgtattagcgttctccagagagacagaaccaacaggatagatgtctatatataaaggagtttattagagaatttgctcatactactacaaggcaaattcctacaataggcattctgtacgctggggaaagagagaagccaaaagtggctcagtctaagtccaaaaatctcaaaaccagggaagccaatagtgcagcaaaaggcccaaaagtttctggaaagccactttgctggaagtcccagagtccaaagtctgaagaacctggagtccaatgtgcaagggcataaggagtggaagcaagcatctggtatggggaaaaaaagagagccagaagactcagcaagcaagctatccccctttcttccacctgctttgttttagctgtgctggcagccaattgcatggtgccacattgagggtgggtcttcactcccagtccaccagctcgaatgtcaatctcctccggcaacaccctcacaaacacacccagaaacaacactttaccagttatataggaatccctcaattcaatcaaattgacacctaatattaaccatcacatatacccaatagtgagattgctgggtcaaatggtagttctgttttaagcccttttggcaatctccagactgctgtccgcagtggctgaattattcacatctccaccaggagtgtataaacaacctcaccagcatctgatgttttctgacttttaagtaatagttattctgactggtgtgagatggtatctcattatggttttgatttgcatttctctaatgattaatgataatgagcatttttcatatatttgttggccacgtgtatgtcttcttttgagaagtgtttgattatgttctttgcccatttttattggggttgtgttttgcttgtgaatttgtttaaattctttagattctgaatattagacctttgttggatacatagtttgcaaatattttctcccattctataggttgtctctttactctgttgatagtttcttttgctgtgcagaagctctttaattatatctcacttgtcaatttttatttttgttgtaattgcttttgaggacttaaccataattcagatgtggatgggtgtagctcctaacacacatggtaaactgaggtagctgacagatgtttgagttgtgcacacatgtgcattttgtgcattcctacactgctcactacaggtggagttttctgtgttcccctagtgtttttcttgaacaaaataatgcatacgtgaaatgtgcattatggtcaaattgttccctaatatatcaattgtgttgaaacaaattcaaattttcaaagcaagagttataacataactgactgcatgttagacgttaaaatagacatgtctaataggcagttggatttataagtctagagtttatggcagaggtaccaactaaatataatttagaagtcatcaacatatatacgctattgaaagtcatgcaactggttgagactacctagggagtgcatataaatatagaagacatcaagttctaggacattccaacgtttagaagtcaggaagatgaggaggaatcaggaaaggattctgagaaggaatagtcgaaatggttggaggagaatcagggaagtgggctttcctagaagccaagtgtagaaagtttttcaaggaagagggaggaaccaactgtatcgaataaagcagataggtcaagtataaaaaaggactaggaaacattcttgtaatctggttacctggaggggactggtaactttgacaagaatagttgagtagagtggtgagaaagaaggcctgatgggaaatagttgaagaggaattgggaaaaaaaaggactgaagacagctagtacggggaattatttttcgagggaaagaaaaatacagcaaagctggtatgatacatcagaatttttctttaagattgaagaaattacagcttgtttatatgctgatcagaacagaggtcctgggtgtagatgcaggtaggtggaaaagatgttgatagtatgtggagattccctttgattgcctctgttttctcagtgaagcagaaagcaagatcattttcagctgagagtgaggcaggaaaggaggtgttggcattccaggagaaaagaatcaaaccattgttcaggagagtttgaaaggactagggtaacagaataacatatttattttttaaagttcctagatagaaccactggatcaaaggatgcatataattttcattttgttagatactgtcaaattgccctctgacagtacattagttcacatccccacatgtgacaatgcctgctttctcaagcctctgccaacacagtatgctatcaagcatttacgcccttttcaatctgagggttgaaaatgatatctcagtgcagttttagtttgaaatgttcttatttatgtgaaattgagcattttttcttatgaatagtgacaaaggaccacagataaaactagatccttccagggagctgtgacttggtaatttaggcaaacaatttcttttcattttctgtctccatccactcaaccagtatttactgagtgtctactatggattatacgctgttctattgaccaagggatacagcagtgaacaaaaaaaaatcaatatcagaagctaagctgggagccatatcccagaatcacagaaactcgagggaagaagaggtcacaggtaaccgccatgatcaagacaagaacccagggcagaaatcaagctttctgttaggtgctatggagaggaacactaagatttttgagcaggcaaatgatataaaatcgagctgagctttaggatgacaaatcaacccatttgtttgtggattaaggattaaggaaaagcagcagctggttcatgggaagtacttagtaaatgtgaaaggggaaaaaaaaggactttccatgagggaaaggtggctacagatacaatagaagtcctcttcttcacagaactctgaatcagttggtcttgtaggtactcagagaaaaattgaatatagaggaattaactactaaaagctgtgctcagccactctcccaggtcccctggactccctgtgattttccaggcattgtagcaatgggtgattctagagcggaactggaggcacaatgcctatttaaagatatattttcagccttaaagaattcctcctggcaatgctctcagctgcagcccttgggaattgatgcaaatttccactcaggtatcaaattacatatgctgaacgatgtaattcaaacttatctgaaccaagttcctcagtgctaagctgacatgcaaaccaaaaaagccatgctatttgagtagtttccttgatttctccttccactggcagtacccacatgtctacaattccagtcaatcttgtaaactggaaaacttcccaatcaaaataggaagcattcatcaaatataatcataaactcctgtcctggaactccttgtggtgtccctggaagctgaagatgtcgtttgggaaagcacttagccaggcagcaatattgctcaacctttcccctctcctggcaccctggaattctcttgcaaaaagttgccaagtcataaatcactagagctgtgttgaagtttgaaaatttttagtttccctaaacctccttccagtcctcacaaagtccaactacatggctgttttaggcgcctacactgagattcctgctcatttcgacacaaatcttgataaccccaacatcaatccctccctagtgtgaagtaatctgagcaattctctgttcttgtaaaacaagaacctgatttcccatgtattggttatttagcaatgaactcattacttcatcactgaggatacatagcaaccttagcaacctttggatggttgtgaagaaaaagtgaattatcatgtactacatgtcttctaagtgtcaggcactgtgttgggtgtttataaaagttatctcattttggtcaggatcatgactgtaatgtaagatactctgtaaacattaaacactctagaatataagaaattattattgtggggtattaatgctgcaatccttcctttacaatgagaaaattcacagaaagcattcccatagtgtctcatacttttctcaagatccgtagtcctaacaaaaggcaaatggtgatatcacatatgtctgcattcgctcattggactgttagcaatcagagggcaaagactaggtgttatttttcctttgtccacagccaagcaaaataagcagtgcctaggtcaaaacaggtgcctagaaaatgtgtgttaagtaatttgaaggcaattcagggtgaggaggtcagacactaattgacaatgctgatgaatgtgatgactgattgataaagatgacagaagtgccatgcttagaaacaattcttatccttaccatggcctggaaccctctagtatccttcttctgctaacttctgctaactcactatgatccaaacacagcagccttcttgctatatttcagacataccaagcaacccctaccgcaggacctttgcctttgctgctcttcatggcttactcttacttcattcaggtctctgttcaaatgacacatcttcagagaaaactgttctgactgtaatttctaaaacagaatgcctgaaatcttgctagttctttaccctgctctatttttattaatcacacttaccaatacctaacatcatgaatccaatagtttgcttgttccactaatgtataagcttcaattaagagagagatgttttcttactcaccatggcaactccagcaccggaataacgcctggcatgcagcaggtactcaaaactttgttcaaagaacaaacaaattgatgaataatttaggtctgagagttaattgccaggtcaagacccctgtggcttaaagattcctgatgcttttttacatcatacttaaagtaaaagtgtagagcacgacatattgctaataacaaacaggttgctcagccttctaatctctagatccttctggagctatgtaatttggaaagtaaaattgaattccacatcggtttatccaaaaataatccttgaatgattaaaaatatgaattcaaaatccagattggcagcaaaagttaagacaatcaacactaaaagaataaactaattcggatagtcctaatttgccttcagaacagaacaaaaatgaaaacatcttaatcaaatacaataattttccttctctaactgacccagcatgcgcagaaaatctgccaacacaaattccagttgtgttcagtaggatgagaatgacatgccagaaaatctgacaagtcaagaggggtaacagaaatggagcctttgcccaagagagaaggggaagtgtgtgcgtaggggtggttcattcaaaatatggaacatgactttgtgattaaaaatgtatatgatgctcagaaaccccttttgatttttaaaatcaaaagcctgtaatattcttgcaataactttaagatatcatagattttacagatagccatgagattactagcttaaatctagatatttctttagagcagtgaaggggagcttgaccaagtctttgtgtgagctgttacccttggccttaaggagaccaccacttaacttcaagaaacataaaatttaaccaatctaataaataggtgtcagatgtaacagctgggaatcttcttctagtagaagacagatgttagtagaagacactggaacattgacttccacattggtgtcccaataaatgcacccacttcagttcctccttactcttcaatcccatggactttgctttatcagcatttcatttcagccacctaccacccaaacccaattttatgatagagcaagaacacctgaactatactgactgtaaccaccaacaagagagaacaaccctcctgttattgaatgttcataattttttagtaaggatgtcacggattctgttcagacaaagaattgctatactgtgggcctataaccagagaggtttttaagctacttttattgtatgtcattttgggtatccaagaaacagcttttaacaaaaagttaggaacacaagaaattcattggggagtaatgcctgtgaaagctgaaaagggaataaagcagatgagcagaaagggccttcagattgccttacagatatgatacctgtgaaaggaaaggaggaggaaatcaagatttagcaggaagagcttcacatcaaactgcatatctgagaaagtcttggaaaacccagtgagaagctctggagcaaagattgtccattagaggcatcccctaaaggacaggcactagcaaccacatcatgcccaatcattggctaaataccactcagtaagtgtggccttcccccacactctgaggcagatcctgaaggtgctgcacctggaggatgccaactcactgcatcccctgcatatgaacagcaggttctttcttgaagggtgatctgaggagtgaactttcatgactgccacatctggggatcagatctcacctggaagttacagacattcattgtttcaattggctgtgaatgaggcaggtctcacaaattagaaaccagagctcaatacgagaatcctaagtaggtggcaatgttagagcctggacttttgcacgcgttgaaaaagaaaatacattgaccagtctttgaaagatagaaaataagatgactcttaccacatgaagattaattagtggggtagaggccaggccaaggaactgaagacatgcttgctgtttaaggattgatgttagttaacaacatacgtaatttagaaaattgggtttgagaaccttatgccattgggatttttttaactgcaattttcattgagattattgtagatccctttgcagctgcaaaaaataatgcagagaattccgtgtacactttatcaagtttcccccgatggtaacattttgcaaaagcataatatcacaaccaagatattgatattgatataatccactgatcttattcagagttccctagttttacctgtactcatttctctgtttgtgtgtgtgtgtatgtgcacgtgtgtgtgtgtgacaccaccatcacagtcaagatactgaacatctccatcaccacaagatccctcatattgcagcctcactcactttgctcccacatttttatccctatctgtagcccctggcaattaccaatcttttctccatttctcaaaatttctcccttcaaaaacattagatacataattaaatcatccattatgtaaccacttgagattggctttttcactctgcataatgcccttgagattcatccaagttgttgcatgtatcaatagtgtattcctttttgtcactggtatgatatggatgtgctacagattgtttaaccatttacccattgaaggacatcttggtgtttttccccaattttgggctacaaacattgtcgtatagatttctgtgtgaatgtaagttttcattgctctgggataactgcccagaagtgctgagttattgctgagttacgttgtagttgcatgttttgtttcttaagaaattactaaaatgttttccagtgcagctataccattttacattctaccaataatgtagaagtgacccaatttctctgcatcctcaccagcatttggtattgttattatgttttattttagccattctgataaatgtgtagcaatgtctcactgtggctttcatttgtgtttccctaaggctaacaatgttggacatctttgcatgtggtcatttgtattttcacaatgtattggcttctctttatttagccaagttagttttgaagagaacaatacaattcaactaaacaaaggagagtcaaggcaaggagagtgtatgatcaggtgagactagagttttaaagggggacatttgtccattccaagattttgtccaaattattttttcagcttcaactcacgttttgcatccaatacaactcatgttccaaaaaaaaatgtccagtgctccctatatataccccatactttctggcatctgtgttttctcacattattttctctatttgtttctccatctccaaagtcgaattccaagaatcaccaagttccagaggctaccctctcaatggaactttccttgatgccagcagctggaattcatctccctcatgtgaacattcctcacaactttctagaaaggtctccattgttgctttgtattgccattatgtgtcatgtatcctgactttccaattcggctgtgaatccaggagctagctggtggtgactaggccaggtcttttatctcctagtctaatcatcttgccttgatcaagctctgcccactaaagtgcaattgttaaagatcaaatacagggtgtcctttcggtaggaaacaatcctctacctcgttatccaaagaagtcactcagggtcacacagcatttaaaatactatcagtgtgtgccattttttacattcaataatttttcttcacatcaaaatttgaataatatttttattgtcaaaaaatcaccagataaatgggtaaattagtctctccctcaaaaaaagagaaccagggatgtatacaataagcacaagaaatggattaaataattatcaaaaaacaaacagggaaaaatagaaatcagatgggacaatggatattttgtgatgctagaaagattacagagaatactgatagggagaaggctatacaacctcagaattttcacactgtacatctttaaaacctggtctcattggattttttagcttttattttgtgagaataaatttctccacaacatttatcaaaaataaaaagctatgattaggtataactttggaggtaaaaataatatgaaaaacttagtgaaatataaagagaataaaatcaccaatctgtacacttaatgtatgaattttattgtatgtaaatgaagctttaatacaacttacaaaccaaaaagtaaatgagatggaggttactatagtacacagactagtctgagaagacttcatcaaaagagaacattttttctgatcatatttaatctctaatccttttatttcagttccagagattagggtgtgaacatttactccacccttttgccttactctctaccttctcttccaaccaaaaagcatggtgggagagaagccctcttattcccaaattgtggaaagcaagctggaggtaaactccttcattgtctaataagtttccctcaccatcccctgcaagagaaaaagagtaacttttattgcctgccagagttctgtgattcattcttatttataattaacaacctgcatgtttccaaaaggtatcccacattaaaaaaaacaccaaataagaaacaatatactgtcggtgggattgtatagtaccatacctttcgaagggtactttgaaattcttttgtctcagaaattacatggctagtcatctatcttcacaaatttattcacttaacaattattgaacactcactatgtgctagacactgagctaaacactgaagagacagtggtaaataactcagtattaaggcctcatggggttgttatgtcacagtaggcagtgatactataaaaacagcatcaggtagtcatcagtgctctgaaggaaactacagaacagttgtgttcacttcattgcttcgttcataattattcataacataaatatgcatgacatgcattattgttcatacatttcatatgtatcaaagaatgcataacaaaataaaagagaaaacagggtgaggggacaagagtgatgggagtaaaaggaaaatgccactatttcttgggtaaacagccagggaacttttctctgataagataacatgtcagaaaggcatgaagcatgtcagaaggtgagccgcatagagctctggggcaacagccttcccaatggaggcaatggaaaatgcaaaggttctgaggcagaaaggggcttggcatgttcaagggatcatgaaaaagtcagtgtggctggaatggagtgagcaatgggaaacatgatcgtcatggaggtggcaggtagccattttctgaaggccactgtagaccatggtaaggaagttagactctacctaacaaagatgggaagacattgaaatgtaccgaataggaattccgagccaagatggccgaataggaacagttctggtctacagctcccagcgtgagcaacgcagaagacggttgatttctgcatttccatctgaggtaccaggttcatctcactagggagtgccagacagtgggcgcaggtcagtgggtgcgcgcactgtgcgcgagctgaagcggggcgaggcattgcctcacttgggaagcgcaaggggtcagggagttccctttctgagtcaaagaaaggggtgacggacggcacctggaaaatcgggtcactcccacctgaatactgcgcttttccgacaggcttaaaaaacggcacaccacgagattatatcccgcacctggctcggagggtcctacgcccacggagcgtcgctcattgctagcacagcagtctgagatcaaactgcaaggcggcagcgaggctgggggaggggcgcccgccattgcccaggcttgattaggtaaacaaagcagctgggaagctcgaactgggtggagcccaccacagctcaaggaggcctgcctgcctctgtaggctccatctctgggggcagggcacagacaaacaaaaagacagcagtaacctctgcagacttaaatgtccctgtctgacagctttgaagagagcagtggttctcccagcacgcagcttgagatctgagaacgggcagactgcctcctaaagtgggtccctgacccctgacccccgagcagcctaactgggaggcaccccccagcaggggcacactgacacctcacacggcagggtattccaacagacctgcagctgagggtcctctctgttagaaggaaaactaacaaacagaaacgacatccacaccaaaaacccatctgtacatcatcatcatcaaagaccaaaagtagataaaaccacaaagatggagaaaaaacagaacagaaaaactggaaactctaaaacgcagagcgcctctcctcctccaaaggaacgaagttcctcaccagcaacagaacaaagctggatggagaatgactttgacgagctgagagaagaaggcttcagacgatcaaattactctgagctacgagaggacattcaaaccaaaggcaaagaagttgaaaactttgaaaaaaatttagaagaatatatcactagaataaccaatacagagaagtgcttaaaggagctgatggagctgaaaaccaaggctcgagaactacgtgaagaatgcagaagcttcagtagctgattcgatcaactggaagaaagggtatcagcaatggaagatgaaatgaatgaaatgaagtgagaagggaagtttagagaaaaaagaataaaaagaaatgagcaaagcctccaaaaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagagattttctcaccaccaggcctgccttacaagagctcctgaaggaagcactaaacatggaaaggaacaaccgctaccagccgctgcaaaatcatgccaaaatgtaaagaccatcgagactaggaagaaaccgcatcaactaacgagcaaaatcaccagctaacatcataatggcaggatcaaattcacacataacaatattaactttaaatgtaaatggactaaacgctccaattaaaagacatagactggcaaattggataaagagtcaagacccatcagtgtgctgtattcaggaaacccatctcatgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcttaaatatatatgcacctaatacaggagcactcagattcataaagcaagtccttagagacctacaaagagacttagactcccacacaataataatgggagattttcacaccccactgtcaacattagacagatcaacaagacagaaggttaacaaggatatccaggaattgaactcagctctgcaccaagaggacctaatagacatctacagaactctccaccccaaatcaacagaatatacatttttttcagcaccacaccacacctattccaaaattgaccacatagttggaagtaaagctctcctcagcaaatgtaaaagaacagaaatgataacaaactgtctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaaaatcagagcagaactgaaggaaatagagacacaaaaaacccttcaaaacattaatgaatccaggagctggttttttgaaaggatcaacaaaattgatagaccactagcaagactaataaagaaaaaaagagagaagaatcaaatagatgcaataaaaaatgataaaggggatatcaccaccgatcccacagaaatacaaactaccatcagagaatactacaaacacctctatgcaaataaactagaaaatctagaagaaatggataaattcctcaacacatacactctcccaacactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaaccattccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaacgaatccagcagcacatcaaaaatcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacagcccttcatgctaaaaactctcaataaattaggtattgatgggacgtatttcaaaataataagagctatccatgacaaacccacagccaatatcatactgaatgggcaaaaactggaagcattccctttgaacactggcacaagacagagatgccctctttcaccactcctattcaacatagtgttggaagttctggccagggcaatcaggcaggagaaggaaataaagggtattcaattaggaaaataggaagtcaaattgtccctgtttgcagacgacatgattgtatatctagaaaaccccatcgtctcagcccaaaatctccttaagctgataagcaacttcagcaaagtctcaggatacaaaatcaatatacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaaccacaaaccactgctcaacgaaataaaagaggatacaaacaaatggaagaacattccatgctcatgggtaggaagaatcaatatcgtgaaaatggccatactgcccaaggtaatttacagatcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaagaacgccgcatatctacaactatctgatctttgacaaacgtgagaaaaacaagcaatggggaaaggattccctgtttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggctttaccattcaggacataggcatgggcaaggacttcatatctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaaccggtgctggagaggctgtggagaaataggaacacttttacactgttggtgggactgtaaactagttcaaccattgtggaaggcagtgtggcgattcctccgggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggatgaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctgggtactgttgtggggtggggggaggggggagggatagcatcgggagatatacctaatgctagatgacgagttagtgggtgcagcgcaccagcatggcacatgtatacatatgtaactaacctgcacaatgtgcacatgtaccctaaaacttaaagtataataaaaaaaaaagaaaggtaccaagtaggcttatgctttaaaatgatcatgcactggctgctgtttggaaaacagacgataggaagacaaaggtatagaaatgcacagacataggtacaatgatggtcactgtctctgtatttaaagagatgaaaaataaaaacagctgaaatatccaccaatgagagtaggttaaagaaatgatgtaacatgcaaccatctcctggaccactgggcagcccttcaaaggaatgaggcagaactatgtgtaatatttggaaagatgcctattacatgctgttaagtgaacaaaaagccagttgtaaaacaaaatggtaagatccctcttttactaaaaagaagaaaacatgtagagcaccacacacacacacccttttttgtggaagcatagaaaatattaagcgagtaatttatggtagacagaataatggaacccccaaatatattcacaccctaatcccagaaactgtgaatacgtgaccttattcaccgtaaatatgtgaccttattcaaagtaaaaaggactttgcagatatgattaagggtgtgaaccttatgatagggagagcatgctggttcacttaggtggatccaatcaaagcacatgagtccttaagagagataaacttccctcgctgaatcagaaagatggcagcatcagaaagatttgatgcattgttccttgttctgagatgtaggaggctgtgtgaaagaaccacagggaggccttcaataattaagggcagcccctgcaagacagccagcaatgaaagggggacctcagttctgcaacagcaaggcactaagttctgccaacatctgaatgagcttggaatccaattcttccctaaatcctccagaaaagaacacagccctgcccataatttgactttagccctgtaagacccatagctgacttatgatctctagaactgcaatctgtattgttttaagccactaagtttgtggtgatttgttaaagcagcaatagaaaaccaataatacgtaacctcagccagcaggatctcacagcaaaagaggatcccaagaaaaaattagagaaattagattggttagatcttattcctggcccaaaccccagagtctctgattcagcaggtctggggtggggcttcagagtttgcgtttctaacaagttcctaggggatggaggtgctgctggtccaggactacagtttgagtactgttgatcaagagaatagggtctagaaccatacctactggaaccaaattttggttccactgcatactcacttttgaccttaagcaaattatctttgccctagttttttcaaccattaaggggatggtaatactagtttctacctcatgagcttattctgagactaaattagttaatatatgtaaaatatttagaaagctgccagcacatatttagaactaggtatattttaaccattattactttactgtgtacttatttgacctgtaatctgtttttttacaatcaaatagaatctctctttgaaagtcattcatatccttttccaagtgccttccctttttctcactttctctgacatcctattaacctttacaccaaaaccttcatagatagacctctttcttcagcaaacctggccctcactggggaaataaaagcctccagctacaaaacaacaactgccctttctcctttcctgcaccttctccttcactctttttcccatcagttgaaggggaaatgcttcaggaaaagggaactgctacaacagcaaatctttcttgctcagccttccctttcaatactttaataattgagctggtctgctctactctgagtgagctctagaattattgttctcctgagaatttgacgaggcaatactgaaataacaaatgtaatttacttcaactttcgctaaacaaaacaaaatggtttatgcatcatcacgtcgcgtctttttgataagccacctctactcatgatcaaaaatatgcggctgataaataaattcaatcagcagacaaggctcttgtagctctttaaattgtcaatctctattgacaatagcagcaatttcagctaaacactgaggaggccagcaggccactaactcccagcctccgctcccacttgcaaacagagccccactgtggctctgcaagcccttcgcccacactctcacctacccggccaccaataggcagcttctcagcctaattgtacctttatctgctacaactttgaactcagcgaaatttataccaggtgttgcaaattttttactggtaatgagttaatttacacagatggctgtcacttctccatttctccagctcctttgctgataaggcaggaaacagcttgactgtgcagagcccgtggagcccagaaaagtcggggatggggagtggtccctgaccaaatggacacgccctggctccagagctctgccctggcccccagagcaagccaagccttacccaccgaccctgccaactctagcccaggacttttagttccctgctaaaagagctcttacacaactgaaacgagaccaaccaacccactagttgggagggcagggggtggcaagagagatgtgattataagtaccttttaaatcccaggaaattcatcttttcaattgcttttgttggtttttcaacccggaaggcctcaaatgcgtgctaaagcatcttgtgaaagtgctaacgggggatgcagcgcctcagagttagatactgccaaataaggcaccctcctcactgtgtgaagccctctgggttagtggctctgcaggcaaggcggcagcaagcgcccagggctgggctgggactgtctcccagcctgcctatataatggaaaactgtatcaataataataggtaacattatatacaatgttatatgtaatcataatggcaccaaatataattcacggttaacatttcgcattcaatgccttcacctggtggatttcgaatctgaccaagaattccaatcacctacagagcgtttccaactcttgaagcccaggttacactccatactactcaaatcggatctctaaaggcaggagccagtgggcagtgtttgttaaagatgattccaggtgattccaatgtacagcaaagtttaggaactgctacctgaacccaaaggagagacatcagcaaccctggacaggcaagcaggagctaattttttgagttgagccaactctccacataaagtgccatcccctagcctctagcctgttccatccctgctggtaccgtgtttgttttcttttaattttttgagggcaggggatgccaaggtcccccaggcatataatgtctttcatgaataatgtcttaatgtctttaagaaactatgctctacaagccatactactagcagcctgggtcactgccagcctcccattacccatgctggacccaatcaatcttagccacaccctgtccctcatctttcccctccccttgcagtccatgaccatcctgttcccaccacaacaaagcattccctgaatcccggctccaactgtccacctcctagccatcaatgcaggcacaacccgagtgccattccctccatgaaatctatgttgatcttctctccaagttgtctctacaaatctgagggtcaggtctatagatttaatgaaaagagcatcacacatagatcagtagacctggatgtgagatttcaccactgtaaccgaaatgctagttgttgagtcaattttattttccccttcttccttaaaactatccttggactgcctaacactgtgctgattttactgggaaaaaacccaaacctctaccttgatccaccaggtgatgttattaacagccaaacctaacttgaactggaacaagtagatgctggttgtgagatcctggacaggccattgttcttctgaaccttagtttcttcaactataaaataggaagaaaatgagctgtgaggattatttaaaatcacctaacagttagttgaacttgtctgtatcttaattaattgaataaaaacttctcacttcgtagacaatggaactgagcacttaaaggggaagtgctttgctcaaggacacaaagaaaattagtagcaggtgcaggaattaaaaccagagcccctttgatttggaactcaacttaaatcaacagaactcaggcttaactacttgaaaatcattgcaagcagtaatgagaaaatattgatttaaaaatcatgttagtagatgatcaaaaacagaagctatttagtccattaggaattgcttttaagctgggagggtgtgggaaagatcttatagaaagataaccaacagtcaattatgcccacactaggtatggaatagtttattctccactcatgtgaaatgctatctttacaaacacccacccacacacacacacacacacaatctcacggatctatttgtctattcctgtgccaataagtcattgtgctgattaatggcaagacgagcccctcctaccatgttcctttaaaaagttttattcgcttttgttgctttctctttctaatgaattctagaatcagcttctcaaattctataaaacatctcactgtgatattaattgggttgcattacatttataatttctggagaactgacatctttactataataatagtgcttattgtgtaccaggtatgattctattttccctgccaggtgccaagtaaattatctaagcatttggggtatattttcaaaaatatagacatgtatttatattttattttatttcttatgtcaaaaaattaaaacagagattcttgccctcaagaagcttatattttggcagaggtagtcagtcaataaataagaaatacggcctggtgcggtggctcacgtctgtaatcccagcactttgggaggccaaagcgggaggatcacttgagtccaggagtttgaggccagcctgggcaacatagggagatcccatctctacaaaaagtttaaaaattagctggacgtggtggcatatgcctgtggtcccagctacttgggaggctgaggtgggaagatcgcttgagcccaggagatcaaggttgcaatgagtgatgatcacaccactgcactccagcctgggtaatagcaagaccctgcctcaaaacaaacaaacaaaaataagtaaatgatatcatatgctagagggtagttagtgctatagaaaataaaatgaggagggaaagtaggatacagggaatcaggagagcagggtgcaggtcacacagccttatataggttaatcatggtagaataactcattgattcctcagtgaaccttaactctatggctactgacactttacagggaaataaaattgaggcacaaagaggtttaagtaataggccaaagtcacactgctaggaagtgacagagccaggatttgaagttgagcaggctgggctccagattcctggagccagagtcaatattcctaaccctacactgcatgccatccaggttccaggtatgtttctcaatttccatccatctttatatccatcagcaaaatataacatttttcatttagtatggcacatttcttgttcagtttatttttatgtatttatactatttcttgccattgcaatgtgaaatattttcaccatgacattttctaatcagcttttgctactgtatggaaaagctattgatttttatgtggtaatcagctatctctgagtgcttataagttccagtagtcttccggttggttttcttggattttataattagaaacacataaaataacagtttgcctcttcctttccattatgtttttatatttcatttttgctcctgcagttctaagtattttcaaattttcactgtgattccagttttgacccattggttatttttaagtgtgttaattttcaaatatgtggtaattttctagttatcttttgttattgatttctagcttatttctactatggtcagacattctaatctatgcgatttcagccctttgaaatttgttgagccttgctttatggtccaataatggttgattttggtaaatattccatgtgcaattgaaaaaaaattccgccattgttaaatgctgtgttctataaatgtcaatgaagtcaaatgtgttaaccatgttcacatgttctatatacttactgatttttttaatctgcttattcctttaatggttaatctagagattgtaacatgcattgttgtttttcaaattagcacaagtgtatgcagggaccttaaaacattccaattccatttactccctcctgccacttgtggtatttgttgtttttataaaatgttttttttaattgttatttttgtgtaaacagaagcaatatttattcagatttttccatatagtaataattaccttttctattgctctttattctttcttgcatctacttgggataatttttctgctgcctgaaaagcagtatttaggtatttcttttagtgcaggtgtcctggtgatgaattcccttaattactttttatttgaaaatgtctgtgtcttcccttcatttgttaaagataacttaatgaataaagaattccaggtcggtggttattttctttcactattttaaagatgtcattttatttgcttctggcttctactgtttctttgacaggtcaatatcaatctcacagtttctcctttgaaaaggatatgtcctttttcttctggctggttttaagattttctgtttgtctttggtttttcagcagtttgactataatgtatacaagagaaaccatgcttgaattttataggactttcataatctttgtttcaatatgtttcatcaattttagaaaattctcagtcattatctacttaaacatcacttctctcttcttctaggattccagtctcacatatgttagactctgtcacactatgtcatattatcttacgttcatttctgtatttttattcttttgtcccttttgtgcttcagtctaaaattttttcttcaaaattatatttctattcactaattttcttttcagttttatttaatttgttcttaaatctatccattgagctcttaatttattgctttccatgagtctgtcaaaagctcagctcagctgcttggcctctcatccactacttttcagaatcaataatttcttagtagggtaaagcagcataaaataccagactcccctccctgggcttctgtctgggaccttggccctgaaaatcctccctgccttgttagttccctgatgactccaaagaagtgctttgaaatattattattgagcttcattcactgtcttcagcaggaggattggtataaagcaacctattccaccactgctaaaggtgggatttcttcattattttgggaaacagcatagtacttacaaggctttgaactgtgtctggcatgacagaatgtactcaataagtttatgttattattgtacacaaatgaacccatagttccttttctgtgtgttatcttgattgtttttagtatcattattttgccggctttgtataatgggttagttgacattccatatttctctatcttctaaaactgttcatataatatagagattatctgtttcttgaagatttgatataactcacccataaaattacttgagcctactattgtttttaggggcaaacttttggttacctttttaatttcttctataattattaattatctctgtataggaattattctaaaactatatcagaaattcagacattattcttattcatattttccatctcttaaaaaatttacaaaattaccagtagaggttaaatacaatattttaacaaagtttcttctgggtctgtggttatacctcatttatcatttctaatgtaatttgtgttttttctggctttttaagtcacatttgactaattttatttaatttttaggaaaaaaaagcttttggttttatggatcaagtctactgttttgttgttattgttgtgagaaggtacatgtctcactttggggctgaggttgtgttagcccatatgcatcactataaaggaatacctgagggtgggtaatttgtaaaggaaagagatttattttggctcacagttctgcaggctgtacaggaagcatggtaccagcatctgcttctgatgagggcctcaggaagcttccagtcatggtggaaggtgaagggggagccagcgtatcacatggtaagagagaaagcaagggacggggaggtgccacactctttcaaacaaccatccctctcatgaactcagagaaaaaactcactcattacagagaggagagcaccaaaccattcatgagggatccacccccatgacccaacaccaggccccacttccaacattggagattatatttcagcatgagatttcgaggggacaaaacatccaaaccatatcagataatttaaagctctctcttgccctgtcttggcaacatataagtttacatgtttcaggtggattaagatagattagagaaatccagcttccatcagattttgtgtaagagagaagtgtaagagagagaatttgagcagccactgagatttcagggtttatttgtaattgcagcacaatctagccaattctgattaatgcaggaattaaaatttttggtaccttaaaatatggtcaatttttaaaatttcccatggatattttaggtggatttgtattctttgtttgtacttgtgtgattcttttagttgtcttgagtttgtttaaattttaaaatatctttccagcatattaagaaatttaggataggaaaggacacgcacctagcctccattgtgatttcaactctaccttttgtctagttatattctcaaagagtttgcattttgtagctggaaatgggtaattttaaagaaaatatttattaaaagtcatgtaggctttgtaattttagtaataactaagaaagcataagctttataaccataagctctttatttaaaagtcagaagttggtggattataaacatgaaattccttcctccatcccctcatcactgccttcaactatgtccttgtctcctaatgacatctcaggtagagctcatagcattcaggacgctggcaacaagaaaacaacccactgcaggctaattcaataaattgcaaattttaatttcaaagcatttcttctcaatcaagtgccggccaggcttctctcagtacaacttgcaatggaaaagtggcttgccctcttgacaactacccgcttcctactctggttgtccatttctactagagtgtgcaatggtttcttagaaagtccgtgaagtatgtggccctatttagcccatggagttattcagaagctatcactggcagaattg

SEQ ID NO: 916 - DNA, 2767 bp, Homo sapiens
tgtcttgctggaatacaagaatgtaagacaaaaaataaatgataggtcatagataaagcattcatgaagcaagtaaaagtgtcaattcatattaaactcttatgagttaatgaatttccatttttatagtaaacactaaaataatagcaaaaaggtataaaatcttcaagctaatagagtatatatgtgtattttagaatgcttgaatatactcaatctatattcattctaaaataaggcaagcaagagaaaataagaatataggcaggtggaatgaatagaaatcacttaataagctgaacatttttaatgcaaatgtatttgtaattatagtaactatacatagagtaatgctccaattaactaaatactgtccaactggatcctgccaagtctcaactatatgctatttatagaacacaacttcaaaacataaagggaaaagagtgaaagtaaatgaatgggtaaagaccatgcaaactctaaccaacatgtggctggtatagctatgacaacatcagataaggaagactttaaagcaaaaagaattaccagagaaaaaaatgacaatagtaggtaaaaattaagaattaaatttatgaggaaatattaactattctaaatttatatacttagtaacatgtcttcaaaatatctaaagaaaacactgacagtagtaaaagaagaaaaagaaaaacccagaaacatggtaaaatttaatacactttcatcagtaaatgatggaataaacacaaacaagttagcaaagacaaagaatatgcaaaagaacattaaaccaagtaactatagaatacatattctccaaatacccacacaacatgtagagaactgtccattttgctgggccataatacaattatctacatatttcaaatgaacaaaatcataaaataattttttagctataatataatcatattaggaaacaataatgaaaaagtaactagaaaagtcccattgtttagaagttaagcaatatgcttgtaaataatccaacggaaatcgaaaatattatgaactgaataatagcaaaaatactatttagtaaacttactatttattaaaacttacaggatttgacttctacttctgagtaaaatggaatagttcatggcaggtcaatatttccactgaaaacaattagaaaaaagatagatttcaaaaattatatatatatttatagacacccaataactgtagaagtaagcaagactagagggaatacaattccagaatgaggacagtctttcggaggtaaactgaggctccacagctgtctccgagaatatgtcctgattctgaacatggatctgagcttgagaatttgagctaggtctaggtggagagctgctgctgatggactttttgacagctacacagagctgaagtaaaaaaatgtagattagacaggcctcaaatagacaatttatttctccttcaagatatttgctaaactccaaagctaaactgaagaggaagataaagagattaagccaaaacttaaagcaaagtagaattatttccacagtctctaggtgattaggaggcaaaggttgggggtacaggattggcaggactaagaacaaataacatatgaaagcattagagggagtagtaaattaacacccacatcttccaaccaccttttgcagatctggaacctgctgaaagataagaatccacacttggtccttggcagaacttttggcagacggtaatgacaaaattggagtcttgaaggatgctaaatgcacagctggtctctccctcaaaagatttgccaaattctgaatcttcacagggcaagaggctaaagaaataattcaaaaacctctgaatcacacaggaaaaaaaaatgcccatagtctcttagcactgaggttacaaagacctgccatgtactcaaataaatgtcctggggtacaagccatagaaatggtaaattgagattcattaaactaaatgccagcttccaccagctcagtctgtgattaaagtataatatttagctccctactctatctgcctagcaaaggagatttggataattacacaaggctgaagcggcagaacttagattagacaggcctccaatagatgactatagacaaattatagatcatgtgaaatctataatagctggtgagggggaaatcatgtgagataataagtataaaagcgcaataaatgatatgtattcagatatcttaattttacaaacaaaatgttgaccaaaaagacatcagctttgaagacagacaggtctgtgtataaaccacatactcagaaatagttttttgaccttaaaaaagttatttaaccttctaggcttcagtttatttatttgtaaatggaaataaataatagcaagcagagaatatgctctcataagaattacgagataatacatttaaagtaattaaaacaatctctgaaatgtaaaaaataatggtttcattattattgctgtcgtcattactactgtgacaaagaaatagtagcttttagaatactttccattttgccaaatgcctttgcatttattatctcacttgattcctccctgcaattaatataaatgaaccaaagatcatgttctgcatatttcaaataatgaataaactgagactcccaaaagagaaatgacttgctcagagacaggcaacaaggtactgaagaaccaggactagagccctcagctattcacacttgtcccgctttgtacaactccacattacctgcaaac

SEQ ID NO: 917 - DNA, 90368 bp, Homo sapiens
cttgagattttaaatggggaagtaaagaaaataaatgtatgaaaacatattgaaaactaaaaaatgattatattggtcaaataataaacacttagaaagtacaaaatttttaaaatccataattacacttataattgtacattaagttcataattttatatatacagtcgtcctcaatatccatgggcagttggttccaggacccatcacagataccaaaatccacagatggtcaagtccctgacctaaaatagtatactatttgcatataacatatgcacatccttccatatactttaagttatcactagtttatttgtaatacctaatacaatgtgaatgctatgtaactagttgttatactatattgcttcaggaataatgacaagaaaaaatatctacatgtgctcagtacagacaaaaccatcatttttgtttttcaaatatttttgatctgcagttggttgaatccatggaggcagaacccacagggccaactgtatttgtacatgaaaattcaaataaatctacaatataataccaacactaataagtaatatagcataaaaggtcaatatacaaaaatcaattgtgttttagttattagaaacaaccattgaaaaatgaaacttcaaagaacaagactaataacaacagtatcaggagtaaatggcattgaaatacatttaacaaaagatgcacaatactgttatatggaaaactacataagtttctaagaaaaattaagaaagatctaaataaaaagataataccatgtttgtgattgtaagacttaatgttaagatatcaattttccccaaatttgatgataaattcaacacaattacctagcaggatttttatagaaaaattttttttcaaaattatgatgctgagtaaaatttttatataaattgataaatttattctaaactccataaggcaacacaaaattcttaattaatgtaaagatacattaactaagacagtgtggtattagcataatagaaaaataaataagttgaacaaaatatagagtccagaaataaactgacacatataccatcaattgattctcaataaagtcctcaaagcaattcaattggagataagaatgtctgcaataaatggtgctgaaacaactggatattcctgtggaggaaaaaatgaaacttaaccttccctcacaccatactcccaaattatgttgagaatgattatagatatcagtgtggaagctggaattataaagcttctgaaagaaaataggaaaatgtcttcaaggctttgaggtaggctaaggtttcttagatacgcataagggcaatatccataaaacaaaacaaatgataaattaggtctcaacaaattttaaaacctttgttcaacaaaacacaccattaagaacgtgcaatagcagtcacaggatggaagaaaatattttaatatatatatgtgacaaagacctcatatctggaaaatataaagaattctacaaaacaataataaggttaataaacaacaaaaattggcaaaatatttcaatatacactgcactaaagaatatagatagcttaaagaaaaaaacaataaaaattcaggaaactgtggacacacttttagaaacgcataatgctctggaaagtctcagcaatagaatcaaacaagtagaggaaagaaattcagagcttgaagacaaggtcttcaaactaactcaatccaacaaagacaaagaaaaaagaacaagaaaatatgaacaaagcctccaagaagtttgggattatgttaaatgaccaaacccaagaataatcggtgttcttgaggaagaagacaattctaaaagcttggaaaacatatttgggggaataatcaaggcaaacttccctggccttgctagagacctagacatgcatatacaagaagcacaaagaacacctcggaaattcatcctcaaaagatcttcatctaggcacattttcatcaggttatccaaagttaagaggaaggaaaaaatcttaagagcggtgagacagaagcaccaggtaacctataaaggaaaacctaccagattaacagcagaaatctcagcagaaaccttacaagttagaagggattggggccctatattcaacctcctcaaacaaaacaatcttcagccaagaattttgtatccagtgaaagtaagcatcatatatgaggaaaagatagtcattttcagacaaacaaatgcagagagaacttgccattaccaagccaccactgtaagaacttcaaaaaggagctctaaatcttgaaacaaatcctggaaacacatcaagacagaatatctttaaagcgtaaagcacacaggacctataaaaaaatagaagttaaaaagcaagaacaaaaaacaaagtatgcaggcaacaaagagcatgatgaatgcaaccctacctcacatttcaatactaacattgaatgtaaatgtcctaaatgttccacttaaaagatacaaaactgcagaatggataagaactcaccaaccatctgctgccttcaggtgactcacttaacacataaggactcataaaaacttaaagtaaaggggtggaaaaaggcatttcatgcaaatggacaccacaagcaagcaggggtagctactcttatgtcagacaaaacaaattttaaagcaacagcgagacaaagagggacgttatataatggtaaaaggccttgtctaacagtaaaataccacaatcccaaacatatatgtacctaacactggagctcccaaatttattaaaaaaattactaatagacctaagaaatgagatagcaacacaataaaagtgggagactttaatactccactgacagcattagacaggccatcaagaaagaaagttaacaaagaaacaatggatttaaactacaccttggaacaaatggacttaacagatatatacagaacacttcatccaacaacagaatacagattctattaaacagcctatggaactttctccaagatagaccatatgataggccataaaacgagtctcgataaatttaagaaaattgaaattatatcaagcactctctcataccacagtggatttaaactggaaattaactccaaaaggaaccctcaaaacaatgcaaatacatggaaattaaataacctactcttgaatgagcattgagtcaaaaacgaaatcaagatggaaatcaaaaaattattcaaactggatggcaataatgacacaacctatcaaaacctatgggatacagctaaggtgatactaagagaaaagctcacagccctaaatgcatatatcaaaaagtctgaaagagcacaaacagacaatctaaggtcacgcctcaaggaactagagaaagaagaacaaaccaacccaaacccagcagaagaaaggaaataaccaagatcagagcagaactaaatgaaattgaaataacaacaacaaccaaaaaaagtacaacagataaatgaaacaaaaagctggtcctttgaaaagataaataagattgatagaccattagcaagattagccaagaaaagaagagagaaatccaaataacctcactgagaaatgaaacaggagatattacgactgataccactgaaatacaaaagatcattcaaggctactatgaacacctttatacacataaactagaaaacttagaagagataaataaattcctggaaaaatacaaccatcctagcttaaattaagaagaattagataccctgaaccgaccaataacaagcagcaagattgaaatggtaattaaaaaattaccaacaacaaaaaaagtccaggaccagatggattcacagcagaattctaccagtcattcaaagaattggtaccaatctttttgacactattccacaagacagagaaataaggaacccttcctaattcattctatgagccagcatcaccctaataccaaaaccaggaaaggatacaaccaaaaaagaaagctacagactgatatccttgatgaatgtagatgctaaaatccttagcaaagtactagctaaccgactacaatgacatatcaaaaaaataatccaccatgaccaagtgggtttcataccagagatacagggatggtttaacatacacaagtcaataaatgtgattcaccacataaacagaattaaaagcaaaaatcacatgatcatctcaatagatgcagaaaaagcatttgacaaaatccagcatccctttatgatcaaaaccctcagcaaaattggcatacaagggaactaccttaatgtaacaaaggcacttatgacaaacccacagccaatataataatgagtggagaaaagttgaaagcattccccctgcgaacgagaacaagacaagaatgcctgctctcaccactcctcttcaacatagtactggaagtcttagccagagcaatcagactagaaaaagagataaagggcgtcgacattggtaaagaggacgtcaaactgtccctgtttgctgacgatatgattgattaccttgaaaaccctagaaagctccagaaacctccagaaagctcctagaactgataaaagaattcaggaaagtttccagatccaagattaatatacacaaaacagtagctcttctatacaccaacagtgaccaagtggagaatcaaattaagaactcaaccccttttacaatagctgcaaaaataaataaataaataaataaataaataaataaataaataaataaaatacttaggaatatacctaacaaaggagtcaaaagacctctgcaaggaaaactacaaaacactgctaaaagaaatcatagatgacacaaacaaatggaaacagatcccaggctcatggacgggtagaatcaatattgtgaaaatgaccacactgccaaaagcaacctataaattcagcacaatccccatcaaaataccaccatcattcttcacggagttagaaaaacacaattctaaaattcatatggaaccaaaaaagagccctcatagccaaagcaagactaagcaaaaagaacaaatctggaggcatcacactacctgatttcaaactatagtataaggccatagtcaccaaaacagtgtggtactgatataaaaataggcacatagatcaatgaaacagaatagagaacccagaaataaaccccaaattcttaagccaactgatcttccacaaagcaaacaaaaacacaaagtggggaaaggacaccgtattcaacaaatggtcctgggataattggctagccaaatgtaggagaattaaactggatcctcatctctcaccttatacaaaaatcagctcaagatggattaaggacttaaacctaagacctgaaactataaaaattccagaagacaacattggaaaaacccttatagacattggcttaggcaaggatttcatgaacaaaaactcaaaagcaattgcaataaaaacaaagataaatagctgggacttaattaaactaaagagcttttgcacggcaaaaggaacagtcagcagagtaaacagacaatccacagagtgggagaaaatcttcacaatctatacatctgacaaaggactaatatccagaatctacaatgaactcaaacaaatcagtaagaaaagaaaaacacacaaaacaaaacaaaacaaaatcaatcccataaaaaagtgggctaaggacgtgaatagaaaattctcaaaagaagatatacgaatggccaacaagcatatgaaaaaatgctcaacatcactaatgagcagggaaatgcaaatcaaaaccacaatgtgatactaccttagtcctgtaaaaatggccataatcaaagaatcaaaaaacagtagacgttgacgtggatgcggcgattagggaacacttctacactgctagtgggaatgtaaactagtacagccagtatggaaaacagtgtggaaattccttaaagaactcaaagtataactaccatttgatcaagcaatcccactactgggtatctacctagaggaaaagaagtcattgttccaaaaagagtcttgcacacacatgtttatagtagcacaattcacaatagcaaaatcgtggaaccaacccaaatgcccatcaatcaacgagtggataaagaaactctggcatatatatacgaaggaatactactcagccataaaaaggaatgaattaacaataatgacctggatgagattagagactagtattctaaatgaagtaactcagcaatggaaaaccaaacatcgtatgttctcactgatatgtgggaactaagctatgaggatgcaaaggcgtaagaattatacaacggactttggggacttggggggaaaagtgcaggggggcaagggataaaggacaacaaatatggtgcagtgtatactgctcgggtgatgggtgcaccaggttgtcacaaatctctattaaagaacttatgtaaccaagtaccacctgtaccccaacaacctatggaaaaataaaattttaaaaataatatatataaagatatacaaatgcccaagaaacaaggagaaggtacattacaagtcatcatagaaaatctaattaaaactataatcaaatatcactacacattcacaagaaagggaaaaacgtcaaattacattcactgattgtcaatagaaagtgttgtcaaggatgtgaagcaactggacctgtcatacatgaaaggtggaagtttaaaatagtgcagccactttgaaaaagtctgcgtcagtttctcaaacatacctacacctataatccagcaattctactcatatgtatataaccaatagactggaaatcatatgttcacaaaaaaacttgagcaagaaagttcataacaactttattcacaatagctaaaaattgggggaaaaaacaaagtccacagcagtgtaatcgataaacaaactgtggtacagtcatacaggctctatttagtactaaaatgaacgaactactgataaatgcaacaacaggtatggatctcaaaactgtgatgatgagtgaaagaagcgacacaaaaaggaatatataccctatgatttcatttatatgaagtgcaggaataggcaaaattcatctatgatatgagaatggtcacttaaaggatgggatagtgactggaaagggcacaagggaactttctggggtcatggaatattctttacctcgatcagggtgatggtcacattaatgtattcatttgttaaaattaatctttttgtttaagatttgtggttttcattacatgcgattatatctcaataaaacagtgagaaaaccaaaacaagaggatcacttgaatattcctataactatcaaagaaactaaaaactaaacatctcccacagagaaaatctaggccaaaatggctttgctgcaatttccagcaataattcaagaagaaagtaattacgatctaacaaaacctcttccatagaataaataaaggtataacactcccaaaattattttttttgaggctagcataaccttgagatcaaaacctgacaaggactgtatgaacaaataaaattatatgccattctgactcatggccatgaatgaacaaatcctttaaaatgttcataaatcatatccaccaatatctaaacagcctaatacatcacgacctagctggatttatcccaggaaggcaattctggttaaaatttttaaaatgtaattcagcacattcatattttagagaacaaaattttgattatataaagaggcataagcaaaaagttcttgataaaatttaatatataccaaaaaatacaaaacaaaggatacaagggaacttaatatgatacaatgtatctagaaatatctattcaaaatattacacttatctgtaatatattaaaatactggcctttgagattggggatgtaacaaaatggctgccatcatcactactattcaccattatagtggaggtcctagacaattcaacacattaataagaatagaagtatgcaaaaagaagtgtaaaactgtcgtttatatattatataattgagtacataaaaattctttaaaaatctatggataaactgttacatttacagtgggactttagtaaaattgctggatacaaaaacaatatatgaaaaataattttttagtcctataagtgaataagaaacatttaaatcattgaaagatcctagttataatagcatcaaaaatatctattcaaaggccaggtgcagtggctcacgcctgtaatcccagcacttttggaggccgaggcgggtggatcacctgaggtcgggagttcaagaccagcctgaccaacatggagaaaccccgtctgtactaaaaatacaaaattagccggggtggtggtgcatgcctgtaatcccagctactcaggaggctgaggcaggagaatcgcttgaacccgggaggcggaggttgcggtgagccgagatggcgccattgcactccagcctgggcaaaaagagcgaaactacatgtcaaaaaaaaaaaaaatctattcaaatatgcttctgaataaaagtatgtgagaggcaacaatcttctacaactacaaaaaactggatgatttacaaaaatcatcatgttaaaggtaccaaatagtggtggaaacaaagattaaataaattaaaatttcaaggagagagaatcttttccactataagctgacaatcttcaactatttttctcctttggaaaatttaccaactctgagaataggctgaggaccaggcttattcagacaaagagcctctgctcgcagagagaaaaaacagcaaagcttttagcagtttgacaaggctggtatgacaaatacaaaagctgatgatactcaagtgctcagcagattttccccactgaacatttgctgacttctggcatagttgggtaaaatacttgtaaaaaggtgaagcaaaatcttcagcaatcacccagttcttaggaaacaagcatgtgccagaatttgaaactccaggaggctgcaagttgtgaatagcagatctggattttccaggctttcagagattacaaaatagaaatctaccatgctcttacatcctagggaaaagaagcaaaccagacgtagactgagttttaataaaactgcactctagccctcatcatgaataatttctgactggattaaattaagcatatgctcaacttatgtgcctaaaaggggaaaagtggaactgtctctggaatatctcatctgaagcctctacaattttttatacatggtgcgtgacatgcaataaaaatattactagatacacaaagaggtaaaaaatatgacatgtaaatcaaaataaaagatgaaaaaagatgcagaaacacacatgatctggatagtatctggatagtgaaatcacgagaaaatgactttaaaattaactatgactaatatttttaaaagaagtaaagaaaaagttaaataaaatatgtgaaagaaccaagaactgtaatagataatttgaattaatggaactaaaaatcaactggatatcttacaatgaaaaaactaggaactcagtgcgtgggattaatgggagatgtgacacaaaagaacaggtttgtataactccaaaattatagaaaatattaaaattgaagcacaagaacaaaaataatcgggaaaaaaagatagagcataagacatatgtaggacagagtaaaaaaacaactaacaaatatggaatgggagaagagaaagaatagggcaggagcaatacctaaagaaataatattcaaaaagtttacaaaattaataaaagacatacacccacagaatcaaaaaactcagtgaatcataaacaggataaataaaaagaaaaccacacctaggcacatcatagtcaagttgttaaaaaaaacaaagagaccaagaagcagcttctctgctccttctggaatctctgcctggttcagcccacctgcctccactcctgcctccaccatgtccatcagggtgacccagaagtcgtacaaggtgtccacctctggcacacgggccttcagcagccgcttctacacgagtgggcccggtgcccgcatcagcttctccagcttctcccgagtgggcagcagcagcttctggggtggcctgggcggaggctatggtggggccagcggcatcggaggcatcaccgccgtcatggtcaaccagagtctgctgagccgccttaacctggaggtggaccccaacatccaggccgtgcgcacccaggagaaggagcatatcaagaccctaggcaaatttgtctccttcatcgacaaggtaccgttcctggagcagcagaacaagatgctggagaccaagtggagcctcctgcagcagcaggagatggctcagagcaacatggacaacatgttcgagagctacatcaacaaccttaggcggcagctggagactctgggccaggagaagctgaagctggagacggagcttggcaacattcaggggctggtggaggacttcaaggacgagaatgaggatgagatcaatatgcgtaaagagatggcaaatgaatttgtcctcctcaagaaggatgtggatgaagctgacatgaacaaggtagagctggagtctcgcctggacgggctgactgacgagatcaacttcctcaggcagctgtatgaagaggagatccgggagctgcattcccagatctcggatacgtctgtggtgctgtccgtggacaacagccctccctggacatggaaagcatcatcgctgaggtcaaggcgtagtacgaggtgatcgccaaccgcagcctggctgaggctgagagcatggaccaggtcaagtatgaggagctgcaggtgctggctgggaagcagggggatgacctgcggcatacagactgagatctccgagatgaaccggaacatcagctggctccaggctgagactgagggcctcaaaggccggatggcttccctgtggaggccgccatcgcagatgccgagcagcttggggagctggccgttaaggatgctaacgtcaagctgtccgagctggaggccaccctgcagcgggccaagcaggacatggcgaggcggctgcgtgagtaccaggagctgatgaacgtcaagctagccctggacatcgagatcgccacctacgggaagctgctggagggcgaagagagccagctagagtctgggatgcagaacatgagtattcatatgaagaccaccagcggttttgcaggtggtctgagctcggcctatgggggcctcacaagccccggcctcagctacggcctgggctccagctctggctctggcgcgggcttcagctccttcagccgcaccagctccaccagggccccggttgtgaagaagatcgagacccgcgatgggaagctggtgtccgcgtcctctgacgtcccgcccaagtgaacagctgcggcagcccctcccaccctgcccctcctgcgacttgcccagagcccgggagggaggccgctgtgcaggggagcacagggaacagaagacacacctgaggctcggctctagccctcagcccaccctcggcggaattcactgcctgaggaccacccttgcccatgcctccaactacaaaacaattcaattgcttttttttcgtccaaaataaaacctcagctagctctgcaaaaaaaaaaaaaaaaaaaaaaaaagatacagaatctttaaagcaaccagaggaataaaagacaccgcatttagaagaacaactggaaaacggaaggcagaattcccaaaagaaacaaggtcagtcagaaggtaatgttataacattttttaagtgctaaagtaaaaataagcacatagaactaccaacatataattctacacccaaagaaaatattattcaacaatgtgggtgaaataaagaggctttcatatgaacaaatattaaaggaattcctcaccagcagaccaacactgaaagaaaacaagacaaaaacaaagaaaattcttcagtcaaaaggaaaattatgctagatggaaacatgaaaatgcaaaagggcatgaagaacaccggagagaataaatacatgggtaaaagtaaatatatatttagattgcataaaacagtaattagaatattttgtacagtctatatgcaaaatgaaatgtgaagtgaaaatacttgacaaaaataatgcaggagggtgaaaaaaggggtaagcactgtttaaagtttctagtagcataaagatgtggtataaatagtttgtatttgactgtaataagtcaaaaattcttgctgtaatttctaaggtcgctactaaaatagcggaagaagatataactgacaaattaatagaaaaaaacattctaaatagaaacattgactatgctaaaagaaggcaagaatggaagtaaaagggaatatgaaacaggtgattcaaatagaaacttgatgattttgtggcaaatatattctaaaccaaattatatatcagtaattaaatttaataaaaataagtcaaatatttacaagtaaaatattaagatggtcagaatggatttttaaacccaaatatatgctagttacaagaaatatagcttaaatattaacatggcaaaagtttaatataaaaggaatgaagagaagtcatgaaccaaaaaaacagataatgaaactgtaatcaggaaaatcaagaagcaatactagagaaaaacaaagttatttcataattataaaaggatcaataaaacaagaagacattatcatagtcctctgtgggaagtgttaaagactttgtggacatcttcaacctacctcaagtctcaatcaagataacagcagagatttttgtggaaactgacaagctgattctaaaatccatgtagaaaagcaaaaagctaaaatagtcagaggcaatcttgaaaaaaaaagaacacatctggaagacctacactaccatatatcaagctatggtaaataagaactgtggtattagtgcaaggatatactaactggaatggttatagatataatggaataaagaattcaggcaaatattatcacccaatttttttttcataaaggtgacattgcagtgcagaggtgaaagtgtagtctttcaaataaatagtgccatattaaatgcacacttatatggaaaaaactgcaattatatcacaaagtcacaccatacgaattgcaaatgagttgaaaaattttatgtcagaagtaaaataataaatattttatagaaaatatctttaaggataacctctttgtgactttggtataggcaaagtttttttaaaaaaaaataggacacaaaaaacactaaccattaaagaaagaaatggtaacttagaccacactaaaattaagatctgttcatcaaaaacaccaataaaaaatgaaaaggtaatccacaggataggagatgacattagaaatacacatatctggcaaagaacttctaccatgaatatataaacatacatacatatatagatagatagatagatagaacatagatagagataaaaagacaacctatctaaaaaactagacaaatgaacataatgaaaaggatattaaaatatccaacaaatatttgaaaagctgtttaacttcattctcatcagagatgcaaagcagcaaattaaaaccacaaaggatagtactataccaccacctgaatagctacaatgtagacaaaaagtattaaataccaaatgttgacaaaaatgtctagatatgagataatggtcaatgttgaacacctggctctcttagaaatgaatatataagatccctgatttatggctttttttccagtctccatactgtaaatactaccaccatagccaatttcaggcagccatcctgagaccactgaatgcagaattgagaagagatgcccacaattggtccttgaaagccagtatgacccagctccagaacaccaccaatgtgcagcaacaataattctcacatattgttggtgggagtgtaaattgatacaaccggtttagaaaatcggcagtttctcctaaagttgaagacatgcatacctttattccacagcacttctactctggggtatgtacccaacagaaatccatacatgtgttcaccaaaagacatgtttgaggattctcataacagtgttcatatgtaaaagctaaaatctggacactacccaaatccccatcaacagtttaaaggataaacaaattgtaatatcgtgatataatggagtactatgcatcatcagtcaatgaactgcagcccacaggaaaaatgtgaccagtcccttatttttttatagccccttagtgaagaatgtttgttacatttttaaatggctacatttttaacagttatacaattacctacataaagtcatcaattttgcctcttgacctacagggattgtgcaatttgctatctggccctttaacaaaaagtttgctgatctttgctataaatcagtgagagtgaatgatttacaacagtgatctcaaagtatggcccctggatcagcagcattagcagcacctgaaaactggactcccagcctccaccccagacatactgaatcaaaactctgggctgtgacccagcgattcgtgcttgaacaagccctcttggtaattgtgatagatgctaaagtttgagaaccaatgatctacaattctaaacatgaataaatatcacaaacataatgttgagtgcaagaacatagatgcaataaagaacatactatataattccatttatataaaatttaaaaacatgtacaagtattctgtttaaaaatcaagacaatggctacccatggaaagggaccagtgactggaagggagcatgaggtgagtttttgcaatattaaattggcttgcagattgctgccttccggctgtgtccttaaatggcagagagagacaaagagagagggagagagagagcacgccagagagagagagagcaagcacactttggtgtctcttcctcttcttataggggcaccagccttttcaaatgagggtcctaccattacaatttcatttaacctttatcacctcctcacagaccctgtctccaaatacagtgacattgggcgttagggcttcagcatatgaactttgagaggacgcaagcattcagtccataatatattctaaaggaaactggaagcacattcttcaggcagaagaaaagtaatcccatatggaagcttgggaatgcaacaacaacaacaaaatgaaataaaatggtaataatattaaagagtactgataggccgggcgcggtggctcacgcctgtaatcccagcactttcggaggccgaggcgggcggatcacgaggtcaggagatcaagaccatcctggataacacggtgaaaccccgtctctattaaaaatacaaaaaaatagccgggcgtggtggcgggcgcctgtagtcccagctactcgggaggctgaggcaggagaatggcgtgaacccggaaggcggagtttgcagtgagccgaccagcctgggcgacagagcgagactccgtctcaaaaaaaaaaaaaaaaaaaaaaaaagagtactgataatataaacaataatgtcttgctggaatacaagaatgtaagacaaaaaataaatgataggtcatagataaagcattcatgaagcaagtaaaagtgtcaattcatattaaactcttatgagttaatgaatttccatttttatagtaaacactaaaataatagcaaaaaggtataaaatcttcaagctaatagagtatatatgtgtattttagaatgcttgaatatactcaatctatattcattctaaaataaggcaagcaagagaaaataagaatataggcaggtggaatgaatagaaatcacttaataagctgaacatttttaatgcaaatgtatttgtaattatagtaactatacatagagtaatgctccaattaactaaatactgtccaactggatcctgccaagtctcaactatatgctatttatagaacacaacttcaaaacataaagggaaaagagtgaaagtaaatgaatgggtaaagaccatgcaaactctaaccaacatgtggctggtatagctatgacaacatcagataaggaagactttaaagcaaaaagaattaccagagaaaaaaatgacaatagtaggtaaaaattaagaattaaatttatgaggaaatattaactattctaaatttatatacttagtaacatgtcttcaaaatatctaaagaaaacactgacagtagtaaaagaagaaaaagaaaaacccagaaacatggtaaaatttaatacactttcatcagtaaatgatggaataaacacaaacaagttagcaaagacaaagaatatgcaaaagaacattaaaccaagtaactatagaatacatattctccaaatacccacacaacatgtagagaactgtccattttgctgggccataatacaattatctacatatttcaaatgaacaaaatcataaaataattttttagctataatataatcatattaggaaacaataatgaaaaagtaactagaaaagtcccattgtttagaagttaagcaatatgcttgtaaataatccaacggaaatcgaaaatattatgaactgaataatagcaaaaatactatttagtaaacttactatttattaaaacttacaggatttgacttctacttctgagtaaaatggaatagttcatggcaggtcaatatttccactgaaaacaattagaaaaaagatagatttcaaaaattatatatatatttatagacacccaataactgtagaagtaagcaagactagagggaatacaattccagaatgaggacagtctttcggaggtaaactgaggctccacagctgtctccgagaatatgtcctgattctgaacatggatctgagcttgagaatttgagctaggtctaggtggagagctgctgctgatggactttttgacagctacacagagctgaagtaaaaaaatgtagattagacaggcctcaaatagacaatttatttctccttcaagatatttgctaaactccaaagctaaactgaagaggaagataaagagattaagccaaaacttaaagcaaagtagaattatttccacagtctctaggtgattaggaggcaaaggttgggggtacaggattggcaggactaagaacaaataacatatgaaagcattagagggagtagtaaattaacacccacatcttccaaccaccttttgcagatctggaacctgctgaaagataagaatccacacttggtccttggcagaacttttggcagacggtaatgacaaaattggagtcttgaaggatgctaaatgcacagctggtctctccctcaaaagatttgccaaattctgaatcttcacagggcaagaggctaaagaaataattcaaaaacctctgaatcacacaggaaaaaaaaatgcccatagtctcttagcactgaggttacaaagacctgccatgtactcaaataaatgtcctggggtacaagccatagaaatggtaaattgagattcattaaactaaatgccagcttccaccagctcagtctgtgattaaagtataatatttagctccctactctatctgcctagcaaaggagatttggataattacacaaggctgaagcggcagaacttagattagacaggcctccaatagatgactatagacaaattatagatcatgtgaaatctataatagctggtgagggggaaatcatgtgagataataagtataaaagcgcaataaatgatatgtattcagatatcttaattttacaaacaaaatgttgaccaaaaagacatcagctttgaagacagacaggtctgtgtataaaccacatactcagaaatagttttttgaccttaaaaaagttatttaaccttctaggcttcagtttatttatttgtaaatggaaataaataatagcaagcagagaatatgctctcataagaattacgagataatacatttaaagtaattaaaacaatctctgaaatgtaaaaaataatggtttcattattattgctgtcgtcattactactgtgacaaagaaatagtagcttttagaatactttccattttgccaaatgcctttgcatttattatctcacttgattcctccctgcaattaatataaatgaaccaaagatcatgttctgcatatttcaaataatgaataaactgagactcccaaaagagaaatgacttgctcagagacaggcaacaaggtactgaagaaccaggactagagccctcagctattcacacttgtcccgctttgtacaactccacattacctgcaaacaggatatgaatctattccattacgcatattgaactcaaatgttgtctgctgctgaatggggcttaggagcattttctcaatatccaaggatgacacaaacattcagctgattgagtactaagataaatcttacagttcatttattctatcaactttcccctgccctcactcatgccatcacattcctccatagccaacttaaagtccatggcatggtccatcattctaatcacttccttgtgcacacaacacaataaacttccttgtctctatctcccttcatcatactaaattagcaaaacaaaattctggttaaatctaattcattgcctactcttaagccgtgcctgactgagcagctgaatatgtgaatgtaactggaccaaaaatacataaccaagttggcttctccaaattcaagctgatctttggtgctgttcaacaatcctaccacatgtcctttccatctattttcccactctccaagaagaccatttctcaccttctctttactgaaattgcctcacctccttcctatcctccctctcaattgatgcccttgctttctatttcattaagaaaatctaggccatcagaagagaatgtctatatgcttcccacatctccttgcccaccagtatcgtgcatacatattatgctttctttttagtgactatggataaactgtccttgctcttacccctccacttgtgaactgtgtgtcaacttctctgtccttttaaggataacactatagaaattctactctcttgtgaatcactacttatttctttttactggagaatcctcatcagcattctgtgatacatctcatttttgaaacctttctcttaaacccacgtcttctcccagctacaatctcatttgctgcctttacagcaacactcttttaaaaagtcatctaaactcactccctatccccgattttttatattttccaagttttattgaggcatgattagaaaattcaagttgtatacagttaaagtgtatacaatatataatttggcgtagtatatattgtgaaattattataacaatcaagctaaattaacacaccactacctcacatagtttctgctttttttctttattaggaggtgtgaatgcttaagatctacagctttaacaaattttaagtatacttattattaactatattcaccattctgtatatcatattgccagaacttattttgtaagttaaagttttgaccgaaatctccctacttccccaattccacagcctctggcaaccactgttctactgtcttctttgactgttctagattctacatataagtctttctttgtctggctagttttgcttagcataatgtcctccaggttcatccatgttgtcacaaatgtcaggattacttttttatggcttaatcgtactccattgtctatatgtgcaacattttatttatccattcatctgttgatggacagagactgcctctatatcttagctattgtaaataatgctgaaatggacataggggtgcagatatttcttcaagataattgtttcatttcctttgggtatatacccagtagtgggattagtaaatcatatgatcaagtctgcttctgaagctctgtcttgaatttgtcttttctgtcacattcttcagctgtttggtcattttttacagtttatgtttcttcattaaacttcttattttgctcatgtattgtcctcatttcatttagtattctgtgttcttgatatggtttggctgtgtccccacccaaatctcatattgaattgtagttctcatagtccccacatgtagtgggagagacctggtggaaggtaatagaaacgtgggggtggtttttcccaggctattcttgtgatattaagttctcacgaggtcagatggtttcataaggggcttcccccttcactcagctctcattcttctccttcctggcatcttttttttttttaaaaaaaaaaggagaaaatttttgcaatctactcagctgacgaagggctaatatccagaatctacaatgaactcaaacaaatttacaagagaaaaaacaaacaatcccatcaaaaagtgggcaaaggatatgaacagacacttctcaaaagaagacatttatgcagccaacagacacatgaaaaaatgctcatcatcactggccatcagagaaatgcaaatcaaaaccacagtgagataccatctcacacctgttagaatggcgatcattaaaaagtcaggaaacaacaggtgctggagaggatgtggagaaacaggaacacttttacactgtcggtgggactgtaaactagttcaaccattgtggaagtcagtgtggcgattcctcagggatctagaactagaaataccatgtgacccagcaatcccattactgggtatatacccaaaggattataaatcatgctgctataaagacacatgcacacatatgtttattgcggcactattcacaatagcaaagacttggaaccaacccaaatgtccatcaatgatagactggattaagaaaatgtggcacatatacaccatggaatactatgcagccataaaaaaggatgagttcatgtcctttgtaggcacatggatgaagctggaaaccatcattctcagcaaactatctcaaggacaaaaaaccaaacaccgcatgttctcactcataggtgggaattgaacaatgagaacacatggacacaggaaggggaacatcacacaccggggcctgttgtggggagtggggaggggggagggatagcattaggagatatacttaatgttaaatgacgagttaatgggtgccgcacaccaacatggcacatgtatacatatgtaacaaacctgcacgttgtgcacatgtaccctaaaacttaaagtataataaaaaaaggatgtgtttgcttctccttctacaataagtctaagtttcctgaggcctccccagccatgctgaactgtgagtcaatctaacctcttttcttttaaattgcccagtctccctcatgtctttattagcagcacaagaatgaattaatatagtagattggtactgctagagtggcttgctgctataaggatacctgaaaatgtgaaagtgacttaggaactgggaaacaggcagaggttggaacagtttagagggctcagaagaagacaggaaaatgtgggaaagtttggaacttcctagagacctggagggctcagaagacaggaagatgtgggaaagtttggaacttcctagcgacttgttgaatgactttcaccaaaatgctgatagtggaatggacgatgaagtccaggctgaagtggtctcagatggagatgaggaacttgttgaggactggagcaaaagtgactcttgttatgctttagcgaagatactgctggcattttgcccctgccctagagatctgtggagctttaaacttgagagagatgatttaaagtatctggaataagaagtgtctttttttttatttttttatttccataggtttggggggcataggtggtatttggttacatgagtaagttctttagtggtgatttgtgagattttggtgcacgcatcacccaagcagtatacactgaacccgatttgtagtcgttttttcctcacccgcttcccacctttctccctgagtccccaaagtctattgggtcattcttatgcccttgcatcctcatagcttggctcccacttatgagtgagaacatacgatgtttggttttccattcctgagttacttcacttagaataatagtctccaatctcatccaggttgctgtgaatgccactaagtcattcctttttatgactgagtagcattccatcatatatatatatataccacagtttctttatacactcattgattgatggacatttgggttggctcctcatttttgcaattgtgaattgtgctgctatgaacatgcatgtgcaagtatctttttcgtatcatgacttcttttcctctagttagatacccagtagcagaattgccagatcaaatggtagttctacttttagttctctaaggaatctccacactgttttccatagtggtcatagtagtttacattcctaccagcaacgtagaagtgttccctgtccactgcatccatgccaacatctatcattttttttttccgattttttgattatggccattcttgcaggagtaaggtggtatcacattgtagttttcatttgcatttccctgatcattagtgatgttgagcattttttcatatgtttactggccatttgtatattttcttttgagaattgtctattcatgtccttagcccacttttcgatggcattgtttttttcttgctagcttttttgagttccctgtagattctggatattagtcctttgtcagatgtatagattgtgaagattttctcccactctgtggattgtctgtttactctgccgactgttccttttgccatgcaaaagctctttagtttaattaagtcccagctatttatctttgtttttattgcatttgcttttgggttcttggtcatgaaatccttgacaaagccaatgtctataagggtttttccaatgttgtcttctggaatttctatagtttcaggtcttaggtttaagtccttaatccaccttgagttgatttttgtataaggtgagagatgaggatccagtttaattctcctgcatgtggcttgccaattatcccagtaccatttgttgaatatggtgtccattccccacttgtatgtttttgtttgctttgtcgaagatcagttggcttaagaatttggggtttatttctgggttctctattctgtatcattggtatatgcctatttttataccagtaccatgctgttttggtcactatgaccttatagtataatgtgaagtcagataatgtgatacctccagatttcagtgtaataaaagccatctgtgacaaacccacagccaacataacactgaatggggaaaagctgaaagcattccctctgagaactggaacaagacaagtttgcccactctcaccacttctattcaacatagtgctggaaatcttagccagagcaatcagactagagaaagaaataaggggcatccaaatcggtaaagaggaagtcaaactgttgctgtttggtgatgatatgatttacctagaaaaccctaaagactcctccagaaagctcctacaactgaaaaagaacttggcaaagtttccagatacaatattaatgtacacaaatcagtagctcttctatacaccaacagcgaccaagctgagaatcaaatcaagaacttaaccccttttacaatagctgcaaaaataaaataaaatatttaagaatatacctaaccaaggaggtgaaagacctctgcaaggaaaactgcaaaacactgctgaaagaaatcatacacaacacacacacaaaaaaaatggaaacacttctaatgctcatggatgggtagaatcaatattgtaaaaatgaccatactgccaaaagcaatctacaaatttaatgcaattcccattaaaatacaaccaccattattcatagaactagaaagaaaatcctaaaattcatatggaaccaaaaatgagcccacatagccaaagcaagacttggcagaagaaatttctaagcagcaaagcattcaagaggaagcagagcataagagtttgaaaaatttgcagcctgacaatgcaatagaagagaagaacccattttctggggagaaattcaagccagctgcagaaatttgcataaataacaaggagctgaatgttaatcaccaagacaatgaaaaaaaatgtctccagggcatgttagagactttcatggcagcccctttgatcacaggcccaaaggcctaggaggaaaaatggtttcctgggtcaggcccagtacctcctgctatgtgcagcctagggacttggtgccctgcatcccagctgtttcagtgtggctaaaagaggccaaggtacagctcgggctatggcttcacagaatgtaaaccctaagccttggcagcttccacatggtgttgagcctatgggtgcacagaagtcaagaattgaggtttgggaacttctgcctagatttcagaggatgaatggaaacacctggatgtccaggcagaagtttgctgcagtagtggagccctcatggagaccctctgctaggacaacatggaaggcaaatgtggggttggagcccccacacacagtccccactggggcactgcctgttggagctgtgagaagagggctaccgtcctccaggccccagaatggtagatccacctacagcttgcccccatgcatctagaaaagccacaggcactcaacactggcccgtggaaacatctgggagggggggctgtaccctgcaatgccacaggggtggatctgcctatggccatgggagcccacctcttgcatcagcatgacctagatgtgagacatggagtcacaggagattattttggagctttaagatttaattactgcctcattggatttcaaactggtatggggcctgtagccctttgttttggcaaatttctcccttttggaatgggtgtatttatccaatgcctgtacctccattgtatctaggaagtaattgacttgcttttgattttacaagctcataggtagaagagacttgccttgtctcagatgagactttttacttggacttttgactaatgctggaatgagctaagactttgggggactgttggaaaggcatgattgtgttttgaaatgtgaggacatgaaatttgggaggggtcaggggtggtatgatatgatttggctgtgtccccacctgaatgtcatcttgaattgtagttcccataatccccatgtgtggtgggaaggtccaggtgggaggtaattgaatcatgggggcggttttccccatgctattcttgtgatagtaagttctcgtgagatctgatggttttataaggggcttcccacttcgctctgctctcattcttctctgtcctgatgctttgtgaagaaagatgtgtttgcttgcccttccaccataattgtaagtttcctgaggctttcctagccatgctgaaccgtgagtcaattaaacctattttctttataaattacccagtctcaggtatttctttactagcagtgtgagaacagactaacacagtcctcttgcatcccattaagcttccgtatgatgattatttcaaattcttgtcaggaaatttgtagatcttctcatttatttggaatcagttactggtgatttaatagttccctttagtgttgtcatgtttatttgattcttcatgattcatgcatgtagccttgtgttggtatctgtgcatttgaaagagaaaacacctcttccagtctttacaaactggttttggcaggcagtgactttctcctgttgggccctcaggctgatgggatttcctctggtatcacagttaagtgtggttggagctgggtcacatggatgctgctggatctgtagtgaagtctacagttggtaggccttttacttgaggctcagttgagcatgaatcctatgtggtccctgggaagacaggactgcctccaggaaattggtcagtggggttggtgctggaacaagggcctacaattggatctgcagttggatccacaaacaagaagtctgttaccaggtgcataaaccagtgtggttcccactgcatcccttagaaagctctcactggttcactgagcatgtctgaattagtcagttttcacactgctaataaagacatacctgagactaggtaatttataaaggaaagaggtttaataaactcacagttccacatggctggggaggcctcacaatcatggctgaaagcaaatgaggagcaaagtcacatcttacatgatggcaggcaagagagcttgtgcagaagaactcccatttataaagccatcagatctcatgagacttattcactaccacgagaacagtatgggggaatcgcccccatgattcaattatctccacctggccctgcccttgacagtggggattattacaattgaaggtgagatttgggttgggacacagccaaaccatatcaatatcctttggaaggcaagactgaccctggattgcagctaagcagtggtggaattaagtcacggggctgtttcaagttgcacagacaggaccaaggtctgcaggcctgcctccattggcatagacattgtgtctctctctgggaccttgagaagacaggctctctcctggaaaatggttgagagagggagcaaagtctgaaggtctgcctctggggataagttggatgtgactcctcccatgtcccttagaaaatagtactggtggcagaaccaaggctaaatggggcttacgctaaatccaaaaggggatgaggcaatatccaggtttgtagctgggaccataaacagtaagaaggcagggcacaggcctgctctctcaaaacagcccctcccagtcttaggctccactcagttttcacaaactcctacctcaatcccaaaggtcctacagaaacacttttttttttcctgtggatggctgacaaattattgttgctgcagggggtatattcaagtgaaaacctcctattccaccatcttgcttcccaatttctatctttgtacttcctgttgaattggctgtactgatatttttatatagcataccacttaactccaccttcgctgaattatttggcaaatccagatcctatggataattaatgtgacttttcagcaacatttgatagaagtaaccactcattccttcttgaaagattttatttatttagattcctggatactacactctcccttttttatttttctcccatcccctggctagtcatcattagtctcctttgctagccatttattgctccgcctcaggtgttggaaagccctagagcttagtgcttaaaccttatctcttttctctatgctcactccttaaacgatatccaggctgttcactgtacttatgttaatatgccgatgactctagaatttctatttccagaccagatctcttccttaatgtgaacctcaaacttaacacatccaagaccaaactccagatttttaccccttaatctgttcttcctatagtcttcacaatctcattaaacggtaattacaacctttccattatggatgccacaaataacttgagagttatctttacttcactcttcttctcacaccctatatccaatccatggacaaatattggctgtatttcaaagaacattcataatctggccacatccatttacactgctaccactctagttccccacctccatcttcagcttggcctattttaatagccccatagtttcctgcttccatctttgaacccctactgcctattctttacggtgcaaccagagttagcctttcaaaacacatgtaatattgcatcactcatttattaaaatgtttacaatagcttactaaatcactccgagtgaaatccaaagtcttcattttggcatacaaaacgctaaataactttttgaactttaactcctactgctgtttttctacataatttcacttaactccttgctattcccaaatacatcaagtatgttcccacctctgcctggaatactctctcagtgcacagttctctcccttcttccaagtatctatttaaatgtaaccttaatataaaggacttcactatcttactaaacgaaacattagcaaccctcacacccccatacaccttcccctttacttcgttgttttttcttcatcacacttatcagatcaactttttgtctattttctacccctctaccagaatatcttcatgagggtaaacagtttgcctgattttcacactgttttgtctccagcaaatagaacaactcttggtacacaaaaagttcaccatgaatgtttaatacatctgcaaagtcacttttgacatgtaaggtaaaatattcacaggttcatagaattaggacatggacatattttgagggacattattcagcctactataagattaaagaacaattcaagtaaaataggtaacatttatatagtgcttactacgtacaaggccatcattctgagcattttacaaacaattatcttagtgaattctcccaaaccacactaattgattgttactattgttatttccattttacagctatttagcaaggatctttttttctttccagggcagcagtgtatcaaaaaggagtttgggttaggtaatcaacaggatatttttcaaatctaaacttccaggattctgatattttgctggactaatttagttcataaggagggcaaaaagtggttctgctgctcttactggcacaaaattcaaaatgatctagaataaaactatctctctgccaactgttcatacctgtcactaccatccaaccctctgtcatgaggctccaccttaatgcaataattcaccaccacccactcaaactctcatatgctttttggcttatctctgcagacagtaaagttcatcaaatattccttctgctctcctacatttttcagcccccataatggtaggcagaaccatactactagttctggctcattcaatgtgtgtgaaaggagcatgagccacttctaggctgaggcagtgaaaatccactatttcctttcttctaccatgagaatataagatgccctcagcctgtgtccctgaggctctggaacagagctcctcatgccaaccagacttagaaacgtacttaaagaaagaaagaaaggaatgttagttttgtctggacatcaagatggggcaggggaaatctgttaccacagcattgtctagacaaacctcactaacatagtatcactgacaggtatctccaaatcatttgctaagcagctcagactgcatttagtctctctactgtcaataagatatgaatagtatctatctgagtaaggtagaaagaaagccacctggagagctatttattctataagaaatgaacaggaaattttgttgtgctgatctccttggaaagagcaatatggggcctgaccatatctcctactgagaccagatgctcagatatgattagagttcagtgtcatctcaaattgctatgaatgaaggcgacttataggtctagaattgatttcgtatagttaacagagctgatttttgcttgtttgttttccttatattttttcaactgagcattttttgagaatacattatgggagacaattcagttgaaagtcatagtccatttcatgaaggagttgacagtctaatggggaggtagaaatgtattcacctaaatatgatataaggcagaatcaagtcagtgcccgttatgaatgggaattctctggtagagtcaattattcaagacgactgggtcataatgaggaaaggatcaaagatgaatgtcattgtttgactccccaccacccagccctgcacttcatccaccaacaacagcataatctcaggccttaaaacctggatattacatttatttgcataagattcttagaatgagataactagtattttgctccccattaaactttaaacattttaaaacattttttcatgtgcttttctatgttttcagattaaaataactttgaagagttgtagtcaaagtatatcctatagcaaaacaatatgcaatactcgtagcaaagacttaagggactaaaacacatacgcaatagtgataaatttggttaaacccatatcatctaagaattgctacaaatttgtcatgaggatggatgacaatctggccctagagctgagaatgtgaaactttctacagaggctaccagaagaaactggcatgccctaaacgtattaccagtgttaaaccgtgctatccatgcctgctctggccctggggacagctgtgagaggaatgctgcttcaaccatctttgtagtaggattaagttggctgacccaccttctatagtaaagtcaaacacggatagaagtttagtactagaaagtgagtcccaagttgaggagggggacagctgagcataaggtaccagctctacatttccctgactctcacttttctctcagtgaatgcgatttactcagggaagtggttaagtgcatagactctggagccaaaattggttgggttgaactcccagttttatcattttccagctctctgacctcacaaaagtcattgaactcctctgtaacactctaacaaacctcaacttaacatttttatctaacaaactatttcacatttttgtccacttagcataactgatacagattggatttttttcaaagaaagttatttttctaaatactaagagagaaaaaaagaagcaaatacaagaagtgcaaaagacaaaaaggatatgcagttcagttatataaggcccacctactccatctgctgccttgctgtgaaaagctggcaggaccttgcaacactccgccttgattccttctttactgtatgattactgcgtcattttgttatcactgaaaagatgtcaaatcccgactactacccaaagttctccccctgagcaagctaataccatctgtgatatgaaagagagagagagacagagagagagagagaatgcaaaagaaattgatttcccctgtgttgattatatattaagatcctcccactcaaatctggcattctgatctttaaactgacgaatacacttctctcccccggtgaatgacctcacaggtgatattcagcaccttcataaaggccatattcctatgccaaatatagatagaacattaccataatgcagcacccatatgcctagatgtacacatatttagagagaataacagggcagatgtggagggaaagggaatttcatcatacatagtgcttctcaaactatagttttagaattatctatagtagaatctcttgttaatggaaatttctgtgttccacaagagacttctgtatcagtattggggtgggacaaacaaatctgcacttttaaaacagactagatgattctgatgtactgaaagtctgacagtccttgtaataaaggcttgggcaaggttaggttattaaattcaaattatgttaacatcaaactccctttatgtgccctgagcaatgctatatgctttatgtaggagaactcctacaaatctcacaccagccctgttaaaaatgtcccattttgcttacattgaaacagaggcacatagaaataaagtaactccccaagactattacaactacttgaagcatagctattaaaagtgtagttaacaaaggacaatgtgatagtctcaaagagaagtattgcaggaattgagtaagggaagaactgagaagccgttaagtgcatggactctggggccaaagttggttgggatgaactcacagttttatcactttctagctctctgacgtcacaaaagtcattgagctcttctgtaccccagatttcccaactctaaaatggaaatgagactgtctcagtctgctttctgttgcttataacagaatacctgaaactgggtaatttataaagaaaagcacttaatccatcttgaattaatttttgtataaggtgtaaggaagggatccagtttcagctttctacatatggctagccagttctcccagcaccatttattaaatggggaatcctttccccatttcttgtttttgtcaggtttgtcaaagatcagatggttgtagatgtgtggtattatttctgagggctctcttctgttccattggtctatatctctgttttggtaccagtaccatgctgttttggttactgtagcattgtagtatagtttgaactcaggtagtgtgatgcctccagctttgttcttttggcttagaataacacttaaatgttagacctaaaatcataaaaaccctagaagaaaacctagggaataccattcaggacacaggcatgggcaaggacataggcatgggcaaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaacaggagaaaatttttgtaacctactcatctgacaaagggctaatatccggaatctacaatgaactcaaacaaatttacaagaaaaaaaaaacaaccccatcaaaaaatgggcaaaggatatgaacagacacttctcaaaagaagacgtttatgcagccaacagacacatgaaaaaacgctcatcatcactggccatcagagaaatgcaaatcaaaaccacaatgagataccatctcacacctgttagaatggcgatcattaaaaagtcaggaaacaacaggtgctggacaagatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaaggatgagttcatgtcctttgtaggcacatggatgaagctggaaaccatcattctcagcaaactatcgcaaggacaaaaaaccaaacaccgcatgttctcactcataggtgggaatcgaacaatgagaacacttggacacaggaaagggaacagcatacaccggggactgtcgtggggtggggggaaggggcagggatagcattaggagatatacctaatgtaaatgatgagttaatgggtgcaccacaccaacatggcacatgtatacatatgtaacaaacctgcacgttgtgcacatgtaccctagaacttaaaatataataataataaaaaaaagaaaagcggtttattttgctcatggttctgcaggcagggaagttcaaggggatggccctggcttgtggggaggatctctgggctgcatcataatatggtggagaaggtcaaaggggaagtggacatgtgtgaagagacaaaacccaaggagtatcctgactttgataacaaactcgcttctcacgggagctaatacatttttgggagaactaatctagtcatgccagaataagaactcactgactatcataaaaaatgcaccaagccattcatgagggatccacccctatgacccaaacacctaccactaggccccacatcacatcactgccacactagggatcaaatttcaacataatattttgtggagacaaacaaaccatgtccaaaccatagcattttcctcctagcccttcaaaactcatgttattcttacatacgaaatacgatcattccatctcaaatagtcccaagtcttaactcatttctgcatctgctcaaaagtccaaagttcaaattctcatctgagacttaaggcaagctccttccaggtatgagcctataaaataaaaacaagttatttacttccaggataccatggtggaacagacatttggtaaacattcccatttcaaaagggagaaataagccaaaagaaaggaatgacaagccccaagcaagtctgaaacccagcagggcagacattaaatcttagcactctagtatagtaattcacactatgtgctacctcctgggcacactgatgtgaggagtgggctcccaaggtcttgggtagccttgctcccatggctttcccgggcacacctcacatggctactcttacaggttggagttggatgcctgcagtttttccaggctggcattccacaccagtagttctacaattctgcagtcccagtggtagctccatccctgtggctccactaggcattgctctggtggaggtggctctgcccctgtagctttggcagctctgtccctgcaactgatttccatctgggtacttaggctttccaatacatcctctaaaatgtaggtggaagctgccaagtgtccacagctctagaccaaaatttactttgtaggtttaaatgcattaatataggtaagttacttaaaacagtactctcagcacatagtaagctctatataagaggcagctattattgccattattttattgctttgattataattgtatacattagactcagatctcctttagcagaaattgatatatccaaagagctgttcttgtactattccaccaccagcctccataaggaactgctcaccatcagtatatacatcttggggtacctgaaaatttaaggaagtgaatactccaattctctgccatgggaggactctgtcctcacagttctgttacagtggctgctgtgttcaccattagaaccattccactatatttatacattgaagagctcagacaaattataagtaacttagcagggttgagaggtaacatatgaacctgctaagtctttgaaaaacagccagctgaaacttagataagagcaaagttccaaggaaacagaaaaccttttgaggaaatttcagaacacagattatcacaatatgtgacacttgggagaggctctagcaccaatttatctcacagtgactgaatcctgagcaaaatggcaccaacttaaggcctgtctgctttgctataactaaaactggtttgtttactaaaagcagtggcagactttgttgctctgggcttcactaaaatacttactatagatatcataaaagcaaacacctgcacaatggataggtgggaaagaggagaaagggcaccataagcaaaacacaattatatttgtcttctcctccctgccccaggagaggggagttggagaacagcccatgatataagtcatatctctatgcttctttttctcagtggcagagggtgatactagacaccatgaagcagctggggcagcagtgaagaggaagattggccagaaaagacagtgcctgtttttctctacagaactaaagcaggacacacatatgccccatgctgctaactcagctgttcaaaagatatgaaacttcataattcaaataagaatttttacaacagaaaggactagttccatcaaatccaaacacgcatactccaagtagctgctgccagataaggagctgttcttcttggaagaatctttaagtaatgactatttgctctcttttgtcacttaggttataaattttagaatcttcatattctagagctggaaagattatgctgtgcagtggccaaataagatgagagaagactaactctattagtccattctcacactgctgataaatacaaacctgagatttagtaatttataaataaaaagaagtttaatggactcacagttccatgtggctggggaggcctcacaatcatggtagaaggtgaaagtcatgtcttacgtgaaggtagacaagaaaggaaatgagagcaaagagggggaaatcccttataaaaccatcagctctcatggaaactcattcactgtcacaagaacagcatggaggtaaccacctccatgattcagttacctcccaccaggtcccttccatgacacgtggggattctaggaactacagttcaagatgagacttgggaggagacacagccaaaccatatcattctgcccctggcccatcccaaatctcatgtcctcacatttcaaaacacagtcatgccttcccaacagtcccccaaagtcttaactcattccagcatgaactcaaatgtccaagtccaaagtctcatctgacacaagtcccttccacctatgagcctgtaaaattgcaagaaagttagttacttcctagatacaatgggggtacaggcattgggtaaatatacccattccaaatgggagaaattggccaaaacaaaggggctacaggccccatgaaagtctgaaattcagtagggcagttattaaaccttaaagttccaaaatgacctcctttgactccataaatcacatccagatcacactgatgcaagaggtggtctcccacagccttgggaagctttgcccctgtggatttgcagggtactgcccctctcctggctgctttcttggctggcattgagtgtctgtgacttttccaggcacatgatgcaagctgtaggtggaactaccattctggggtctggaggacagtagccctcttctcacaggtccactaagcagtgccccagtggggactctgtattggggctctgacctcacatttcccttccacactactctagcagaggttctccatgagggcactgcctctgcagcaaacttctgcctggacatccaggcatttccatacatcctctgaaatctaggcggaggttcccaaaccttaattcttgacttatgtgcacccacgggccaaacaccacatataaactgccaaagcttggggcttgcaccctctgaagcaatggcctgagctgtacattggccccttttagccatggctggaaatgaagcatctgggatgtagggcaccatctcctgaggttgtacagaacaggggggcccagggcccagcacagaaaaccatttttccctcctaggcctccagacctgtgatgggagaggctgccatgaaggtctctgacatgccctggagacattttccacattgttttggtgattagcatttggctcctcattcattatgcaaatttctgtagcaggcttgactttctccccagaaaatgggtttctttcctattgcattgtcaggctgcaaattttcccaacttttatgctctgtcacctcttgaatggtttactgcttagaaatttctttcaccaggtaccccaaatcatctctctcaagttcaaagatccgcagatctctagggacggggcaaaatgcctccagtctctttgcatagcacgagtaacctttactccagttcccagtaagtttctcatttccatctgaaaccacctaagcctggatattattgtccatatcactgttggcattttggtcaaagccattcaacaagtctttaggaaactccaaattttcccacatcttcctgtcttctgagcccaccaagtctctagaaagttccaaactttcccacattttcctgtcttcttctgagccctccaaactgttccaacctctgcctattacccatatccaaaatatcttccacattttctggtatctttacagcattgccccactcctggtaccaatttactgtattagtccattttcacgctgctgataaagacatacctgaagctgggtaatttataaggaaaaagaggtttaatggactcatagttccacgtggctggggaggcttcacaaatatggtggaaagtgaaaggcatttcctttatggtggcaggcaagaaagaaaatgagagggaagtgggggagaaccccttataaaaccatcagatctcatgagaactcactcactatcatgagaatcacatagaggtaactgcccccatgattcaattacctcctaccatgtccctcccacagtggaggttacaattcaggatgagatttggatggggacacagccaaaccatatcaccaaccatgggctaagaagcaagggatgctcagtaaatatctatagatttgaaccaaagtgaattacagtgggttatcaatcttagaaacatgacttttgataattaatgagatgtgattacaccacattgagacttgactttcttgtttggatactaaattggcttctcttccatctcctatttgcaataattcttccaaggatatagacaagggctcaaacataatatcataaagttcttttagtgttctgggatgcaatttacctgtcgtacaaactgaattcatttatttgtttgttgtccaaactcttttggaatataattccttctcttcaaagcttattctcatatattgcaatgacagcactactggcatttgaggtggggcaattctcttataagacttcagtacatctgtctcctacccactaaataccagcagcatgctcccctccgccagttattgtgtaaccaaagaacccactcgcccaataccaaatgttccctcatgggacagtacctcttctggttatgaatcaatctatcatttccaatttgatggcccttctccttgttggaaaacatggacataaaaacgagctgagtagctctgctttctgtctgatgcctgttaactttaaaccacctgctccaaactgggtggcaggtaaaggtaagttcatagataatttaaatacagtgaatggagggtgtagagagtaatgaatatacataaaagagatgacattcaggcatttagacatggcaaaataatggggagatggggatcaggagccattcattaaataaatattttagttcctaatgtgtgccatgtatttgctgttacaaacaggaatgaacaaaacagacaaaactttttatcatcaaggagcttatattattattggggaaagactgacaataaacatgtaactcatatacctgatggtataaaatgctatggaaaatggccagagaaggcctctctgtaatgatgacattaaggcaagtaaaagttaggaggaggttacaatatcccatatgatgatggtggtgtagtcttgtgtgaaagcaagggaggtggtataattccaaaggaagctgacagaagttgctgaaatttggggtatgtgagggaggcataaattattactgcagggttagtggtcttatacactggggcaaaaaagtgagagtaggatgacatttactgagctggaggaggaggtttactgctgatggggttttggttttcattataggagaagacaggcactcaagaattttgtttgggccatccatctgagtggagatgctgaaaataaatcagttagaaaagaagttaaggctggaaatacgacagttgttaccatatagatcatatttatagtcattgacaagatcccctagggaaagaagggaagggcttaggactgagcctgagggcctcccccaaagtttcgtaggcaggaaaggaaaggagtgaagaaagctgaaagtagccagtgaggtagaaggacaattaagagagaatgggatgacagaagccaagggatggtaacatttcaagaagaaaaggaaagcaaacagtttcaggtactgctgaaagatttggtatgatgagcaatgagatttgaccattggatttgataaagcagaagtccttggcaaacatggcaagaaaagtttcagtgaagtgatgaaatggaaaacttgactgcaatggatttattagtgaataagaaaagggaaacagtgagtatagaaaattcttctgagaaattttgctgtaaagagaagcagagatacacttcaaaaagcagaaaaggaatgggaagtcaaaaaagttgttttgcatatttttatgatagaagatattacagcatgtttgtcaacagagggaaatcaattggtagaaaaagaaaggttggtgaagcaggagagagaggtgagacttgttgaagggctgctctttagtagaatgcaaggtacaaattgagagattaacatgagttcgcagtacacagctctgagaaatgggaggcaagttatatgagtacagattatgagaggtagataaatgacatggtaagagcatgaggaatttgccttctaattgtttctgttttcccagtgcaaagtaagaatggaggagaagatatcggatgtttaaacagaggtgactgtgaattagttgtctaagaatgtggggaagtgagtgaaaagggcacttagcttaagaccttaaaaattattccctcgtcttcagacatggataaaaccatccaataaaaaattaaactatttctttttgttgttgaatttttatggctaccatcacaaattaaaataaaaaaattaaaattaaattaaaataaaataaaataaaaaataaattaaaaataaactaaaataaaaaaaaaattttgcaatagttggcccatctgcagctttgagaaaagttcatcgataactaaaggtgcctcatctgataccaatttaaaaaacgaacccttatccatcattttatgagactggagaatatggcttgatcttggttttgacacaaagaggaaaatgcttaataattcagtaagtgcttaggaaaatgtttagaaagccaccttgtcccccagtatggccgtgtctccaacactatgcttcagaaaataaaactttcaacatgtgctcagtcagtcaaaaacacctctcggaatcaagttctgtgccaaaccagacacttaaaagtagaaaagagaggccaagaaaggaacatggagacaaactcaacctgctccctgatgtgtcagctccatctttgcttatattctagcaagggaaatagcattagtataagaacaactaatgtaagacaaatagcatcacttaaatactagcagatttataaccttttgtttggctgaacccctgcctagaatacaaaaagttcaccactggatagccaggcacagtagaaagagatatgattaaaatgaaaataacaccaacaaatatggacaaaatttcccccagtctctccaagtccctccaatgctctctggactctaaagattacgtaagtatactccagtatctccaagtgtcgagtagtagtacctaccgtaacttatagcctctgaaggtaagaattctctgtagcattttcccactattgccccactcaactaccatgtcatcataggcatagtcatgttattggacagaaccaatcacagttctcccttcaggaataaactggtcaccattatcagactcaaataattttgtgtcctctcttcaagggcctacttgatctactcttagaactttacccagataatgtctactcacaattagacaggacatcagacttaaccaggaaattattcatatccacaaggggaactttccagatccatttctgttctctccaacagttagccagttttagtgactttctcttccagattcctattctttatgagaagaatattgacccagtcctgaaaatgacactgtgtccctcttttcatcacattatgatgaggtaatgtgactccttcatactccttggcacatgattactggtgaaagaggcttattgtcactccaaagggaccatcataaaaaacactccaatatatgctaaagctcacaggttttgacaagaaccataaaatacacttgaaaaataccataggaacataaacgtgggaatcattgctgatgactgggaaaggccaagaaagcttcatgggacccaggtaacaaagtggcatatgtagcccttgaatctaaaataaaagtcaaaaataagaaaagaaagcttcatgggagacatgtccctgaatgatgaataagaattaagcaattgattgatgaaggggaaaagatattcataaaagaagagaaaaccataccaagagacaagttcaaaagtagcagtccagtttgctggagaaataaatgtagctgaaaaggtgataaaacacagacggggtcacattatcagaaaatttgaaagccagggaattgactttggacttgactttggtaacctgaaagaacagagttcattgtcatcatcattttatggtgagaagcataatgttatagtgcaaaacacaaatgaactaagacatactcttggttctatccctaactagctgtgggaactgaagcaattcatttaactcagtttatcccacatatgtataatgatggagttagaatgaatggtctttaaaggcccattttgctctgatacaatgtaatcggaagaatcctacctattcttcttggtcaagcttttatgtgacatctattatctaaaatttatattaaatagttgtactaaaagttttaagctaataactctgatttaccagaaagaaaggttgataataaacaatattttagaaattctccaaacctgccatggattatagaggattgctacatggggaaaaataaattaaattaaattagcgcaacaatttggaaaccaggaaatatctaccacctccttgcaactcaggacaagcaagagaaaaggttcagtagtaaagggaagcaaagaggccactgttagaaagatatatgaacttttattttgagactgtgaaatgagtgcaaccatttaactccttaaatgcccaaaattactactgaaattgaaataatagaaaataaaaagaagataatatatttcaatacaaaaatatggaaaggggaactataattataccaaaacactgaagaatttctgcaagatatagttataatattgatagagcataaacagtgccatgtaaaatagaggagggagattactgtcacagaggtaagagacatgctttaaaatggttcttcataggatgaaattcaaagctttggggaagcaaaaacaggaagcacaagcaggtaatagaaaaactgttatagtgataaaatattggagaacaggtgaaagaatcatttacaccttccaacctcagtaccaagttgtaaataaagagtacatggatacggtattttagtctaaacatcaattatttttttaggagatagagtctctttctgtcacccaggatggagtttagtggcatgatcacagcttactgcaccctcaacttcctgggctaagcaatcctcccacctcagcctcccaagtagctgggactgcaggtgcataccaccccgcctaactaatttttgtatctttttttttttttttttgtaaagacagggtctcattttgttgcccaggctggtctcaaactcctgggctcaagcgattctctcacctcagcttcccaaagtgctgggcctacaggtgtgagcctcacacctggccacatcagttacttttaaaacacagagtatattccataaggaatatctattatgtgtgttgggactctagtgatatcttcaattctcaataaaaatgatgtgatgttggtcaaagcacacaaaatttcagttagcaagaggaataagttcaaaagatctattgtacaacaatagtgactacagtgactgcagtgcacaacaatgtagtgtatactggaaaattgccaagaaaagtagattttaagtgtttttgccacaaaaaagtctgtgagagaatgcacatgaaaattagcttgatttagacattccataatgtatacaaatttcaaaacatcatgttgtacaccataaaaacatacgctttgtatttacaattaaaataattaactaaccaaaataaatacataaatgcatgaaaagaaagaaatggggggaaatggggaaaacacaactctgcataggcgttaatacattaaagtgttctacttcaggataatgactttttttgccaataacaacaatatctggcttgtctagaaatttcataccaaaatactcttgagagaagtctgtcagcatatatactcctgtgtacacagggcaaattactcaatcctccattcagcaaagaggtttattgtgacaatgtgctcctataactactaaggaaaactgtattggatccaaatgatgagctaagatcttctttgataaatatgaataggcactcaagaatcatcaaatccttgaagaaaaccatgacaatgaaaaagaagcaagatgaacatattaaacaattatccccaggagaaagaggctcatttagtcaccccagaaaaagtcaacaggatgttaaaacaataaaataagaacacactactatgaaaatacatcagtctgatctataagaaatttaaaactttgtttttagaattttttttaactgaaggaaaattgagagaaaaaaaatggccaaatattaaattagtgatctggaagccctcgctaggatattctcccagaaatctctaagaaaggaaaatcaaaacatcaagacaaaaacaatggatttagtagattatttgattagtcctataacgactaaaaagtactctgtaattaacatcttcccacaaataaagcttcaagcctagatgtctttggagacttcaaccaaacatttaaagcaaaaataaggacaacgatacacaatctctttctacaaagagaaaatgagaggatatttcaaccacattataaggccaacataactttgataccaaaatctgattaaaacattgtaaagaaaagagaactacaagtgattctcacccatagagatgtaaacattcaaaacaaaagatttgcaaagcgaataaataaatatataggaacatggaaggatctggaggccattatccttagaaaactaacacaggaacagaaaaccaaatattgcatgttctcacttataaatgggagctaaatgatgagaacacgtggacacatataggggaacaacacgcactggggcctattggacggtggacattgggaggagggagagaatcaggaaaatataactaatgggtacaaggtttaatacctgggtgatgaaataatctgtacgacaaacccccatgacatataacaaacccgtacatgtacccctgaacttaaataaaagtgaaaaaagaaatatatataaaagaaaacatcatgaacaagttggagttatttcaaaaatgcaagcgtggcttaaaattttaaaatcaacataattcatcacattaaccaaataaaggggaaaagaatcatataaatatttcaatcattaagaaaaatgttacattactgggcatgctcacatgcacctgtagtccagctaatcgggaagctgaggcagcaggatcacttgaatccaggagttcaagaccagcctgggcaacatagcaagatcctgtctcaaaaaaaatgttctattgctaataaaaagtcttaaaaactaggaatagataggaatttccttcatctgatgaagagtagctacaaacaagactacagcaaacatcatactgaatgatgtaattttagtagtttcccctttaagatcaggagtgagccaaggatgacgactatctaaacttttaatcagcatcgtactagagatcctagccaaaaaaaggaaagatagaaatgcaattgaaaaggaaaaattaaaattgtcattttcaggggtataattgtgaatatagaaaattcaaaaggatctatagattattcaaattaataagttcagcatagtttctgtatttctatatatcagccatgaacaattacaaaacaaagtaaaatagtgtttacaatagcatgaaaagtaaagaggctcagaatcaacgtagcaatagtttttctcaatagaggattgccttaatgctgagaaagtcactctagatgcagggttgttatagatctgcctagcaaagcttaaaatcaaggcttaacttagcaaaatttttctaagtaacttagctttgttccagaacaaagcgcaaaaacacataaaggaatacaaaaacaaccaacacacaacaatctgccacaaaatgtctgcagtccaataaagaactaccaggcatgcacagccataaaaaacgatgagctcatgtcctttgcacggacatggatgaagctggagaccatcattctcagcaaactaacacaagaacagaaaaccaaacaccgcatgttttcactcataagtgggagttggacaatgagaacacatggacacagggaggcgaacatcacacaccggggcccgtcgggggttgggggctaggggagggatagcattaggataaatacctaatgtagatgacgggttgatgggtgaagcaaaccaccatggcacgtgtatacctatgtaacaaacctgcacgttctgcacatgtatcccggaacttaaagtataataaaaaaaaaaattaccaggcatgcaaagaaataagaaaatgtgatccataataaggagaaaaatcagtcaatagaataaaaacataaataacacagattacagaattaatagacaaaggccataaaacagcagttataaatttctgccatgtatacaaataggtagagaaaaacatgaagacaatgaagaaataaacagaagatattaaaagacttaaattaaaattctagagaaaaatacagtatctgagatgaaaaaaattcaataaagtaacctaacaacagattgtcattgcagaaaaaaaacgaataaacctttagacagagcaacataaactatcagaataaaacagagagaaaatggctaaaaaatgaaagagtaccagtgcacatcaagtggcctaacatatttgtaattggaggctgaggcatgagtaagattatttaaagaaataatgggcaaaatttataaatttgatgaaaactataaacctacaaacccaaaccaaatgaatcctgagcataagaaaaatgagaaaacattaactacaatctaattatgaaaacagtaataaaaagaacaaatctttaaagcaaccagaagtggagaaaaagatatatgatacagaaaatgaataaaattaaatcagacttctcaccagaaacaatgcaaacccaaacacagtggggaaacatctttgaagcattgaaagtaaaacaacaaaaatcaaccatcaatctagaattctatacccagtaaaaatatctttcaaatgtgaaagtaaaataaaaatatgtccagacatacaacagctaagaaaattcatcatcaacacaccagcattagaatgaatgctaaaggaattgcttcaggcagaacaagaaaagataaacggaaatttgaatatacacaaaagaataaagagccctggaaacttaaatatgcagataaatataaaacactttttaaacttattccttagtctcttaaaaagataattggctttgtttacagttgacaaagctactttatgaaatcagctgacagagataaactgtaagagcattatcagcttgattagtgcataatgttacagtgggttgctcatctcaggccttaaagctttttgaaaaccaacagcatcacaatttgttttggactttattacactattattctcattatgaaaatttagttttgtagggtttttcattcttcaaagaggcacagggccaaattgttagaggaagaatgcagaacgtaaatttgtatattattactttaatatgcccacattttccttaaaatattaaaagaaggaatcctgcaaaatagaaagatttgtttgtaaattctgatagtgagataatgagctagtgacgggtaatttttcttttcttggacacttaattctgttatgaaactcaattatcacattgctttttggcatcatatctggaacgccaccatttaaaagttaagattcttggtatttgggagtcttctagatgctactaagaaaacaggaatgagtttctttactgaaagttttttgatgtggtgtcatagaataacgtgttgtagacacaaccagctgctttattaccttaaaactaggcatttgtaagtattaaaatttaagaatatggcagatgatgtcccttaagattcagactatacttaactagctcttcagattcgacaacacaatttttcctcttttaaaaaattataggagacttgtaactcaatactgctattttctgtttctaatttgctgctgataatgtatatgcatttaacatgctgtgtaagctgtgtcctagttactaaacagcttatgcaatgttactttgctaaatagtcaaaagaaaggaaaaagataactgtataaatcaaaagtaataacaacatagtatgaggcataaaacatatgttggagtaaaatgtacaataaaaatagcacaaagtcttggggagggaaatagaagcactgtatactgttgtacagttcttatatgacacgaaaagtggtataatgttatttgacattggtacaatgttgttcaacattgtactggaaatactatccagtggaataaaaaaagatacagggaaagcaagcatgaagcttggaaaggaaggaataaaactgcatatattcacagaagacataatcatttatgtagaaaatcttagataatccacaaagaagccactcgaactaatatttgtattttgaaaaatttagagagtatatgaggttaattaatatacaaaactgattgcatctctgtatactagttatgaatacacagaaatcgaaatttaaaaatttagaagttaccatttaggataccatccaaaaaataaaatacatccaaacagcatccaaaaaattcaaatgaaatattgaattttaaggaagaaattgacaatagattatcaagagatgtaaaacagaattacaaagcattgttgggagaaatcaaagaagtcctaaataaaatgcaaagatatactgtactgacagatcggaagttttattattgttaatattcatttctacagatcgacattcaatatgaagtcaatgaaaactcttgcagacttttgtaaaagttgacaagctaattctaaaattgatgtggaaatgcaagaaacctaaaacagtcaaaacaatttaaaaaaataaaataagaattgtaggactcacactactaaatttaaagataatataaaactacaataaagacagtatagtattggtgtaaatatagatatatagatcaacgaaacatagtaaagcatgtagatatagaaccattcaaacatggtcaattggtatacagaaccaatgaaacggcaattatttcaaaaaattgtactggaacaataagatatctgtatgcaaaaaaaaagaacactgaccattaccacacaccttacaaaagtattaacttgaaattgattgtagacctaaatgtaagggctaaaacttttaatgttctagaaaaaaaaagaaaaaatttgagtgactttagaatagaaaaatattgttttaaatagaacacaataaccatgacatgtaaaagaaaggtgataaatttgtcttcactaaaattagaggctttggctcttccaaagacactgttaagaaaattaacaggcacggtggctcacatctgtaatcccagcactttgggaggccaaggaggatggatcacgaggttaggagttcaagaaaagcctggccaagatggtgaaaccccatctctagtaaaaatacaaaaactagctgggcgtggtggcgggctcctgtaatcccagctactcgggaggctgaggcagagaattgcttgaacacaggaggcagaggttgcagtgaactgagatcacgccactgcactctagcctgggtgacagagcgagactccatctcaaaaaaaaagaaaagaaaaaaaaaaggaaattaaaaggtaagccacagactgatagaaatatttataagatatatatctgacaaaaaattgtatagagactatattaagcatgtacacctcaataataaaaaggcaaacagcctaatttttttaatgggcaaaatatatgaactgtcactttaccaaacataaatgaatcttagaagtatcatattgagtgaaataagaaaagcctcccccaaaataaaacatatacactgaattgcatttatatactgttcacaaacaggcaaaattacacaatattgtgtggagatgcacatatgggtagtaaaactacaataaaatcaaggtcattctaattatgaaactaaggatatcagtttcttccataaaggaattagatgggagtgattttcaagagacacacagtgggccttaaggtgctggtaatttcttgagctgaatcatgactatgcaggtgtttgctttataatcacaggtgttcactttttataaaacttatgaaaaattttaagtaacacgagtagaataaaaatagaaagcaaaaattgccagccactagagaataaaaagggattaaagaagccttagtaaacacatcaaaaacccacaaagatagtgattccacagaaaacggcagaatagggaattcacagtcccctccctccataaaagcaacagataaactagcaaaaactgtcagaatcaactttgcaggactctaggaactagtcaaaatttacaataaccaggagaaagtttaatgaaaaaggaagctgctgcgttgtagtaagagaatgttgtggactttacaatttcccaccgatcatcttccacttcccagatcagcagtggccatgaagatgacatcctgcattcctggttcaggttgctagtgccaaagggagcaacaggaattttattctcaaatagctgtgattgtctttcaactagttgggtagcattatgaagcatcagcgcaagggtttgcatttgttttgctcaatttacaccattcccagggtggagtggcttcctaggtgatttttgcagaaagtgtttaaagacaaacattggctaaaggaatcttgagcaagaaataggtatgagaaatagacaaaggaaaaatcatgggaaggaggaagttggtaaaggagatatggggagggaagtgaataaaaacttttgaagctcttgcttataggtgggaattgagaaggcaatgcagttgcccagggctaaacatatgctcaggaaaggcctgagaaaaccctaagctttcacctttgagtgaccctcaggcttctctcaaaccggaagtgaaggttaaggcctggctaagcagtaagagtgccacaacagaaagccaatctaactaaatagattttttttcctgtttaatatttctttctttctttttttggcttcaggcttttacagaaaccatgtaaaacactatctgaccattaaactaatgcaatacagatttcaatggccacacatgacaaagaatacagactttatggaaataatttagaagagtcactaaacaaacaaacagccagtagcaagcagcaacagcaagcccagggagggtaataatctgatttccagagttgccacattatactattcaaaatgtcctgtttttaacaaaaaaatttacaaagcatgcaaagaaacaagaaaatatgacccatttacagaaaaaaattactaatagaaactgttcctgagaaagcttacatattgggcttacgagacagtgatagtaagtcagctgccttaaatatgctcaaagagctcaaggaaatcaaagacaaagaattaaagaaaatcaggagaatgatctctcaccaaagagaatatcaataatgagagagaagttattgaaaagaaccaaattaaaattttagagctgaaaaagtacaataactgcattggaaaatttaccagagaggttcaacaacagatttgagcatacagaagaaagaatcagtgtactaaaaagatagattaaggaaatcatctagtctgaggagaagaaaaaaagaatgaagaaagtgaacacagcctaaaagacctataacatcaagcataccaatatatgcataatgaaaattccagaaggaaagaatagaaggcaaaaaagtatatttgataaaagtgtggccaaaaatttcccaaagttttcaaaagggataaatatacacatccaagaaaattctacaaatttcagatagcataaactcaaagagatccacaccaagacacattacaatgaaattattgaaaagcaaaggcagagaatcttgaaagcagcaagagagaagtgactcaccatgtacagaagagcctcaataagattaacagcttatttctcttcagaaatcttggaggccagaggcagtaaagtgctgaaaggaaaaacttgtcaacaaagaattccatatctgacaaaactttccttccaaaataaaagagaaataaagacctggtcaagtaaacaaaagttgatggagtttacaacttgtagacctgtcccacaagaaatgctaaagcgggtcttcaaagctggaaagagtaactcattagatagttattcaaaaccatatgagaaatgaagagcaacataaagctatctacatagtttaatttaaaagccagtttcataactattctggtttgtaactcatctttttccccacattatttaagaagacaaatgcttaaaacaataattataaatctatataaatggacacacaatgtataaagatgtggcttgtgacagaaacaatatgggaggctggagatgtaaatgagcagagtttttgtatactattgaaattaagttggcattcattcaaatttgatagttacagacaaactactaagataaaaattaaaaaaaaaaacagaaaaggaaataaggaaggaatcaaaatggttcacaagaaaaaaatgaactaatcacaaaatatggcagtaatggaggacattaccaacaaacatatgaaaaaagcccaacatcactgatcattcaagaaatgcaaatcaaaaccaccatgagataccacctcacaccagtcaaaatggcaattattaaaaagtcaagaaaaaatagatgctggcaaggctgtggagaaatgggaacacttttaccctgtgggtgggagtgtaaactagttcaaccgttgtggaagacagtgtggtgattcctcaagaacctagaaacagaaataccgtttgacccagaaatcgcatgactgggtatatacctaaaggaatataaatcattctactacaaagacacatgcacatgtatatttattacagcactatttacaatagcaaagacatggaaccaacccaaatgcccatcaatgatagactggataaagaaaatgttgtacatatacaccatggaatactatgcagccataaaaaggaatgagatcatgtcctttagagagacatggatgaagctggaagccatcatcctcagcaaactaacacaagaacagaaaaccaaataccacatgttctcactcataagtggaagttgaacaatgacaacaaatggacacagggaggggaacaacacataccaaggcctgtttggggggtggggtgtcgaggggagggaacctagatgatgggtcaaaaggtgcaacaaaccaccatggcacaggtatatctatgtaacaaacctgcacgttctgcacaggtatcccggaactcaaagtaaaataaaaataaagaaaataatcaacaaatcaggagtagaagagcactgactcaacaggataaaggacatgtatgaaaactccaaagctaacaatatactcagtggcaaaaaagtgtaaacttccccctaagataaaggacaaaacaaagatacccactttcactgctgcaatgcaacactgtagtggaagttctatgaacaacaactaggcaataaaaggcatccaaactggaaatgaagagggaaaatcatctctttttagagatgccatgtagaaaatcctaaagaatcccccagaaaactattaattaataaatgaattcaagttgcagaatataagattaaaagacaaaaatttattacacttttctacatcagcgatgaacaatgcaaaaagaaacttaggaagataatttcatttataatatcattaaaaattaaataaatgttttaatgatttaaccaagtaagtgcaaggcatgtgttgaaaattataaaatattgccgaaataaattaaagaaaaaaaaatttttaaattaaataagatggggaaaggcgtgccatgttcatggattggaaaattcaatattgttaagacaccagtattactcaaagaaatctacatattcaattgaatccctatgaaaatcttaaaggacttctttttttgcaaaaatgaaaaactgatcctaaaattcatatggaattgtattggactctgaatagccagaataataggggaaaagaaaaacaaagtttgaggacttacacttccttctttcaaaccttactacaccaatcaaaatagtgtggtactagcatgatgacagacatatatatatatatatatatatatatatatatatatatatatagatagatagatagatatatagatatatagatatagatatagatatagatatatatgatatatatctgtatgtatagctgtatatgtacatatatcatttatatacctaggttcaattgattttgaaattgattttaatccattgatttcgaatggcacaaatatcattcaatatgaaaataatagtctcaaaaatggtgctggaacaactgggtatccatacgcaaaagaattaagttgggcccatttatcataccataggcaaacagtgacccaaaatgggtcaataatctaaatataaaagctaaaaccataaaactgctaaaataaaatatagggtaaatcttcatgaccttggatttggcaatgggtttcttatatgaaaccaaaagcatgagctacaaaataaaaatagacacattggatttcaaaattaaaaatggataaatttgactacatcaaaattaaaaatttttctctttcaaatacaccatcaagaaagtgagaagacaacccacacaatgggagaaactaattgcgaatcatatatataacaagggcctattactcaaaatatacaaggaaattttacaaattgacaacaaaatgacaaacaacctaactaaaaattgagcagattatttgaacagatattgctctaaagatattcaaacagccagcaagcacatggaagtacattcaatgttattagtcactggaaaaacacaaattaaaaacacacctcacatccactaggatgctcataatcaaaatgtcagacagtatcaagtgttgacaaggatgtggagaaattgaaacccctgtacattgcttgtgaggatgtaaaatggttctgttaattaagaaagcagtttggcagttcctcagttaccctgtgacccagcaatttcattactaggtatatacctgaaatacttgaaaacaggtactcaaaaaaagaaaaaaaaaaaaacacagacacaaacgttaatagcagcactattcacaatagaaaaaaaaaggtggaaacaacccgaatgcctgtcaacagatgaatggataaacaaaatgtggtgtacacaaacaatagcatactattcagccataaaaaggaatgaagtactgatacatgctgtggattaacctctaaaacatgctaatttaaagaaaccagacacaaaaaagcacatactgtatgattccatgcgtatgaaacatttacaaagggtaaatctactgagatagcaagcagaatagtggttgccaggggctagtgaaggggtaaatgaagaaggactaatatgtatgaaatttcatttaggggtgatgaaaatgttttggaactacacagaggtgatgattacacaacattttttttattattatactttaagttttagggtacatgtgcacaatgtgcaggttagttacatatgtatacatgtgccatgctggtgtgctgcacccattaactcgtcatttagcattaggtatatctcctaatgctatccctccccccaccccacaacagtccccagagcgtgatgttccccttcctgtgtccatgtgttctcattgttcaattcccacctatgagtgagaatatgtggtgtttggttttttgttcttgcgatagtttactgagaatgattggaaatcatcattctcccaccttctaaatatgcttcatctatggtcttcccaatctgggtaaattgttccaccataagccaagcccattcattataccttctaaatgtcttttaactcttccctcttctttctggctccattattactgcacaagcccaaacgccatcccaaaaagcaacagcaatgtactttgcaccacaagtcaagcttaactgacttagggctcactgttttctgtctgaagctactgttctttgttttcctactacttcctgattctatgctccagatccatacattaacttgcctacttgacatcttcatttgaatgtcccaagtgcacctcagtgtaacatgccctggacttttaccatcatcttttgccaggattatttcaaggcatactaatcggcctccctgcttttcacccttggccctttaattaattctctgcacagcaaagagtaatatgttttacaatgtaaatcagaacgatatcactcctctgtttaaaacctctcatcagctccttttccttttatgacaaatatcaaattctattcgtgtggcttactggggtctacacactctgaacactgcctacttctccagttctgtcatatgttgttctacccaaatctcattggacatactatttcctttgccaactcaggcctcagcttattctatttcctcttccagaatataatttatccactaaccccaactcttttcacttggttaacccctatccttccataagttcatcgtttaaacttcacatcctttagataaacatttatttccctcacctctaacaatggcaggtcccttcctctggcttccgcagaatcatgtgcttttcctttgaaacacttagaacatgtctaactatttactgctacatatttaatatctttcccacccctaaaaggctaagttccaagagggcagagatttttatctttttattcaacattatatccccaatgcctagtacaacacttggaacatagctggagttcaataagtatctgtgaacttacttcaacagtcctacaattgttccccttgcctttatttttccctttctatctcccctaaggtgcaaaatttgaacaaaacaattaactggttgcccaatgcccttgatataaaggctaaacacctcaacatgacatagaatatcgcatgatcaagatactgcttgtcactagagattcatctcccaacactccctattcccacaccaggctccatactgaactatttgcagtttccctgagcacttggcatatgcctgctacaaataaatcaaatattttcaaaataaataaatatttcttccaaacagttctaaaatccacatatctctctctattccactatcactatcctagtctagacactcgtaatatctcatgtattcttcttcagcaacctcttaacagacttactcccaagtctgccctttatgccactgccagaaagatcttactaacatataagtttcaatatgacaatctcctctctctcttaaattccctcaaagagtctagccacttataaaatgaaatctaaattcattagtatgacacacatgattggttatatgaggtcatcagtttacgatgcttggcaaaatgtctgtcatactaaaagtactcataaatgttagtcactgtgttcttttgctgcaggaacaaacaaaccccccgcatcaatctcaacatttgttgctcagggtcttcaggccagctgtgatttgatagggttcacctgggctcaggttcaaatgtgctccatgtagtctcattctgtgacccaggcagaagaaacagcagtctcattctacaacccaggcagaagaaacagcagctatctggggatatgttcttctcatagatggtggtaagagcacaaaaggccaaagcaaactgtgtgggcacatttaaaacctctaatgggacatggcatatttcttacttgctcacattacattggccaaaactctccactcatcacatgactaaactgaaagtcattggggcagggaagtaaactgcacccactaagtggcacggtaaagtcacatggatgaaaaacactaatatagagagaaactagaatagttgaaaacaacattctaatccactagagcttccattattattcaaagaacttcaccaacttattcctacctacttttgcggttacatcttctgctactgccaaacttgaaatttacattgcagtaatactgtggtagctagtctctaaaaatgagcccccaatgatgcgtgccttttggtattggtggtattgtataggctccatcccttgaatcttgggtgaatatgttattcattagccaccaatagaagtagaagtgacactgcatgacttcttagccaggtcagaagaagtcttgcagcttcaaccttgctcccttagaaaagcacacttgtgattctgtctctcaggaagctccctcttgaaactagttattatattatgggaatcccaagccatgtggagaccatatgtgtgcacttcagtcaactaccccagctgaactctcaatgaatggccagtatcaactaccagtaatatgagtgagcaatattgtacatttactccagttgagtcttcaaaagactgtagccccagctgaacaactaactacaactgccaaagataccttaaaaaggaaccacaaatctgaatctggtcaactcacagatttgtaagagaaggttataaattgctttttaaaaaaatattactttgttttggcatcctgtgtttatttcagttgtggcaaaatacacataacatagaacgtagcatcttaactatttttaagtgtagagttcagtggtgttaagtacatttacattggcatgcaaccaatctccagaactgttctcatcttgcaaaagtgaaattctataccctttgaacgatattcttttctctcccctgcagcaaccaccattctaccttctgtttacatgaattttgctatgctaggtaactcatataagtgaaatcatacaatatttgtctttttgtgactggattatttcactgagcataacatcttcaaatttcattcaagttgcaacatatgccagaattatcatcctttataaggatgatataatagtccattgtgtggataaaccatgttttgtttattcatttatctgttgatggatacttgggtagcctgcacctctttgccatttttaataatgctgctataaacataagtgtatatatatacatatatatatcttcaagatcctgctttcaagttttttgaatatgcacccagaaccgaaactgctggatcacatgataattctatttttattttttaagaactgctttactgttttccagagcagctgtgccatttgacgttcaaaccagcagctcacaaggtttccaatttttccacatccttgccaacacttgttattttctgtttttgtttttttttttaaatagcggtcatcctaatgtattttaaatggtaaaatattaaattatgaagtggtttctcacacagcaatagaaaactaaaaaggaacttaggacctaaagtgaagtgatgtctcaccaaaaactaacacatgtggcttcagcattgggaccagacagcaggcagaaactaaaaggacattaaatagactattagttaaggttggaagagactcaggaaaactgttatgaaaagctagaagggccttgagaagaccatggcttggaaaacagtgagaaaagcattattggaggaaagataagggggcccttgccaacactcacctgggcatcattgaaaataaatctggggcccaatcaactcattaatatggctgggaagatttccaggcaggatataaaaaatagcaactagtttcttcctcttcatctagagtgatcaactaaaggatgaactgttcagttttcaagcagatgtggaagaaacataaagcagccagggtatgctggttatagaaataactgtttaaggaagggtattagttcattctcacactgctataaagatactacctgagactgggtcatttataaagaaaggaggtttaattgactcacagttctgcatggctggggaggccttaggaaacttacaatcatggtagaaggcaaaggggaagcaaggcaccgcttacatggtggcaggagacagagagagagaccaggggaaactgccacttttaaaccatcagatctcatgagaattccctcagtatcacaagaacagcatggaggaaaccattcccatgacccagtcacctcccaccaggtcccaggctaaatacatgaggattataattcaagatgagattttggtggagacacagccaaaccacatcattctcccctggcccctctcaaatctcatgcccttctcacatttcaaaacaccatcatgccttccaaacagtcctccaaaatcttaactcattccaacattaacccaaaagtccaagtccaaagtctcatctgagacaaggcaagttccttctgcctatgagcctgtaaaatcaaaaagaagttagttacttccaagatacaatgggggtacaggtaatgggtaaatgttcccatcccaattgggagaaattggccaaacaaaggggccacaggccccatgcaagtccaaaacctggaaaggaactcattaaagctccaacataatctcttttgactctatgtctcacatccagggcacgccgatgcaaggggtgggctcctacagccttgggcagctctgtccctgtggctctgcagggttcagcccctgtggctgctttcatagatgggtattcagcgactgtggcttttccaggctcatggcaaaaagttgttagtggatctaccattctgggatctggaggatggtggccctcttctcacagctccactaggcagtgccccaatggggactctgtgtgggggctccaatctcacattttccctctgcattgtcccagtagaggttctccatgagtgctccacccctgcagacttctgcctggacatctaggcatttctatacatcctctgaaatctaggtggatgctgccaagcctcaactcttgacctctgtgcacccgcaggcccaataccacatgaaagccaccaaggcttggggcttgcaccctctgaagcaatggcccaagctatacttttgccccttttagccatggatggacctggagcagctgggacacagggcaacctgtcccgaggctgtacagagcaccagggcccagggcccagcccacaaaaccatttttccctcctaggcctctgggcctgtgatgggaagggctgccactaaggtctctgaaatgccctggaggcatttttcccattgtcttgactaacattcagctcctcattaattaggcaaatttctacagccagcttgaatttctgcccagaaaatgggtttttcttatctaccacatgatcaggctgcaaattttccaaactttgatgctctgcttcccttttagataaaagttccagtttctgataatctctttgtgaatgcatatgactgaatgctttcagaatcagccaggtcataacttgaatgctttgctgcttagaaatttcttctgccagataccctaaatcatctctctcaagttcaaagttccacagatctctagggcaggggcaaaatgccaccagtctctttgctaaaaaaatagcaagagtgacctttgctccagttcccaataagttcctcatctctatctgagaccacctcagcctggacttcattgtccatatcactatcagcattttggtcaaaaccattcaacaactctctaggaagttccaaacttccccacatttttatgtcttcttctgagccctccaaactgttccaacctctgcctcttacccagttccacagtcactttcacattttcaggttatctttataggagtaccccactctgctgataccaattctctgtattagtctgttctcatattgctacagagatactacctgagaatgagtaatttataaagaaaggaggtttaattgactcacagttctgcatggctggggaggcctcaggaaacttacaatcatggtagaaggcaaaggggaagcaaggtacatcttacatggcagcaggagagagagattaggggaaactgccacttttaaaccatcagatctcgatagaactccctcactgtcatgagaacagcataggagaaactgccaccatgatccaatcacctcccaccaggtccctcctttcacacatgaggattacaattcaagatgagatttgggtagggaaaaagagccaaattatatcaggaggaaagattaaatccttggccagatgacaggatttcagtaagatccttagttaagacctcagaaagatctgtgcttataaatcaatctataagttccttatagaaaactcaaggtaccaacaaaagaccattctaaggatcttaatggcatacctctagacccctgtcataaacaacagagattttaaaaatcttcacagtcttgttccacagcagcccagaggtccaagatagaaaaaagcctgtctcaaagagatttgtggatacagttttgtctaattatactctttactatatactgcttcaaaggtgtgacatgctcatactctttcctcttttcaccattcccttcttctctccctgattaaaacctactcaacattcattcaatgaaaacttaataagctacagttaggtacaaggcactattactttaaaaatatacttaaaaaatgtacaagatcttttgtaaaaaagctaacagaatttgactactatagttggactataggattaggaataatgttcattttttcttctcttttgacccacctatatttctaaatttcttacagtaaactatattgactatttttttaaagatagagtagaagattctcttccctagcagaacccatattttgttggaggtgacaatgtgtccaggtaaaaaactcacttcatcaagctcacttgcagtaactgttggccatgtggttttattctagctaatgaaacaaaagctgaagttttctgggaaagcttttcatttttctaatgaagacaccacatcttcctgctatcctagttcttcttcctgctaggaatgcaggcataatgcctataaatgtagcaggcaacttgcagccataatgatgaaagaaaaagttggattaaaagtttgagcctgggttgatgatactatcatggagcaaccacaccaactatagattacctacctcaatatttattttatttttattttttaagtttattgtggtatggtacaatttacataaaattcaccctttataagtgtacaatgatgtgatttttgacaaatatatacaaacagatatacattaccaccagcataattaagatgtagaatgtttccatcacccccaaaaagttttctcatgactttcatactcaatcctctccccaagctcccggcctctaacaaatgctaacctattttctgcctctatagatttgtcatttcctgaaaattacataaattgaatcatatagtatatacccttttgtatgtggtttaacttagcgtaatgctttcttgattcatccatgttgttgcacatatcattagtctgttcatatttatttcttagaagtatctcattgttttagatataccacaatatgaccattcattcaccagctgatgtgcatttggattattatcatatttgtctatttagaataaaccagacgtgaacattcatgaggtctttctgtggacatatgtttgcatctctcttgggtgaaacacataatcacatctctttatggattatctattccattccatttatctatatgtccatctttgtacaccatactgtcttcagtacagtaaatttacagtaagacttttttaatatttaaattttaggttcagtgggtacatgtgcaggtttgttacatgagtaaattgcatgtcactgaggcttagtgaatgaatgactccatcaccaaggtagtgaacatagtacgtgataggtagccttccaacccatgcctctcgccccaccatccctcctcaagcagtccccaatatctattgttcccatctttgtttccatgtgtattcactgtttagcccccacttgtaagtgggactatgaagtattggttttccgttcctgcttaatttgcttaggataatggactccagctgcatccatgtcgctgaaatgaacatgatttccttcttttctttggctgcatagtattctatggtgtatatgtaccacattttctttattctgtccagcatggatgggcatctagattgatcctatgtctttgctattgtgaatagcactgtggtgaagatatgagtgcaagtgtctttttggtagaaaaatttattttcctttgggtatgtattagcgttctccagagagacagaaccaacaggatagatgtctatatataaaggagtttattagagaatttgctcatactactacaaggcaaattcctacaataggcattctgtacgctggggaaagagagaagccaaaagtggctcagtctaagtccaaaaatctcaaaaccagggaagccaatagtgcagcaaaaggcccaaaagtttctggaaagccactttgctggaagtcccagagtccaaagtctgaagaacctggagtccaatgtgcaagggcataaggagtggaagcaagcatctggtatggggaaaaaaagagagccagaagactcagcaagcaagctatccccctttcttccacctgctttgttttagctgtgctggcagccaattgcatggtgccacattgagggtgggtcttcactcccagtccaccagctcgaatgtcaatctcctccggcaacaccctcacaaacacacccagaaacaacactttaccagttatataggaatccctcaattcaatcaaattgacacctaatattaaccatcacatatacccaatagtgagattgctgggtcaaatggtagttctgttttaagcccttttggcaatctccagactgctgtccgcagtggctgaattattcacatctccaccaggagtgtataaacaacctcaccagcatctgatgttttctgacttttaagtaatagttattctgactggtgtgagatggtatctcattatggttttgatttgcatttctctaatgattaatgataatgagcatttttcatatatttgttggccacgtgtatgtcttcttttgagaagtgtttgattatgttctttgcccatttttattggggttgtgttttgcttgtgaatttgtttaaattctttagattctgaatattagacctttgttggatacatagtttgcaaatattttctcccattctataggttgtctctttactctgttgatagtttcttttgctgtgcagaagctctttaattatatctcacttgtcaatttttatttttgttgtaattgcttttgaggacttaaccataattcagatgtggatgggtgtagctcctaacacacatggtaaactgaggtagctgacagatgtttgagttgtgcacacatgtgcattttgtgcattcctacactgctcactacaggtggagttttctgtgttcccctagtgtttttcttgaacaaaataatgcatacgtgaaatgtgcattatggtcaaattgttccctaatatatcaattgtgttgaaacaaattcaaattttcaaagcaagagttataacataactgactgcatgttagacgttaaaatagacatgtctaataggcagttggatttataagtctagagtttatggcagaggtaccaactaaatataatttagaagtcatcaacatatatacgctattgaaagtcatgcaactggttgagactacctagggagtgcatataaatatagaagacatcaagttctaggacattccaacgtttagaagtcaggaagatgaggaggaatcaggaaaggattctgagaaggaatagtcgaaatggttggaggagaatcagggaagtgggctttcctagaagccaagtgtagaaagtttttcaaggaagagggaggaaccaactgtatcgaataaagcagataggtcaagtataaaaaaggactaggaaacattcttgtaatctggttacctggaggggactggtaactttgacaagaatagttgagtagagtggtgagaaagaaggcctgatgggaaatagttgaagaggaattgggaaaaaaaaggactgaagacagctagtacggggaattatttttcgagggaaagaaaaatacagcaaagctggtatgatacatcagaatttttctttaagattgaagaaattacagcttgtttatatgctgatcagaacagaggtcctgggtgtagatgcaggtaggtggaaaagatgttgatagtatgtggagattccctttgattgcctctgttttctcagtgaagcagaaagcaagatcattttcagctgagagtgaggcaggaaaggaggtgttggcattccaggagaaaagaatcaaaccattgttcaggagagtttgaaaggactagggtaacagaataacatatttattttttaaagttcctagatagaaccactggatcaaaggatgcatataattttcattttgttagatactgtcaaattgccctctgacagtacattagttcacatccccacatgtgacaatgcctgctttctcaagcctctgccaacacagtatgctatcaagcatttacgcccttttcaatctgagggttgaaaatgatatctcagtgcagttttagtttgaaatgttcttatttatgtgaaattgagcattttttcttatgaatagtgacaaaggaccacagataaaactagatccttccagggagctgtgacttggtaatttaggcaaacaatttcttttcattttctgtctccatccactcaaccagtatttactgagtgtctactatggattatacgctgttctattgaccaagggatacagcagtgaacaaaaaaaaatcaatatcagaagctaagctgggagccatatcccagaatcacagaaactcgagggaagaagaggtcacaggtaaccgccatgatcaagacaagaacccagggcagaaatcaagctttctgttaggtgctatggagaggaacactaagatttttgagcaggcaaatgatataaaatcgagctgagctttaggatgacaaatcaacccatttgtttgtggattaaggattaaggaaaagcagcagctggttcatgggaagtacttagtaaatgtgaaaggggaaaaaaaaggactttccatgagggaaaggtggctacagatacaatagaagtcctcttcttcacagaactctgaatcagttggtcttgtaggtactcagagaaaaattgaatatagaggaattaactactaaaagctgtgctcagccactctcccaggtcccctggactccctgtgattttccaggcattgtagcaatgggtgattctagagcggaactggaggcacaatgcctatttaaagatatattttcagccttaaagaattcctcctggcaatgctctcagctgcagcccttgggaattgatgcaaatttccactcaggtatcaaattacatatgctgaacgatgtaattcaaacttatctgaaccaagttcctcagtgctaagctgacatgcaaaccaaaaaagccatgctatttgagtagtttccttgatttctccttccactggcagtacccacatgtctacaattccagtcaatcttgtaaactggaaaacttcccaatcaaaataggaagcattcatcaaatataatcataaactcctgtcctggaactccttgtggtgtccctggaagctgaagatgtcgtttgggaaagcacttagccaggcagcaatattgctcaacctttcccctctcctggcaccctggaattctcttgcaaaaagttgccaagtcataaatcactagagctgtgttgaagtttgaaaatttttagtttccctaaacctccttccagtcctcacaaagtccaactacatggctgttttaggcgcctacactgagattcctgctcatttcgacacaaatcttgataaccccaacatcaatccctccctagtgtgaagtaatctgagcaattctctgttcttgtaaaacaagaacctgatttcccatgtattggttatttagcaatgaactcattacttcatcactgaggatacatagcaaccttagcaacctttggatggttgtgaagaaaaagtgaattatcatgtactacatgtcttctaagtgtcaggcactgtgttgggtgtttataaaagttatctcattttggtcaggatcatgactgtaatgtaagatactctgtaaacattaaacactctagaatataagaaattattattgtggggtattaatgctgcaatccttcctttacaatgagaaaattcacagaaagcattcccatagtgtctcatacttttctcaagatccgtagtcctaacaaaaggcaaatggtgatatcacatatgtctgcattcgctcattggactgttagcaatcagagggcaaagactaggtgttatttttcctttgtccacagccaagcaaaataagcagtgcctaggtcaaaacaggtgcctagaaaatgtgtgttaagtaatttgaaggcaattcagggtgaggaggtcagacactaattgacaatgctgatgaatgtgatgactgattgataaagatgacagaagtgccatgcttagaaacaattcttatccttaccatggcctggaaccctctagtatccttcttctgctaacttctgctaactcactatgatccaaacacagcagccttcttgctatatttcagacataccaagcaacccctaccgcaggacctttgcctttgctgctcttcatggcttactcttacttcattcaggtctctgttcaaatgacacatcttcagagaaaactgttctgactgtaatttctaaaacagaatgcctgaaatcttgctagttctttaccctgctctatttttattaatcacacttaccaatacctaacatcatgaatccaatagtttgcttgttccactaatgtataagcttcaattaagagagagatgttttcttactcaccatggcaactccagcaccggaataacgcctggcatgcagcaggtactcaaaactttgttcaaagaacaaacaaattgatgaataatttaggtctgagagttaattgccaggtcaagacccctgtggcttaaagattcctgatgcttttttacatcatacttaaagtaaaagtgtagagcacgacatattgctaataacaaacaggttgctcagccttctaatctctagatccttctggagctatgtaatttggaaagtaaaattgaattccacatcggtttatccaaaaataatccttgaatgattaaaaatatgaattcaaaatccagattggcagcaaaagttaagacaatcaacactaaaagaataaactaattcggatagtcctaatttgccttcagaacagaacaaaaatgaaaacatcttaatcaaatacaataattttccttctctaactgacccagcatgcgcagaaaatctgccaacacaaattccagttgtgttcagtaggatgagaatgacatgccagaaaatctgacaagtcaagaggggtaacagaaatggagcctttgcccaagagagaaggggaagtgtgtgcgtaggggtggttcattcaaaatatggaacatgactttgtgattaaaaatgtatatgatgctcagaaaccccttttgatttttaaaatcaaaagcctgtaatattcttgcaataactttaagatatcatagattttacagatagccatgagattactagcttaaatctagatatttctttagagcagtgaaggggagcttgaccaagtctttgtgtgagctgttacccttggccttaaggagaccaccacttaacttcaagaaacataaaatttaaccaatctaataaataggtgtcagatgtaacagctgggaatcttcttctagtagaagacagatgttagtagaagacactggaacattgacttccacattggtgtcccaataaatgcacccacttcagttcctccttactcttcaatcccatggactttgctttatcagcatttcatttcagccacctaccacccaaacccaattttatgatagagcaagaacacctgaactatactgactgtaaccaccaacaagagagaacaaccctcctgttattgaatgttcataattttttagtaaggatgtcacggattctgttcagacaaagaattgctatactgtgggcctataaccagagaggtttttaagctacttttattgtatgtcattttgggtatccaagaaacagcttttaacaaaaagttaggaacacaagaaattcattggggagtaatgcctgtgaaagctgaaaagggaataaagcagatgagcagaaagggccttcagattgccttacagatatgatacctgtgaaaggaaaggaggaggaaatcaagatttagcaggaagagcttcacatcaaactgcatatctgagaaagtcttggaaaacccagtgagaagctctggagcaaagattgtccattagaggcatcccctaaaggacaggcactagcaaccacatcatgcccaatcattggctaaataccactcagtaagtgtggccttcccccacactctgaggcagatcctgaaggtgctgcacctggaggatgccaactcactgcatcccctgcatatgaacagcaggttctttcttgaagggtgatctgaggagtgaactttcatgactgccacatctggggatcagatctcacctggaagttacagacattcattgtttcaattggctgtgaatgaggcaggtctcacaaattagaaaccagagctcaatacgagaatcctaagtaggtggcaatgttagagcctggacttttgcacgcgttgaaaaagaaaatacattgaccagtctttgaaagatagaaaataagatgactcttaccacatgaagattaattagtggggtagaggccaggccaaggaactgaagacatgcttgctgtttaaggattgatgttagttaacaacatacgtaatttagaaaattgggtttgagaaccttatgccattgggatttttttaactgcaattttcattgagattattgtagatccctttgcagctgcaaaaaataatgcagagaattccgtgtacactttatcaagtttcccccgatggtaacattttgcaaaagcataatatcacaaccaagatattgatattgatataatccactgatcttattcagagttccctagttttacctgtactcatttctctgtttgtgtgtgtgtgtatgtgcacgtgtgtgtgtgtgacaccaccatcacagtcaagatactgaacatctccatcaccacaagatccctcatattgcagcctcactcactttgctcccacatttttatccctatctgtagcccctggcaattaccaatcttttctccatttctcaaaatttctcccttcaaaaacattagatacataattaaatcatccattatgtaaccacttgagattggctttttcactctgcataatgcccttgagattcatccaagttgttgcatgtatcaatagtgtattcctttttgtcactggtatgatatggatgtgctacagattgtttaaccatttacccattgaaggacatcttggtgtttttccccaattttgggctacaaacattgtcgtatagatttctgtgtgaatgtaagttttcattgctctgggataactgcccagaagtgctgagttattgctgagttacgttgtagttgcatgttttgtttcttaagaaattactaaaatgttttccagtgcagctataccattttacattctaccaataatgtagaagtgacccaatttctctgcatcctcaccagcatttggtattgttattatgttttattttagccattctgataaatgtgtagcaatgtctcactgtggctttcatttgtgtttccctaaggctaacaatgttggacatctttgcatgtggtcatttgtattttcacaatgtattggcttctctttatttagccaagttagttttgaagagaacaatacaattcaactaaacaaaggagagtcaaggcaaggagagtgtatgatcaggtgagactagagttttaaagggggacatttgtccattccaagattttgtccaaattattttttcagcttcaactcacgttttgcatccaatacaactcatgttccaaaaaaaaatgtccagtgctccctatatataccccatactttctggcatctgtgttttctcacattattttctctatttgtttctccatctccaaagtcgaattccaagaatcaccaagttccagaggctaccctctcaatggaactttccttgatgccagcagctggaattcatctccctcatgtgaacattcctcacaactttctagaaaggtctccattgttgctttgtattgccattatgtgtcatgtatcctgactttccaattcggctgtgaatccaggagctagctggtggtgactaggccaggtcttttatctcctagtctaatcatcttgccttgatcaagctctgcccactaaagtgcaattgttaaagatcaaatacagggtgtcctttcggtaggaaacaatcctctacctcgttatccaaagaagtcactcagggtcacacagcatttaaaatactatcagtgtgtgccattttttacattcaataatttttcttcacatcaaaatttgaataatatttttattgtcaaaaaatcaccagataaatgggtaaattagtctctccctcaaaaaaagagaaccagggatgtatacaataagcacaagaaatggattaaataattatcaaaaaacaaacagggaaaaatagaaatcagatgggacaatggatattttgtgatgctagaaagattacagagaatactgatagggagaaggctatacaacctcagaattttcacactgtacatctttaaaacctggtctcattggattttttagcttttattttgtgagaataaatttctccacaacatttatcaaaaataaaaagctatgattaggtataactttggaggtaaaaataatatgaaaaacttagtgaaatataaagagaataaaatcaccaatctgtacacttaatgtatgaattttattgtatgtaaatgaagctttaatacaacttacaaaccaaaaagtaaatgagatggaggttactatagtacacagactagtctgagaagacttcatcaaaagagaacattttttctgatcatatttaatctctaatccttttatttcagttccagagattagggtgtgaacatttactccacccttttgccttactctctaccttctcttccaaccaaaaagcatggtgggagagaagccctcttattcccaaattgtggaaagcaagctggaggtaaactccttcattgtctaataagtttccctcaccatcccctgcaagagaaaaagagtaacttttattgcctgccagagttctgtgattcattcttatttataattaacaacctgcatgtttccaaaaggtatcccacattaaaaaaaacaccaaataagaaacaatatactgtcggtgggattgtatagtaccatacctttcgaagggtactttgaaattcttttgtctcagaaattacatggctagtcatctatcttcacaaatttattcacttaacaattattgaacactcactatgtgctagacactgagctaaacactgaagagacagtggtaaataactcagtattaaggcctcatggggttgttatgtcacagtaggcagtgatactataaaaacagcatcaggtagtcatcagtgctctgaaggaaactacagaacagttgtgttcacttcattgcttcgttcataattattcataacataaatatgcatgacatgcattattgttcatacatttcatatgtatcaaagaatgcataacaaaataaaagagaaaacagggtgaggggacaagagtgatgggagtaaaaggaaaatgccactatttcttgggtaaacagccagggaacttttctctgataagataacatgtcagaaaggcatgaagcatgtcagaaggtgagccgcatagagctctggggcaacagccttcccaatggaggcaatggaaaatgcaaaggttctgaggcagaaaggggcttggcatgttcaagggatcatgaaaaagtcagtgtggctggaatggagtgagcaatgggaaacatgatcgtcatggaggtggcaggtagccattttctgaaggccactgtagaccatggtaaggaagttagactctacctaacaaagatgggaagacattgaaatgtaccgaataggaattccgagccaagatggccgaataggaacagttctggtctacagctcccagcgtgagcaacgcagaagacggttgatttctgcatttccatctgaggtaccaggttcatctcactagggagtgccagacagtgggcgcaggtcagtgggtgcgcgcactgtgcgcgagctgaagcggggcgaggcattgcctcacttgggaagcgcaaggggtcagggagttccctttctgagtcaaagaaaggggtgacggacggcacctggaaaatcgggtcactcccacctgaatactgcgcttttccgacaggcttaaaaaacggcacaccacgagattatatcccgcacctggctcggagggtcctacgcccacggagcgtcgctcattgctagcacagcagtctgagatcaaactgcaaggcggcagcgaggctgggggaggggcgcccgccattgcccaggcttgattaggtaaacaaagcagctgggaagctcgaactgggtggagcccaccacagctcaaggaggcctgcctgcctctgtaggctccatctctgggggcagggcacagacaaacaaaaagacagcagtaacctctgcagacttaaatgtccctgtctgacagctttgaagagagcagtggttctcccagcacgcagcttgagatctgagaacgggcagactgcctcctaaagtgggtccctgacccctgacccccgagcagcctaactgggaggcaccccccagcaggggcacactgacacctcacacggcagggtattccaacagacctgcagctgagggtcctctctgttagaaggaaaactaacaaacagaaacgacatccacaccaaaaacccatctgtacatcatcatcatcaaagaccaaaagtagataaaaccacaaagatggagaaaaaacagaacagaaaaactggaaactctaaaacgcagagcgcctctcctcctccaaaggaacgaagttcctcaccagcaacagaacaaagctggatggagaatgactttgacgagctgagagaagaaggcttcagacgatcaaattactctgagctacgagaggacattcaaaccaaaggcaaagaagttgaaaactttgaaaaaaatttagaagaatatatcactagaataaccaatacagagaagtgcttaaaggagctgatggagctgaaaaccaaggctcgagaactacgtgaagaatgcagaagcttcagtagctgattcgatcaactggaagaaagggtatcagcaatggaagatgaaatgaatgaaatgaagtgagaagggaagtttagagaaaaaagaataaaaagaaatgagcaaagcctccaaaaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagagattttctcaccaccaggcctgccttacaagagctcctgaaggaagcactaaacatggaaaggaacaaccgctaccagccgctgcaaaatcatgccaaaatgtaaagaccatcgagactaggaagaaaccgcatcaactaacgagcaaaatcaccagctaacatcataatggcaggatcaaattcacacataacaatattaactttaaatgtaaatggactaaacgctccaattaaaagacatagactggcaaattggataaagagtcaagacccatcagtgtgctgtattcaggaaacccatctcatgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcttaaatatatatgcacctaatacaggagcactcagattcataaagcaagtccttagagacctacaaagagacttagactcccacacaataataatgggagattttcacaccccactgtcaacattagacagatcaacaagacagaaggttaacaaggatatccaggaattgaactcagctctgcaccaagaggacctaatagacatctacagaactctccaccccaaatcaacagaatatacatttttttcagcaccacaccacacctattccaaaattgaccacatagttggaagtaaagctctcctcagcaaatgtaaaagaacagaaatgataacaaactgtctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaaaatcagagcagaactgaaggaaatagagacacaaaaaacccttcaaaacattaatgaatccaggagctggttttttgaaaggatcaacaaaattgatagaccactagcaagactaataaagaaaaaaagagagaagaatcaaatagatgcaataaaaaatgataaaggggatatcaccaccgatcccacagaaatacaaactaccatcagagaatactacaaacacctctatgcaaataaactagaaaatctagaagaaatggataaattcctcaacacatacactctcccaacactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaaccattccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaacgaatccagcagcacatcaaaaatcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacagcccttcatgctaaaaactctcaataaattaggtattgatgggacgtatttcaaaataataagagctatccatgacaaacccacagccaatatcatactgaatgggcaaaaactggaagcattccctttgaacactggcacaagacagagatgccctctttcaccactcctattcaacatagtgttggaagttctggccagggcaatcaggcaggagaaggaaataaagggtattcaattaggaaaataggaagtcaaattgtccctgtttgcagacgacatgattgtatatctagaaaaccccatcgtctcagcccaaaatctccttaagctgataagcaacttcagcaaagtctcaggatacaaaatcaatatacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaaccacaaaccactgctcaacgaaataaaagaggatacaaacaaatggaagaacattccatgctcatgggtaggaagaatcaatatcgtgaaaatggccatactgcccaaggtaatttacagatcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaagaacgccgcatatctacaactatctgatctttgacaaacgtgagaaaaacaagcaatggggaaaggattccctgtttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggctttaccattcaggacataggcatgggcaaggacttcatatctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaaccggtgctggagaggctgtggagaaataggaacacttttacactgttggtgggactgtaaactagttcaaccattgtggaaggcagtgtggcgattcctccgggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggatgaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctgggtactgttgtggggtggggggaggggggagggatagcatcgggagatatacctaatgctagatgacgagttagtgggtgcagcgcaccagcatggcacatgtatacatatgtaactaacctgcacaatgtgcacatgtaccctaaaacttaaagtataataaaaaaaaaagaaaggtaccaagtaggcttatgctttaaaatgatcatgcactggctgctgtttggaaaacagacgataggaagacaaaggtatagaaatgcacagacataggtacaatgatggtcactgtctctgtatttaaagagatgaaaaataaaaacagctgaaatatccaccaatgagagtaggttaaagaaatgatgtaacatgcaaccatctcctggaccactgggcagcccttcaaaggaatgaggcagaactatgtgtaatatttggaaagatgcctattacatgctgttaagtgaacaaaaagccagttgtaaaacaaaatggtaagatccctcttttactaaaaagaagaaaacatgtagagcaccacacacacacacccttttttgtggaagcatagaaaatattaagcgagtaatttatggtagacagaataatggaacccccaaatatattcacaccctaatcccagaaactgtgaatacgtgaccttattcaccgtaaatatgtgaccttattcaaagtaaaaaggactttgcagatatgattaagggtgtgaaccttatgatagggagagcatgctggttcacttaggtggatccaatcaaagcacatgagtccttaagagagataaacttccctcgctgaatcagaaagatggcagcatcagaaagatttgatgcattgttccttgttctgagatgtaggaggctgtgtgaaagaaccacagggaggccttcaataattaagggcagcccctgcaagacagccagcaatgaaagggggacctcagttctgcaacagcaaggcactaagttctgccaacatctgaatgagcttggaatccaattcttccctaaatcctccagaaaagaacacagccctgcccataatttgactttagccctgtaagacccatagctgacttatgatctctagaactgcaatctgtattgttttaagccactaagtttgtggtgatttgttaaagcagcaatagaaaaccaataatacgtaacctcagccagcaggatctcacagcaaaagaggatcccaagaaaaaattagagaaattagattggttagatcttattcctggcccaaaccccagagtctctgattcagcaggtctggggtggggcttcagagtttgcgtttctaacaagttcctaggggatggaggtgctgctggtccaggactacagtttgagtactgttgatcaagagaatagggtctagaaccatacctactggaaccaaattttggttccactgcatactcacttttgaccttaagcaaattatctttgccctagttttttcaaccattaaggggatggtaatactagtttctacctcatgagcttattctgagactaaattagttaatatatgtaaaatatttagaaagctgccagcacatatttagaactaggtatattttaaccattattactttactgtgtacttatttgacctgtaatctgtttttttacaatcaaatagaatctctctttgaaagtcattcatatccttttccaagtgccttccctttttctcactttctctgacatcctattaacctttacaccaaaaccttcatagatagacctctttcttcagcaaacctggccctcactggggaaataaaagcctccagctacaaaacaacaactgccctttctcctttcctgcaccttctccttcactctttttcccatcagttgaaggggaaatgcttcaggaaaagggaactgctacaacagcaaatctttcttgctcagccttccctttcaatactttaataattgagctggtctgctctactctgagtgagctctagaattattgttctcctgagaatttgacgaggcaatactgaaataacaaatgtaatttacttcaactttcgctaaacaaaacaaaatggtttatgcatcatcacgtcgcgtctttttgataagccacctctactcatgatcaaaaatatgcggctgataaataaattcaatcagcagacaaggctcttgtagctctttaaattgtcaatctctattgacaatagcagcaatttcagctaaacactgaggaggccagcaggccactaactcccagcctccgctcccacttgcaaacagagccccactgtggctctgcaagcccttcgcccacactctcacctacccggccaccaataggcagcttctcagcctaattgtacctttatctgctacaactttgaactcagcgaaatttataccaggtgttgcaaattttttactggtaatgagttaatttacacagatggctgtcacttctccatttctccagctcctttgctgataaggcaggaaacagcttgactgtgcagagcccgtggagcccagaaaagtcggggatggggagtggtccctgaccaaatggacacgccctggctccagagctctgccctggcccccagagcaagccaagccttacccaccgaccctgccaactctagcccaggacttttagttccctgctaaaagagctcttacacaactgaaacgagaccaaccaacccactagttgggagggcagggggtggcaagagagatgtgattataagtaccttttaaatcccaggaaattcatcttttcaattgcttttgttggtttttcaacccggaaggcctcaaatgcgtgctaaagcatcttgtgaaagtgctaacgggggatgcagcgcctcagagttagatactgccaaataaggcaccctcctcactgtgtgaagccctctgggttagtggctctgcaggcaaggcggcagcaagcgcccagggctgggctgggactgtctcccagcctgcctatataatggaaaactgtatcaataataataggtaacattatatacaatgttatatgtaatcataatggcaccaaatataattcacggttaacatttcgcattcaatgccttcacctggtggatttcgaatctgaccaagaattccaatcacctacagagcgtttccaactcttgaagcccaggttacactccatactactcaaatcggatctctaaaggcaggagccagtgggcagtgtttgttaaagatgattccaggtgattccaatgtacagcaaagtttaggaactgctacctgaacccaaaggagagacatcagcaaccctggacaggcaagcaggagctaattttttgagttgagccaactctccacataaagtgccatcccctagcctctagcctgttccatccctgctggtaccgtgtttgttttcttttaattttttgagggcaggggatgccaaggtcccccaggcatataatgtctttcatgaataatgtcttaatgtctttaagaaactatgctctacaagccatactactagcagcctgggtcactgccagcctcccattacccatgctggacccaatcaatcttagccacaccctgtccctcatctttcccctccccttgcagtccatgaccatcctgttcccaccacaacaaagcattccctgaatcccggctccaactgtccacctcctagccatcaatgcaggcacaacccgagtgccattccctccatgaaatctatgttgatcttctctccaagttgtctctacaaatctgagggtcaggtctatagatttaatgaaaagagcatcacacatagatcagtagacctggatgtgagatttcaccactgtaaccgaaatgctagttgttgagtcaattttattttccccttcttccttaaaactatccttggactgcctaacactgtgctgattttactgggaaaaaacccaaacctctaccttgatccaccaggtgatgttattaacagccaaacctaacttgaactggaacaagtagatgctggttgtgagatcctggacaggccattgttcttctgaaccttagtttcttcaactataaaataggaagaaaatgagctgtgaggattatttaaaatcacctaacagttagttgaacttgtctgtatcttaattaattgaataaaaacttctcacttcgtagacaatggaactgagcacttaaaggggaagtgctttgctcaaggacacaaagaaaattagtagcaggtgcaggaattaaaaccagagcccctttgatttggaactcaacttaaatcaacagaactcaggcttaactacttgaaaatcattgcaagcagtaatgagaaaatattgatttaaaaatcatgttagtagatgatcaaaaacagaagctatttagtccattaggaattgcttttaagctgggagggtgtgggaaagatcttatagaaagataaccaacagtcaattatgcccacactaggtatggaatagtttattctccactcatgtgaaatgctatctttacaaacacccacccacacacacacacacacacaatctcacggatctatttgtctattcctgtgccaataagtcattgtgctgattaatggcaagacgagcccctcctaccatgttcctttaaaaagttttattcgcttttgttgctttctctttctaatgaattctagaatcagcttctcaaattctataaaacatctcactgtgatattaattgggttgcattacatttataatttctggagaactgacatctttactataataatagtgcttattgtgtaccaggtatgattctattttccctgccaggtgccaagtaaattatctaagcatttggggtatattttcaaaaatatagacatgtatttatattttattttatttcttatgtcaaaaaattaaaacagagattcttgccctcaagaagcttatattttggcagaggtagtcagtcaataaataagaaatacggcctggtgcggtggctcacgtctgtaatcccagcactttgggaggccaaagcgggaggatcacttgagtccaggagtttgaggccagcctgggcaacatagggagatcccatctctacaaaaagtttaaaaattagctggacgtggtggcatatgcctgtggtcccagctacttgggaggctgaggtgggaagatcgcttgagcccaggagatcaaggttgcaatgagtgatgatcacaccactgcactccagcctgggtaatagcaagaccctgcctcaaaacaaacaaacaaaaataagtaaatgatatcatatgctagagggtagttagtgctatagaaaataaaatgaggagggaaagtaggatacagggaatcaggagagcagggtgcaggtcacacagccttatataggttaatcatggtagaataactcattgattcctcagtgaaccttaactctatggctactgacactttacagggaaataaaattgaggcacaaagaggtttaagtaataggccaaagtcacactgctaggaagtgacagagccaggatttgaagttgagcaggctgggctccagattcctggagccagagtcaatattcctaaccctacactgcatgccatccaggttccaggtatgtttctcaatttccatccatctttatatccatcagcaaaatataacatttttcatttagtatggcacatttcttgttcagtttatttttatgtatttatactatttcttgccattgcaatgtgaaatattttcaccatgacattttctaatcagcttttgctactgtatggaaaagctattgatttttatgtggtaatcagctatctctgagtgcttataagttccagtagtcttccggttggttttcttggattttataattagaaacacataaaataacagtttgcctcttcctttccattatgtttttatatttcatttttgctcctgcagttctaagtattttcaaattttcactgtgattccagttttgacccattggttatttttaagtgtgttaattttcaaatatgtggtaattttctagttatcttttgttattgatttctagcttatttctactatggtcagacattctaatctatgcgatttcagccctttgaaatttgttgagccttgctttatggtccaataatggttgattttggtaaatattccatgtgcaattgaaaaaaaattccgccattgttaaatgctgtgttctataaatgtcaatgaagtcaaatgtgttaaccatgttcacatgttctatatacttactgatttttttaatctgcttattcctttaatggttaatctagagattgtaacatgcattgttgtttttcaaattagcacaagtgtatgcagggaccttaaaacattccaattccatttactccctcctgccacttgtggtatttgttgtttttataaaatgttttttttaattgttatttttgtgtaaacagaagcaatatttattcagatttttccatatagtaataattaccttttctattgctctttattctttcttgcatctacttgggataatttttctgctgcctgaaaagcagtatttaggtatttcttttagtgcaggtgtcctggtgatgaattcccttaattactttttatttgaaaatgtctgtgtcttcccttcatttgttaaagataacttaatgaataaagaattccaggtcggtggttattttctttcactattttaaagatgtcattttatttgcttctggcttctactgtttctttgacaggtcaatatcaatctcacagtttctcctttgaaaaggatatgtcctttttcttctggctggttttaagattttctgtttgtctttggtttttcagcagtttgactataatgtatacaagagaaaccatgcttgaattttataggactttcataatctttgtttcaatatgtttcatcaattttagaaaattctcagtcattatctacttaaacatcacttctctcttcttctaggattccagtctcacatatgttagactctgtcacactatgtcatattatcttacgttcatttctgtatttttattcttttgtcccttttgtgcttcagtctaaaattttttcttcaaaattatatttctattcactaattttcttttcagttttatttaatttgttcttaaatctatccattgagctcttaatttattgctttccatgagtctgtcaaaagctcagctcagctgcttggcctctcatccactacttttcagaatcaataatttcttagtagggtaaagcagcataaaataccagactcccctccctgggcttctgtctgggaccttggccctgaaaatcctccctgccttgttagttccctgatgactccaaagaagtgctttgaaatattattattgagcttcattcactgtcttcagcaggaggattggtataaagcaacctattccaccactgctaaaggtgggatttcttcattattttgggaaacagcatagtacttacaaggctttgaactgtgtctggcatgacagaatgtactcaataagtttatgttattattgtacacaaatgaacccatagttccttttctgtgtgttatcttgattgtttttagtatcattattttgccggctttgtataatgggttagttgacattccatatttctctatcttctaaaactgttcatataatatagagattatctgtttcttgaagatttgatataactcacccataaaattacttgagcctactattgtttttaggggcaaacttttggttacctttttaatttcttctataattattaattatctctgtataggaattattctaaaactatatcagaaattcagacattattcttattcatattttccatctcttaaaaaatttacaaaattaccagtagaggttaaatacaatattttaacaaagtttcttctgggtctgtggttatacctcatttatcatttctaatgtaatttgtgttttttctggctttttaagtcacatttgactaattttatttaatttttaggaaaaaaaagcttttggttttatggatcaagtctactgttttgttgttattgttgtgagaaggtacatgtctcactttggggctgaggttgtgttagcccatatgcatcactataaaggaatacctgagggtgggtaatttgtaaaggaaagagatttattttggctcacagttctgcaggctgtacaggaagcatggtaccagcatctgcttctgatgagggcctcaggaagcttccagtcatggtggaaggtgaagggggagccagcgtatcacatggtaagagagaaagcaagggacggggaggtgccacactctttcaaacaaccatccctctcatgaactcagagaaaaaactcactcattacagagaggagagcaccaaaccattcatgagggatccacccccatgacccaacaccaggccccacttccaacattggagattatatttcagcatgagatttcgaggggacaaaacatccaaaccatatcagataatttaaagctctctcttgccctgtcttggcaacatataagtttacatgtttcaggtggattaagatagattagagaaatccagcttccatcagattttgtgtaagagagaagtgtaagagagagaatttgagcagccactgagatttcagggtttatttgtaattgcagcacaatctagccaattctgattaatgcaggaattaaaatttttggtaccttaaaatatggtcaatttttaaaatttcccatggatattttaggtggatttgtattctttgtttgtacttgtgtgattcttttagttgtcttgagtttgtttaaattttaaaatatctttccagcatattaagaaatttaggataggaaaggacacgcacctagcctccattgtgatttcaactctaccttttgtctagttatattctcaaagagtttgcattttgtagctggaaatgggtaattttaaagaaaatatttattaaaagtcatgtaggctttgtaattttagtaataactaagaaagcataagctttataaccataagctctttatttaaaagtcagaagttggtggattataaacatgaaattccttcctccatcccctcatcactgccttcaactatgtccttgtctcctaatgacatctcaggtagagctcatagcattcaggacgctggcaacaagaaaacaacccactgcaggctaattcaataaattgcaaattttaatttcaaagcatttcttctcaatcaagtgccggccaggcttctctcagtacaacttgcaatggaaaagtggcttgccctcttgacaactacccgcttcctactctggttgtccatttctactagagtgtgcaatggtttcttagaaagtccgtgaagtatgtggccctatttagcccatggagttattcagaagctatcactggcagaattg

SEQ ID NO: 918 - DNA, 44216 bp, Homo sapiens
ttatacttgctttacttttattttttcagatttcctttacttacattccttattccctcaccaacagtaatcctcatttttatagaaggtaagagagaagaagtacgcagaggttacagacttgggtccaaagaaaattacagagtccaaactgaggccaagcctgccaatactctcagcagcagttttctcctctaacactcttcctctatctgccatgatgcccaggcatacaaagggagtttttcattgtttccttaaggttaactgctctggatgctctcagttcaaataagatggttttaaaattcccctcctccttgccttacagcaaagaagaggaaaggagaaattcaaatgaaaataaatcatatacacaaatatcaaggttcaaaagctggaggatttaattcaatcaatttagcaaggcccaaaatgaaacctggtaatgaaaatgaagacacagcaatattttcctcaagaaaatagacatttgggagaagaaatgttttcttaaaaaatgtttatttggaaaagtcagcctcttacacaaggttttgtatctatacttttactctgtcaattacagtggtattttaaatgcattgaatataattcattgaatgtctgtatctttctgcctcgatttaagtgatattaggttaaaaaaatatttacagttttcattctggtccaccttccctccttatccttatactgaatccatttctctacttttcaggtaagtgaaaggggtcacaaaatttttaggtttgtgtggagggtaaaaatgcatccagcaattctaagcacaacaattttctgtaaggccttctctgaaaaaagagaaggaattacttattaaaactaagcacacttagcaacttctttcccaatcctatctttattcgtttgcctggtgccaaatttttctggccctttttaatttgcaaaccttaaaaaaaaaaaaacaaaaaaacaaaaacaccaaacacacacatatctcacacatagcactaagctagaagcagatataaatgggaccactgtgaatcaaaggggaaaaattccaggaaaaaaaaattccaatagcttcacagtttaactgaggttttggaaaaacttaagtgaattcagctgatgtttgaaatatctgtctacatttaattagatgtgttgtatttaccaaggaggcacaaatatgtagttctgtagattttaatactaacttttccagtaagaaaaataataccaggtgatttcaaaaagggcagtgatctataaacactcaaaatgcatctttgaacaggggagcagaaatagctaatttaatgaaaacaaaccttaagcactttacttggcttctaataagcatcccaagaaaaggtacctgagaggggttgacaagtacactgtgtctagaacagccaagatgttgccaaagttttatgctttgaatttcctaaatatatagctagcagaaacatatgccagaaatctactgatgctaggaaaatatttttgtcagcattttgtaaaatctctaactttcaaccaatatttctgttcataaatcttccagtgaaaatgtctgaaatatattacatgtaacaatgaagcaagattaattttaaattttagatttgcctcaaacaagttagttgttatttttccttttaacacaacactcgaaatagatgaattcagcaaaaatggtttaagaagttaaggctctctagagttctaaagactaaaacttaaggcacatattataatctttatgacactattaaaagctaagattaaaacaaaacaaaacagaacctacttctttcccccatcctttgctaccaatcattccctcctcaaattcaggctattggtaaggagtcaaacaaaaatcccatcaatgaacaactggtatgatttccacacaaatgtctactatttgcattgagcaccactggtagattacaggccagtagaatattttcagatatcctgggtcatgaactgctcaatttacccttcagccccatggattcagactggactttcctcctccttgggccctccatctgtgtctttctggtccggagattctgctgctttggtaacttcatttggcttcccagcaacatctatactggtctcttcctctttactttcctttttctgctcgtttgctttctgttcttttgccaaaagtcgataattgatgcccatgccaatgaagagatagatacctgaaataattaggacgacgccacatgcccagtatgtgtatttgtagtctccatacatgtcattgagccgacctaaatatgtaaaacaacacaaacagttgtttctaagagtaaacagtttttttttcccccaagcaaagcttaaggatccattcagaaagatgtcaatccaatctttaaagagtcccaaaatgatgaattagtataaggaattgctgaaaattagctgatcctctgtttataatgcatcatggattttaagtggcctttgcatattctgttatttttagtaacttgaaaatagttaactcttggcaaactggaaatggaagagacgtagtgatcacctagagtcaattctcttaatacactatagaaataagtgttgctaaaagaggcttgggagtcttgtccaaggccatagtgctgtcccatttacccaggccaatgctctttctctctcagcatttcccaaagagtattcctgtaaacacttgtccagtgctaaaaatttaaaagcaatatcttacacccattctaagtgcttaatctttataacaggcagattctattatcatcctcactggacagatttaaaaactaaattacagagatgttagctaatttgtccatggtcacaaaactaataagtgaaatgacttggctttaaacctagaaagtctgactcggaagtctgcacccttaagcatgtgctacaaggatactgctttaatgtttcaaaagtcaaatgaattgataaatggcatattattttctcataaaggctttgtgaagtctggtagtaaagaaccctatttaatttgatgtttacaaattttattttggtcatgtaactttcattactgtaaaatttattagcatctcattgaactggtatctctgggaaaattctactctatgcttaaacaggacttaatacaaccaatttaaatatgattccatatggctttctaactcagggcatcattcattcaacaatatttattgagcctttatcatataccaggcactggctcagctaagccctgaggataagggtgaacagaggatccacagttcagtggacaagagatgttaatcaagtaactacacaaactgtgacaagtactaccaggagagtttgaaagaagtggggtcaagaaagctttccttaaagtgtcaacttagctgggatttgcaggataggaattatctaggagaaaggagatgggaattagatccaggcagagaactgtagtgcaaaggcgcaatggtaggagagagcatggtgtgtgaggggaaagaagggccaggttgctggggcacagagagcaggaggccagtggtagaaatgaggctggaaggacagctggggccagcccatgcagtgccttgcaagccacattagggaatttgcttttcaccctgaaagtaatgggaagcaactggagagttttaagaaatcttgaagagttctgaactggagacttcaaggagactgaagaacagctagaactgatacaggtagaccagttaggaggttacagttaggagcagcccaaacaggagacaggagctttggataagggtagtagttgtgatggagaaaaatgggcagatgagaacaagatttagagcataaaaactcatagaacttagtaactcactgggtatgagatggaagaagacagtgatctcaaaaggcagctatggatcttctgttatatactcactcactccccaaatcaaagttcctaaagtatgagtcacatccagaagaagggtcaaattattttttcactatgtgttatgtattgagctattaatttgaaagataaagtattcaataaccttcaggaatagttcccaagttgtaattaattttctagctgtatgattttagccaagttatttcaccttttgaagcctctgttcacttacaaaatggggacttaaaacggtcctacctcatatggacttgtgagatacaacaggagatacaaaatgataaggacagtctctggtacactgtgagcttacatggtagctattattatactactgctactgaaataaactttttttttttttttttgctttttgtgtgtttttaaaaaatttatggatcaggcatggtggctcatgcctgtaatcccagcactttgggaggccaaggcgggtggaccacctgaggttaggagttcaagacgagcctggccaacatggtgaaaccgtctctactaaaaatacaaaaattagctgggcatggtggtgggcgcctgtaatcacagctacttgggaggctgaggcaggagaattgcttgaacccaggaggcagaggttgcagtgagccgagatcgcgccattgcactccagcctgggcaacaagaccaagactgtcttaaaaaaaaaaaaaaaaaaaaaaaaaacttatgtgaaatatacttcatttttaaaatgaaataatcactagcgctttaaagattgggttgtttttctacatgcttttctacactaagcacatcagttttgcgatcagaaaaaaacatattttaggccaggcacagtggctcacacctgttacccagcactttgggaggctgagacaagtggatcgtttgaggtcaggagttagagaccagcctggccaacatggcgaaaccctgtctctattaaagatataaaaattggccaggcatggtggcatgcatctgtaatcccagctaccgggaggctgaggcaggggaatcgcttgaacctgggaggcggaggttgcagtgagctgagatggtgccactgcactccagcctgggcaacagagcaagactccatctcaaaaaaaaagaaaaaacactgacatttgtaacaatatttgatcccccttttgccttgatggttccatttaattagattctatatttgagcaattatgctgtgccaagcattgtcccagcatcaagggtacataaatgagaaagatttattcttacccaaatagctcactaatgtttgctttctgtcagcattcccatcttacatgcttgttttgtaatagacccacattagtagggagatatactatacctaaaagtggtggccccaggaggacaggacagcattccacaatggtcaccaatcccacagcgctggagaacctctggggtccaacaaggtccatcaatgtttcaaacaatacggagctgagccacccgaaggcaaatccaaagaatcccgcatagacacagaatccaacataggtagtggataaaggtgctagcatatgacacactccatttgcaacaacggaagccgcaaagaaatactgaattcgaggtcttattggctttgtgttggctacaagtcccatagatggtcgggctaccatgtcaacaaaagccagaatggaaagaaggaaggcagacttctcactagaataatgctgactcttcccataactactaagaaacaccaaaggtgcaaagagtccaaaaaacatgatcacatttccagagaggtatagcaaaaagcctctgtgggtgaatagggttaagtccaggaactgattaattgtttggaagactgatcgtttctcttgtttagggtgtcttccaataagatctgtatttgcatcatgcagatcttttttcacaccagattttccagctttctcaagggatgctttagacttatctttccctgccttggttggcttgggcccgattggtcgcatgagggctccagcaacacagcagtttagtagcaagcccccaagaattagaaagcttcctctccatccaaagataccgaagaaaacctgattgaggggggccagagtacagaggaacacagggctgcctgccatggccagtccgttggccaatggtcgcctcttgtagaaatacttgccaatcatggtcagagctggattcaagttgaaggcaagcccaagacctgtgaagacaataaataaataaataaataaataaataaataaataaataaataaataataagaggtataaataatggaaggaataggatataaatcctcattattagaggacatgttatgtagtggtttaaagtatgacttctaaaacagacatgggttcaaatctcagtatcagtgcttactggttgcataatctcagacatgtataccctcctatgactgcttcctaatatgtaaaacgggcacaggtcactgttgtgaggaagaaaagatttgttaagcacttagtacccagtgcccagtatgtagtaagcacttaatacatgttatttttattattgttgtttttattatttgaaggtgaataactattttgtctaatctaacaaaatcaccggaaggattattataaccatataagatcattaagtcgacagtagagataaaacaaatttacactagaaaatgcataaggccagctgcagtggctcatgtctataatcccagtgctttgggaagccaaggcggcaggattgattaaggccaggcattcaagaccaccttgggcagcatagcaagacctgtctctacaaaaagtaattcgaaaattagtcaggtatggtagtgtgtgcctgcagtcctagctacttgggcggctaaagctggagtatcacttgagcctagaagtttgaggctatggtgagctatgatcacacaactgcactccatcctgggctacagagaaagaacctgtctcaaaaacccaaaaacgaaagaaataacatatagtacaaaatgatcccttccactatagcaccaaaacttaaaaacaggccaattcctaagactccaattgtgaaactttcctgagagatcagagaatttaaaatacacacaaagttttgggaaaataaaacacaacattgctaagatgccaaggctcctgaaatgaatgtactaatttattttatttatttatttatttatttatttatttatttttgagacagagtcttgctctgccgcccaggctggagtgcagtggcgcgatctcggctcactgcaacctccacctcccgggttcacaccattctcctggctcagcctcccgagtagctgggactacaggcgcccgccaccatgcccggctcattttttttttgtatttttagtagagacggggtttcaccgtattagccaggatggtctcgatctcctgacctcgtgatccacctggctcggcctcccaaagtgctgggattacaggcgtaagccaccgcacccagcctgaatgtactaatttaatgcaatccaatgaaaatgtcagtgaattttactttcggattaaggtaaatgattctaaaggatacttacagaacaaatacagagctactaggaaatttttgatggtgcagaggaaaaagtgggaccaaccagaacaaattatttaaatggctttacaaaagctacagtcattagagcagtgtggccctgtttcaggaaccagtaaaaattcgtcagtgaaagtgcagaaacactatagaaagtccaggaacagagttgaaatacatggaaacatttaatgtaagataaagtagcattttaaattaatagagagaaattattcaataaatagtgctagcaaaagtaatattcaaagaacttcctccctgacctcatagcaaaccattcttacatttgttaataagctctacggtctatgatcccttacattttcacaaatctggttccctgttgttatgcaggtctctacttaaagttgattcttcagtgagccctgaccttcattgcttgcccagttcttccctgtcacaacactcagttaaaggctttatatagcatttatcactacctgatatttttcttatttattaatttatttatgagttgtactgtttgtctcctcctattaaagagtgtaactgcctgacttgttgctctatctctacagcacctaaaatggttcctaacacacatacagttgttgctcaataaatatttcataaataaattaataaaagagcaaatgaaccaactgattaaccatgtgggaacaaatagagttatatttcttttttctcatcttatgtcagatgttttcatccatttggaatttttaaatgtagctgggcgtggtcgctcatgcctgtaattccagcatgttgggaggccgaggcaggcggatcacctgaggtcaggagtttgagaccagcctggccaacatggtgaaaccccgtctctattaaaaacacaaaaattggccaggtgcagtggctcacgcctgtaatcccagcactttgggaggcagcggcaggcggaccatgaggtcaggagtttgagaccagcctgcacaacatagtgaaaccccgtctctactaaaaatacaaaaattagctgggtgtggtagcgggcgcctgtaatcccggctacttgggaggctgcggcaggagaatcgcttgaacccaggaggcggagattgcagtgagccgagatcatgccatagcagtctagcctggcagtgagagtgaaactgtgtctcaaaaaaacaaaacaaaacaaaagaacaacaacaaaaccagatttttaaaatataaaaactaaagtgcagtaaacagaagtggacaaatattttcataatcttggagtagaaaacaactttctcaggatgacatacaagatggaaaccataaaatacgttttgaatacataaaaatttatatgtttaataagggaaaaacattggaaaagactgaattttaaaaatactttttaacaaaattcaacatcagaaggccgggcaaggtgattcacgcctgtaatcccagcactttgggaggccgaggcaggcggatcacaaggtcaggagatcgactatactgactaatgcgatgaaaccccgtctctactaaaaaaaaatacaaaaaattagccaggcgtggtggcgggcacctgcagttccaggtactcaggaggctgaggcaggagaatgacgtgaatccaggaggcggagcttgcagtgagctgagatcgcgccactgcactccagcctgggagacagagcgagactccgtctcaaaaaaaaaaaaaaaagaaaagaaaataaggattaaaaccaagagatactgttctcacgtgttaaactggcaattatttttttaaaaaaggcaatatcccattgttgacaaaagggataatcttggaatctctgatatattgtggtgggataataagtgagtataacttttttggaggacaatttagcatacatatattaaaacaaacacacagcagttccctttctacaaatttatacgaagaatatattcatgttcacaaaactttcaacttaatactgacaaaaatctggttataaaatattagacataatttgatccttttttgctcaaaaaaaggtgtatctgtgcatagaaaaacacatggaaggatatacatagaaatgttaatgatattctttggattgtgaggttatgggtaacttttattcattatgctcatcaacagttcattatcttaatttagtgatttttaaaatggggggaggaattatgaagcgtatcctctacccctcagaaatgttatgtggacattctatcaaattgccactctcgcaccaagttgccacacacattgtatctaccactactggctattcttaggacaaggaatgcaatcattctttcaattcattcactcattcgacaaacaataaatatccattatataatggcaatttctttaaaagtttgcttttctagtacttttatctctagttcttcaaaatgataatcaagtcatttctataagaaaagaatttcactccagagatctgaaagatgaatgcaggtaaatacaaaatagccagccataaactaatgcttccaaatgaatcagtagtaactcacctccaatgactccaatacagacgtatagttgctgtacggtgttacagaaagaagctgcaatcaagccacagcctgacaagcagccaccaacaatcatgactatacgacttccatatttattcaccaggatactgctgataggacctaaaagacaaccaaaaatgtagtaatataaaggaaactgctccctcacatctacacaagtatgaatgacaatgaatgacaaatcctccaaaataaacaagcagcaatgataagaatattgttttctataattacttctgagtcacatgtgtactaaaataaagatgttagaaaacataattaattgtgcaggttctaaatctaaaaatactggatggaattttactaaaatacaaaagacctgaagttatccttaatctttctcttttatggcagggcaggctgaaaacaccttggtaatggatgttcacaaggttcttgatgtatctaggatacgattaacatgtatgtagaaagtggctgggcgcagtagctcacgcctgtaatcccagcactttgggaggctggggcaggtggatcacccgaggtcaggagttcaagaccagcctggccaacatggcgaaaccccgtctcgactaaaaatacaaaaattagccaggcgtggttggcgcgtgcctgtaatcccagctactccgaaggctgaggcaggagaatggcttgaacctgggaggtggaggttgcagtgagccaagattgcgccactgcactccagcctgggcaatagagtgagactctgtctcaaaaaacaaacaaacaaaacaaaaacatgttagtagaaagtatgttctgttttaaatttcagacacacgcagtgataggagacgtataaatgcatctagattttagagtacttgtatattatcataaatgtggtttgtggtgttgtgttttttttgagacggagtctcactctgtcacccaagctggagtgcagtggcctgatctcgcttactgtaagctccgcctcccgggttcatgccattctcttgcctcagcctcctgaaagacagggtgggcgtggtggctcatgcctgtaatcccagcactttgggaggtggatggatcacctgaggtcaggagttcaagaccagcctgaccgacatggagaaacctcatcactactaaaaatacaaaattagctgggcgtggtggcgcatgcctgtaatcccagctactcaggaggctgaggcagaagaatcatttgaatccaggaggtggaggttgcggtgagccattgcactccagcctgggcaacaagagtgaaactccgtctcaaaaacaaacaaacagcaatccctaaagccacgcggccgccaactccagggagctgatgcttccaaccactgcacgttgctcccgggctgtcgcagtctcctgttgccgccatcatgtcccggccctccacggtgttgggtgccatggagatggggcgccgtagtcacccgcgccttcctggagcacggccacaccaagatagacacggccttcgtgtacagcgacagccagtccaagaccatcctgggtggcctgaaaattgataccaaggccaatccattgtttgggaactccctgaaacctgacagtctccggttccagctggagacgtcactgaagtggctgcagtgtccccgagtggacctcttctacctgctcaggccagaccacagcaccccggtggaagagacactgagtgcctgccaccagctgcaccaggagggcaagttcctggatcttggcctctccaactatgccacctgggaagtggccaagatctgtaacctctgcaagagcaatggctggaccctgcccactgtgtaccagggcatgtacaacgccaccacccagcaggtgaaaacggagctcttcccctgcctcaggcactctggactgaggttctatgccttcaaccctctggctggggacctgctgactggcaagtacaagtataaggacaaggacaggaaacagcccatgggccgcttctttgggactcaatgggcagagatctacaggaatcgcttctggaagaagcaccacttcgatggcattgccctggtagagaaggccctgcaggccgcgtatggcgccagcgcccccagcatgacctcggctgccctctggtggatgtaccaccactcacagctgcagggtgcccacggggacgcagtcatcctgggcatgtccagcttggagcagttggagcagaacttggcagcggcagaggaagggcccctggagccagatgttgtggaggcctttaatcaagcctggcaattggttgctcacgaatgtcccaactacttccactaggcccatcgtttctcaggttgcccaaggctcttctgtaacctcttttgtttctcacactttctttaatttagaagtgcctcagtaaattcttagggatggaagtatttggacaaaaacctaacagtaaagtcaccaccaaatgaagaatgaaacctcctggggtgctgtgtgttagtctgtttgcattgctataaaagaatacctgagaccgggtcatttataaagaaaacaaacaaacaaaaacaacaacaacaaaaaaaagaaaaaagacaaaaatgcatgatcattttttccaagtttaagtagtgttgcaattaggtaatcttgattaaaaaagaaaaagttcctagttacatccaaattcaggtactaaaccaaatatatctttcaggggccaggtatggtggtggtgcatgcctgtagtcccagctactcgggaggctgaggcgaagaatcacttgaacctgggaggcagaagttgcagtgagatgagatcgtgcctgggcaacagagtgaggttctgtctcaaaaaacaaacaaacaaaaaaaacccacccaaatatatccttcagaattacttggttccatgcctatattattaagtttcatggtagtacaattgtgaaaaaaaatgcttgcaggataagattaaatcagataacagtcaacacaacgtgggtgtaacaactcaagagaataggaaatagtattatccaagaaaaccagacatttcctcagctaactatatgcatataaaaatcagcatttctagtatgtgagaaaaggaaccaaatgaaaagcattataagaaacaagaaaatattttatgcatttcatgtatcagttttttgcgaccagtctccctctgtggctggagtgcagtagcgcaatcacagctcactgcagacccaacctcctaggctcaagtgatactgccaccactgcctccaaaagtgctgggattataggtgtaagccaccatgactgacctatgtatcagtttttgagaagaggaatcaaatgtcaagtggcctttcttttttttttaaatttgagacaaggtgttgttctgtcacccaggctggaatgcagtggtactatcagggttcactgcagcctcgacctcctgggctcattcaatctgcctgcccagcctcccgagtagctgggacttcaggtgcatgccaccgtgccgggctaatttttgtattttttgtagagacagggttttaccatgttgcccaggttggtcttgtaatcccggactcaagtgatccacctacctaggcctcccaaagtgctgggattataggtgtgagccaccgtgcctggccttctcttcttacttgctataaataggtataatctgtaatttgccttttccaaatttcaaaatcttaattacaagaaagtcttatccaaacatagagtctatttctaaaaacacatattgaatgtacatatattcagaatatactaatgatcacatattggcatattctatttccataaatactatgaaaaatacttcagttacttatagtctagttttactattcagagttgcggtacagtatactaacattaaaaggataggctgtagccccagggcaccctgttttaagttttggtttcaccatattcttgtctgtttctcagaggttattattaaactactttataggattgttgaaagaataaaaaattaactaatatatgtgaggtgtttagttggtcctcaataaatactggcagtgatcatgatactggtgcacatgcttatttatgctttcacatgacacagacagaaggtgctctctttccatctccatccatatagatatagatgttatgtatgtatatatacataagataagcatgttaagaaggaattaaagcttttgattattcatgtgtttcataggaccaagtctctctaaggtgctacatcaagaactggccgttgccaggcgcagtggctcacgcctgtaatcccagcactttgggatgctgaggcaggtggattacctgaggtcaggagagttcaagaccaacctggccaacaccatctctactaaaaatacaaaaactagctgggcgtagtggtacacacctgcagtcccagctactcaggaggctgaggcaggagaattgcttgaacccaggaggcagaagtttcagtgagcagagatcatgccactgtagtcataagactttgtacagttagaattacaaagataaataccaggctaggcatggtggctcatgcctgtaatcccagcactttgggaggccaaggtgggcagattgtttgagcctaggagttcaagaccagccttggcaacattgcaacaacccatctctacaaaaaatacaaaaattagccgagtgtggtggtgcaagcctgtagtcctagctacttggcagggtgaagggggaggaccgatcacctgaggccagggaggctgaggctacagttagtggtgattgtgccactgcactccagcctgagtgacagagtgagaaaccctatctcaaaataaataaataaataaataaataataaaaaaacttaaaaaaaaaaggatcagcttgggccatagagtgagaccccatctctacttaacaaaaataaaaaattagctgagcatagtagtagggccacctgctactggggaggctgaggcaggaggatggtttgagcctcggtggctgaggctgcagggagacatgatcatgccactgtactcctggtcaacagtgagaccctgtgtcaaaaaaaaaaaaaaaaaaaatcccacaaaacaaagatcagtatcaccacactgttgactctgaggtagaagttaatactgtagaagttaaagtttttgaaatatttaaaattccaaaccacaagtgttaaggtgacccttgtggaactgataaaatttatactttcatgtttaaaaaaaaaaggaaaaacaaataaacaaaccaaaagtaggcaggtaagatctcttccccgcaaaatatactttaacaaccatcactgtatatctctgacccaaagcactaaaaaagaaaacaaaaccaaccatatctcaagacgtattagtgttcagattgtggtccaaatgaacaagttaaaggattatcacagttgtaaaagtgatgaaaactattaggggatatactatttagaaaccaaaccaaacaaaacaacccatttagtaaaaattctgcaacaaggttcatgataggcattttgtcttttagtgttatttcaggaaggataggcctaattagctatcattaaaaatagaaaggggtacggtttataggcctattataatacaaactcaaaaaaatgtgctagttatctcactaattgagtaaggacaaagaaggaactgtttccccaaaggaaagtgtcatgtgcaactaataaaactgacatcacttacttttgatgcaaaacacaagtggctttctcgctctttggtagcacagaatagcaacatgtaaacttctggtttgtagtcaacttaagaagacactgaacacctggagtacctctgggtaatgtttataccaatttcttcaagccatcatagtcaaaacctgattaaaatcctggcagaatggagttcaaagcctacaaaattattggctctcagaagctaatgcccaaagtccattttgatttctctgaacttattaaaaaaaaacactacaattaagcacttaggttctttaatttgatagacaaaataggcctatgttcaaaatgtaaaaggcacaaaaagataaacagtggaaacataagtcttcctaatcctgttcccagtcacccagtttctctttctccatggcagccagttacctgtttcttctggacgatttaattacaggcttaatgaaattatgatttcaactgcttattcctgtttcacgatcatatattactgtctcaaaaggattataaacttctcaaaggaagggatcagtgttttctgtcactcacaatacctagcccagtgctgaatatattcatagaacttgacagatattggttgactctggcaccaccttagcagcctaaggctaagttatttatagttgaaaccaagaatcattacattggctagaaacagtattttagatgatgttaagtgagcaacttacttccaacatttcctttacaatatgccaaaaaaaacaaaagagaaataaatggtaaaatttaagtttagggtgcagctgaaatgcttttaggactcataacatcgcaagtaatacggaggaggttttttcagttaattctaacatcatataaagattttacctgagaatctgaaccatgccattcaggctagtctgatttattttaatcctcccaacatcaatttttaaaaatctatatttatgtttacatttcaagagtccagcagagatcaacaaaaaaaatacagctgtgaatacatcatttttataacagtcttttaaactcaatgatacatcagttggagcaaatcaaggtccctcacaattttctcatttctgttttgaaatactacagtatactatagcaagagttgctattgttatcaggaatgaaaaatgtgactctaaacaccaaactttaagaaataacatttcaaaacatctcactgaataagacttttttttttttttaaagttacctaatacagacactctggctgcttcatgaaaattaaaagagcaggccttaatgggtacttacctccaccatacatgacagccaacattatggaggatatccatgacacttcgctggtggtggcatggaatataccttcaatctctttgaagaagacagtaattgatttgggaaatgcataagagaagccgatggaaatgaaagctccaattaccactgcccagccccagcctccatctgggggggtgtatccaactggacctccaactgctggtggcattttaagtgtagataaattccaaaatgcaggtcaaatccaaatatctgaaagacataaaattaaaatagtatgtcaatataaggcacacctataaaactcttttgtgaaataagaaatatagccaatcgtggtggatcatgcctattagtaatcccagctacttgggaggttgaggcaggaggatcatttgaggccaggagttcaagacagcccgggcaacacagatcctgtgtctaagaaaatttttaaaaaattagctgggtatggtggagcatgcctatagtcccagctactcaggaggctgaggcaggaggatcacttgtactcaggagtttgagaccaccctgggcaacataagtagaccccaactttacaaaaaaattaaaaaattagccagacatggtggtgtgtgtctgtggtcccagttacttgggaggctgaggtgagaggatcacttgaacctgggaggtagtggctgcagggagctgtgattgcaccactgcactgcagcctgggtgaaagagcaagatcctgtctcagtaaatacataaataaattggtaaacaagagacctgatgagattccaggttggtcattgcatccatgtgcagggaggatagcataccccaattccacgggggaagaggctcctgtacttggggacccttccagactttgccctatgtacttcttcatctggctttcacatgtatcctttaaagtatcctttataataaaccagcaaatattagtaagcgtttccctgagttctgtgagccttcctagcaaattaatcaaacccaaggagaggggtagtggtaacccgatttatagctggtgagtcacaagtacaggtgacaagctactacttatgtatgattggcatgtgaagtaagggccttagtcttgtgcaactgaggccttaacctgcgatctaactccaggtagctgaagtcaaaattgaattgaattacgggacacccagttggtgtctcctacaattgcttggtatatgtgggggaaaaaaacccccacacttctggttacagtagtgttttgtgatgtgctgagtgttgactgtgtaagaggaaaaaaaaaagtgtttttctccttcagaactttacacctagctctcgagtaaatgaattttttttaatgttacttatccaatagacattatcttcttttaaagacattatcagaaaaagctttagagtcatagtattgcccataattttttgtagcttaaaggaaaatagcttctcaccacttaagaaatcataattgaaataaatccctttcaataaatcagttaacatcataattccttaaattacttagataaccaaatgccccatttgacttatctgcttaacctaagataacacataatacataacctacaaacattttaggttttttttttttttttttgagacagagtctcactctgtcgcccgggctggagtgcaatagcaagatcttggctcactacaacctctgcctcccaggcggttctcctgcctcagcctcccgagtagctgggactacaggcacacgccatcacctttgactgatttttgtatttttagtagagacggggtttggccatgttggccaggctggtctcgaactcctgacctcaggtgatccacccaccttggcctcccaaagtgctgggattacaggcatgagccaccactcccagccccaatgctacaggttttaatatagcctttataagttttttaccttttccaaaatatattcttccatactcttttcattctcttatttatggctgacttaacatactaggaagtgggtgcctgactcactagatatgtagcaatttacaaaaaaaaagataattctgaacaccgaaaattttcacttaacaggctggggaattatctcagaaaagtttccttttatcttaatagctttgattcaaggtatttttccgcattatatgacaagaaactcctaaacaacagctagccaatacagttaaaatcataaatatatatatgatgtcaaaagatggtagttttaggccaggcgcagtggctcacacctgtaatcccagcactctgggaggcagaggtaggtagatcacctgagatcaggagttcgagaccaaccttatcaatatggtgaaaccccatttctactaaaaatacaaaaattagccaggcatggtggcatgcgactgtagtcccaactactagggaggctcagataggagaatccttgaacccgggaggcggaggttgcagtgagccgggatcatgccactgcactccagtctgggcgacagagtaatactctgtctcaaaaaaaaaaaaaaaaaaaaaaaagtagttttaaatcaaagataactcctttgtcttgaattcacttagtactaatgaataatgaatagcatggttagaaaatgtaaccttctgttacattttctaataagattttaataaggggcaggtgggagtgagcgtttggtggtaggttacctgttttctcatgaaggtctcctttactttaagccaacttccaccctatattacaacttatcctgtatgttagcaggtccatttcaaagtacttccactcagactatattacagcaatgaacacaggtcagagatgacaagttcactcttgactaccatgttctttagtctataacacaaacgcttcttcataatattagcactcaactccaaaacactgttccttccaacccctatgaacacttcaaatacaatttaggacactggacattgcgggagtatgatgaaaatagctccatacaagaagtttcctgaaaagcaaggatatactcaccacttatacacaacattctactataggttctagccagtgcatgcaggcaagaaaaagaaacaaaaggcataaagaatggaaaagaagaaataaaataggccaggtgcagtggctcacacttataattccaatgctttggaagaccaatgtaggagaatcgtttgaggacaaaaattcaagaacagcctggacaacacagcgagaccctacctctacataaattgtttaaaaattgggtgtggtggtacacatctgtagtcctagctacttgggaagctgaggtgggaggatcacttgagcccaggaatttgaggttacagtgacctatgatcatgctgctgcactccagagcaagaccttgtctcggccaggtgcggtggctcacacctgtaatccccagcactttgggaggctgaggcgggcggatcacaaggtaaggaatccaaaaccagcctggccaacatggtgaaaccccgtctctactaaagatacaaaaaattagccaagcatggtggtatgtgctagctacttgggaggctgaggcaggagaatcgcttgaacccaggaggcagaggttgcagtgagccgagatcgcgccattgcactccagcctgggtgacaaggggagactccgtcgcaaaaaaaaaaaaaaaaaaaggcctgtctctaaaaaataaataataaataaagttgtttttattcagatgacagatatgtataaagaaaaccctaaggaacatcaaataagtgaatttgactaggtcttaggatacaacatcaatacacagaaatcaattgtatttctatatattaacaatgaacaatccaaatatgaaaacatttttaaatgctattgtaaatggtaaactatatagaaataaatctcacaaaagatgtatgagatatgtacactgaaaactataatactgagaagttaaaatagataacctatcctctcggactgaaagactcaatatttaaatcaagcaaagatttctgaaggaacataaagaaacaactataaaaaaagttggccgggcgcagtggctcacgcctgtaatcccagcactttgggaggctgaggcgggaggatcacgaggtcaggagtttgagatcaacctggctgtctctactaaaaatacaaaaattagctgggtgtggtggcgtgtgcctgtagtcccagctactcgggaggctgaggcaagagaatcgctcgcttgaacccgggaggcggaggttgcagtgagctgagatcacgccactgcactccagcatggccgacacagcgagactgcgtctcaaaaaaaaaaaaaaaaaagttttaaaattagacttcaaaatatatgcaaaataatatactcaagaaaagacatacccagaacataaaaagaacttgcacaacgatagcaaaaaggcaaatcacccagcttaaaaaaaaagcaaaagatctaaacaggtgcttcaccaaagatacatgaatgataaacaagcacatgtaaagatgctgaatgtcgttggttatttaaaaatgcaaattaaaatcacaatctaatacatacctactaaaaataagacagataattccatgactttgtggggttataaagccaatggaactctcatattgctgatgttacagtcccttggaacacattttggcagttccttataaagttatagatatatttaacatatgagccagccattacagtgtcaggtatcacccaggatttatataaaaaattctctagcagcttgatgcataatagccaaaaactgaaaacaacccaatgtccatcaacaaatgaatggataaacaatggtacagccatataatagaatactactcagcaataaaaaggaactactgatgcatgcgataacatggatgaattttaaaagcgttctgttaagtaggaaaaaaaagctagacaaaagattgtattctatatggtcacatttatattaaattgtagaaaaggcaaaattctagcacaggtcaagcatttctctaatctgaaaatatgaaacccaaaatctgaaactttctgaacaccagcatgatgctcaaagaaaatactcattggaacatttcgaattttggatttttggattagggatgttcaactgcttaagtaactgcaaatattccaaaatctgaaaaaatctgaaatccagaacacattttatcccaggcattttagataagggatagaaaacagatcagtggctaccaggggttggggagaggagactgactgcaaagcagtatgagataacttttagggtaaatggaaatactttattatcatgatggtgacagttactcatcaaagtatacattcaagttagtaaattttattatgtcaattatacctcaataaagctgatcaaaaccaaaagaaagtccaaggacagtgacaaggggaataaaatttgttctgtggcacagggagacaatacagaagcaaaaggagagggcaggcaaacttctttgtcttagttatctagacggttaaaagaaagaggaagaagacaaagatgaggataaagaaaaggagacaagaggaggacagaagattcttctgagaattcacaactcaggccagtgtgagctcatgcttggcagggaattatctgtagaatatctttgttgttcttccagagatacactatatttgattttgctagcaaagatttcccacaaaggcctgccaaacataagctcacaattgtgaacacatcaagaaccaattaaccgtgagcaaacgcaatgccaatctaacacagttggattagacactcaggaactataggcatagcaatatgaatatttaaatgactaaagacataaaacaaggcatttaaaacattagaaaaaactgtgtatttctctaaaattatgtctttctctaaaaaagatccatagaagaagattaattgatttgaaatagaactagaaatggaaagtaaagttagccaggcatggtggcttgtgcctgtaatcccaacactttgggaggccgaggagagtggatcacctgaggtcaggagttcgagaacagcctggccaacatggtgaaaccccatctctactaaaaatacaaaaattagccaggcatggtggcacatgcctgtaattccagctacttgggaggctgaggcaggagaatcgcttgaacctgggaggttgcagtgagctgagattgcactactgtactacagcctggtgacacggcaagactccgcttcaaaaaaaaaagtaaagtcagtgaaattaataacacattaactggaagactggatgtagctatatacagagtcagtaaaccttaagaataggtttgaagagattagtcagaattcaggggagtgtcattctgaagctatgaaagaaaggctttagaatgggaggatctgacatttatctaatgggactttggaaaaagagaatagagaatggagaagagacaactgtctgggtaaatgactaagggttaatgactaaggatattatagacttgatgaacaatataaatcctcagtttgagaaaacaagataaagagaaaaatcttagaagacaactacttagaaaatacagatgactcagctaacaaatattcatactgacaaaacagtcttcctgacaattttgaaaaattctcacctattatgtcttcaaatattgcttctcccccattctctcttttcacttttctcagactccaactggatatgggttggaccttcccatgctatctactctcttactctcccttctatgttgtcatgttatcattcattcctttgtttctctgaacttcattctggatggtttcttctgtactttagctgtgtttggcactaaagattaaggtgatgtaacttaagattaaggtgatgtaacttacaggaaatagctggccagtcctcattttcaaaccaatcaagtaaaagagatttctgttaaacaaaagcacacttcattttaattcaaataaatgtgttgatacacatctctgtgataactatctcatttttataataataattctaacttagagaaggcagccgggggcagtggctcatgcctgtaatccaaacactttgggaggccgaggcgggtggatcacttgaggtcaggagttcgagacctgcctggtcaaaatggtgaaaccccaactctactaaaaatacaaaaattagctgggcatggcggcaggcacctgtaatcccagctacttgggaggctgaggcaggagaattgcttgactctgggagacagaggttgctcagtctaggtgacacagcatgactctgtctcaaaaaaaaaaaaaaaaaaaaaaaaggagaaggcaggagtttgttgtccagatgaaataatttttcaatattctccaatatttctgacctaatctctttttggatttctatcatgggactctctctaggactatgcattctggaattttcccttcctttgagatttttattgcttaggacagtgaaccaccataagaaatgggatgaataagagatacacctctcttttgtagtgggagtaaaaggcttttggataactcaagttggaaaagaaaaagtagagatcaggcatccattctcaagaggtaatttttagctaaggttatctctcaacctgaggatgtgcagaataattccttcaaaaatataacccagtttaaaaattgaaggtctttgtcctagggcatttcatctacctaggatttgggtgagataaaaatatttacaagttaaggtttcctaaaatttctactggaatgaatatgattaaaagctatttaacaggtcagctctgctaacagcaacagcctgaattctaaaatgatgttaaataaaactgctgcaggcattgattttatgagctttttcttcttctaagtatgaaaaaagagaacacttaaaaaatttcaaagaaccactaaaaagattaattcatctcagaatatttacacacatagaacacccacacacagacagtagggctgtttaacacatcaagctctgactagaacagctaatacgtgctggacgtgattaaactttgagtttagctgccagctatgatttgtcccaattaaggcagttacaatttttagtcactaaagcttgcctcatcaagttaataccttattccacagtgccaaaattagatttaaagcctcaagaaactttagaaaaatttaaaaggaaataagaaagtataagaaataagagcatgcaaaatcattatgaaaaacagaacacttcaaaaaaccacacacagattcaacacaattctgccaccacctgacaaatggctatccctgttaacttaaaaatactgatggtacataactgaaaaaaaaaagtcagttaatattatctaagcatattatttccttttttaactggcaaatctcagctataaacagaagggctcattcaaaaagtaaattatgagagcaggcccccttgcagagtactcagagttcccttgagaaagcagagcacatgcattctttgtatgctaaagcccagaggctaaaagggactaaagtttaagattttaatccttacaatatgcacagtagctttcctatcagcttagctattactgcccaagagtgatggggagactaaaaaacaaagtgatagggtaatgagaaaaattcttcattaattcatcttctaaaggatgatagaaaacaataaccctaacttttcttggcaatgacggtgataagaatcaccttctagattttctgatatttttttctcgtaactctcatgaattgtgctagtaaactaatctggaaagccgaagctgtgctccatacctgccatgtccttgccccactcccaaagagaagagctacaaaagccttgaaaatagtattcatcatgttctgtacactttcctcatcaacatttaaaatgaagccactgtcttttcctaaaatgacaatgaccagtttgtgaacttaaaagaagcagaaagtatctaaaaccaataaccttaaaataatctgttaatgagtgtaaactagttttaggtttcaaacacatggaaacattcaaatccagaaaggctgatttcctgaagctattgctgctaaagtagataacctgttgttctctgtaactagccctaatgcagcttcatggtttacagaaccacctgtcccaagttaactcccaagattcaaagtctaggaaacctcactttcgtttcttttccactttgaaactgaatacattgaggaaaccaaaacaatgaaaaaatcaagcagaaagcgctagtcaaagaaggaatgtaactactggatctggctagccaaacactcagcaattacgaaatgcataattttgatcaaactgcatataaagaatcttaaaaaatataaacctgtctctgcaaacttccaactctctttacctaccctgccattctgggaaaatcctatccacattacaagaagttaaatatattatgcttataagagaaattaacaacttgctaactcgaatgcttaaagaaggattttaggcctatctttcagaattctgtttatgataattgattttagaccttgcttttaattcatatttataatccctaaaaaaatcagtattttagttaataatttacagtttaaaattatttacatagaccactctaccaataaatagaaagcatttcttttttttttttttacctttttttcttttttgagatggagtcttgccctgttgcccaggctggagtacaatggcgcgatctcggctcactgcaacctccgccatccggtttcaaacgattctcctgcctcagcctcctcagtagctgggattgcaggcacacgccaccatgcccagtttttttttttttaacttttagtagagacaggttttaccatgttggccaggctggtctcgaactcctgacctcgtgatccacccgcctcagcctcccaaagtgctgggattacaggcgtgagccaccgtgcccggccaacgtatttctttttaaagacagcagatttccaaagaacaagaattggtaaggatgtggagaaaaggaaacccatgtacactgttggagggaatataaactggtgtagctgttatgcaaaacaatatgaagattcttcaaaaaattaaaaatacaattaccatttgatctagcagtcatacttctgggtatatatccaaaggaactgaaatctggatctcaaagagattacctgcacactcccatgttctctgcagcatttttcacaatagccaagatatggaagcaacctaaatgtccatctacggaggaacagattaagaaaatgtggaaaatacatatagttggtcttgtcgcccaggctggagtgcaatggcatgatctcggctcactgcaacctctgcctcccaggttcaagtgattctcctggttcagtctcctgagtagctgggattacaagcatgtgccaccatgccggcctaatttttgtattattagtaggaaggggtttcaccatgttggccaggctggtcttgaactcctgacctcaggtgatccacccacctcggtctcccaaagtattgggattacaggcgttagccaccgtgccctgcatttgtcagctttttaaaatgagttatgtattatttctttcatcattctaaacaaaaactcagcctcatactccctccactccccgcccctgcccatcccctggcacaaaaagacaacaaatctcaaagtttttgttccaaggcagaaatgtatttggaaaagggagtattttaatagcattttcagataattgaggatattcctctttgatactacaccaaaacctgatgggtgatttttttttttttttttttttttttaaagacagtgtctcgctgtgtcacccaggctggagtagagtggtgcagtgcctcactgtagctcctgggctcaagtgatcctcccaccttagtctcacgagtagctgagattacaggcatgagacaccatgcctggctaatttttgtatgttttgtagagatgaagttttgccgtgtttcacaggctggtcttgaacgcctgggctgggctcaagtgatccgccggcctccgcctcccaaagtgctgggattacaggcatcagtcacggcccggctgatagtttcatgatgattagtttaagtgaaatctaaagacctcaatcgtgagagagtcttgaggtccttgaaggatccaaaaaaaccacactttgagaacggctgtttttttaaatcattaattcaatttgatcacaaacgtgactaaattgatacctaatggtttattcagactgcatatcatcttggtgcattcaactgaatcagaatcaggttagacaatgtttttttcagcactacagtaaattctgatgtataacagggatgtattaattatagaaaaaagctgatatatatgtatactggaaaggatggtcagagatggtgcagaatacactatttttcactgtacatcatttaggctctatttaaataatatatattttatactttgataaaaagtatgcacatacttcttattaaaataattttgatcaaggatgtcaaatttactatttttagtcagttaaaaaagaacatgcaaaaattctattatagaacaaaataataattcactttcctttacgagttctttagacaaaatcatgtcctttgcaacaacatgaagatggtggccattatcctaagcaaactaacacagtaaaccaaatatttttctcacttataagtgtgagctaaactttgggtacacatggacataaagatgggaacaatagacactggggaatacaagatgggggagaagtgaagaggggcaaagggttgaaaaactacctattgggttctatgcttacttcctgggtgatgggttcaattgtactccaaaccttaccatcatgcaatatacctttgtaaaaaacctgcacatgtaccccagaatctaaaataaaagttgaataaataaataaataatgatgtagtataaaaaaagagttctttggcttatcaagtttatcccctatagacctcttcacaccttttttttttttttttttttgagacagagtttcgctcttgctgcccaggctggagtgcgatggtacgatcttggctcaccgcaacctccgcctcctggattcaagcaattctcctgcctcagcctcccaagtagctgggattacaggcatgctgccaccacacctggctaatttttgtatttttagtagagacggggtttctccatgttggtcaggctggtctcaaacccccgacctcaggtcatccgcctgccttggcctcccaaagtgctgggattacaggtgtgagccaccatgcctggcccacatcttcttgtagtcctaaataccatacgtattcttggagagcattctccaaaccagaaatttgtccaaagtttttcctaacaagaaagctcgcaatgcacacttgtcaggagtctacaggaccataaaacatacgaaagctaacatttgtaactgtcctcatctctactgtgatctagaaaagccctgttttgtttcaagtaaatatagcatgtgctaaatttgtgatacgtgatgaaatggagagtgtttgtaagatctcagggccctttcaccacctaaagtaagacagaaggaggttgagaggagggtttctccagcataaacaatatcccttaatttccagcctttctgacacctctctctgtccactgcagttcaagtatgacccccttttttttttgagatggagtttcactcttggttgcccaggctagagtacaatggtgcgatcttggctcactgcaacctccaccttctgggttcaagcaattctcctgcctcagcctcccaagtagctgggattacaggcgcgtgccaccatgcccagctaatttttgtatttttagtacagacagggttttaccatgacggccaggctggtctcaaactcctgacctcaggtgatcagcctacctcagcctcccaaaatgctgggattacaggcgtgagccactgtgccaggccagtatgacacttttctaccttgtgaatgacttttggtgaagaatctttgctaaatattagtccaactgagtcagctgagcaaagcttcaatgctgaaattttttgaaaaggcataaacaaagttcaagtaacatgaaggcatgtggacataaagaaccagccttaagaaatttccagagaatgggatttaactaccaaataacatgtattataaatatttctggcttgttaggtgaaatgggtttaagttttcctagacagctgcctggcaatcaatgtttctgctaaccagcattaagagctacttttgctatatcatgaacaaagccagtcaagctgtttcaatgaaaaataaacaaatggaaaatgttggctttctatttgcaacttcaactaaatttcattaagatacaatatgcctgagtaagaatcaatcttcatttgtatttactgggcatatgttgatatataattccaattaatttgacttgactttaatactctacaataccctatgatgctactattgtgaccccaatcctaatcctcttgtacagtagttgttttagatatgaggaggattaaagtagtatagagaactgatgaagtgaacatatttgtaaatgggcaaactagcatgcaaacttaaaggtaatgaacatagatatacatatatgcacgcacttgtgtgtatatatttacttatttaatcctcttttgtcaatctcagccaacgttatgttaaataatctgaatctagtagcaaacactcttaattctccttgtaagaaaatgacttacatcatttgttcaaccaaataagcatgattttatttagggagaatgaggctattatataagaaaggtgtgggggtataaaatggatcacttacttttgggataagtacccacatcagtacaacttttttcaaaagatagtgacccattcattttaaattgaaaaccggaattttccagtgtctactaaaagcaccacagattagccgggcatggtggcgtgcgcccggagtcccagctactcagaagactctcttgaacctggaaggcggaggctgcagtgagtggaaaggaagaatggggtatactttgttagctaacaaagaaagatttgtagaagggcaatattttaggataatagccaaagaagatcaaatatcaatgtcctaaattatcaaacttcatcgtattgtttttgcaattaaaattgcaaaccggctgggcgcagtggctcacgcctgtaatcccagcactttgggaggtcaaggcgggtggatcacctgaggtcaggagtttgagaccagcctggccaacatggcaaaacctcgtctctactaaaaatacaaaaattagccgggcatggtggtgggcgcctgtaatcccagcttctcaggaggctgaggcaggagaatcacttgaactcaggaggcggaggttgtggtgagccgagatcacaccactgcactctagcctgggtgacagcatgagactccatctcaaaaaaaaaaaaaaaaaaaaagattgcaaactaagatttaaaaaattacacaccatacaactgtatcatcatttttaaaaagtatatcaggatatacaccaaactttttggccattcattcaacaaatctgagtgcctggagtaaaggcagtaaaagagaaaaagagacagacataatccctgccttcatggagcttagattctgggaaagaaagaaagtaaataggtaaacaaattaattaaataaatatgttctaataggcatacttaaaatgccatattgctggaggttgagaaggggagttaatatgctctttccatataactatgttgactgacttgttccaatgaacatgtattacctgatagtaaagaaaatatggccaggtatggtggctcacacctgtaatcccagcactttgggaggcagaggcgggaggatcacctgagtccaggagttcaagaccagccttggccatatggcgaaaccctgtctctacaaaaaatacaaaaaattagacagcagtggtggcacacacttgtggtcccagctacatgggaggctgaggatcacttgagcccaggaggtggaaattgcatgagccaagatcacgccactggaccccagcctgggcaacagagtgaacccgtctcaaaaaacgaaaaacaaagccccacaaagtagtagttttaaaacatgacaagttatacatgtgtgttatagaaaaattaaaagatatgtgtgaatagaaaataaaatttacctgtcattctaccatcctcatttaaagttatttatgttttgatgtaaatcctgacttccttttatgatagtcatgcatatgaataaacataaatatggaatatgtatgtatatgctgcttaatagacattttccattaatatcagaaacttccttttttttgacggagtctcgctctgtcgctgaggttggagtgcagtggtgcagtcttggctcactgcaacccctgcatcccaggttcaagccattctcatacctaagccccacgagtagctgggattacaggtgggcgccaccacatctggctactttttatatttttagtagacatggggtttcaccgtgctggctaggctggtctcaaactcctgacctcaaatgatctgcccgtctcggcctcccaaagtgctgggattacaggcctgagccactgcacccagcctcttttttttttttttttttgtttgagacggagtctctctctgtcacccaggctggagtgcagtggcgtgatctcggctcattgaaacctccacctcccaagttcaagcgaatctcctgccttagcctcctaaatagctcggattacaggtgcctgccaccgtgcctgcctaatttttgtatttttagtaagggtagggtttcgccctgtttgccatggcggtctcaaactcctgacctcaggccacccgcctcagcatcacaaagtgctgggcttataggcataagccactgtgcctggccggaaacattttttgatgtgtctagttccacaatgctgtttttgaagaacagcattctggtctatggatgtattatactttaaaacattacctactgttggccgggcatggtggctcacgcctgtaatcccagcactttgtgaggccgaggcgggtggatcacctgaggtcaggagcttgagaccagcctggccaacgtggtgaaaccccgtctctactaaaaatatgaaaattagctgggcatggtggcgggtgcctgtaatcccagctacttgggaggctgaggcaggagaatcacttgaacccgggagtcggaggttgcagtgagccgagatcgtgccactgcactccagcctgggcgatggagcaagactcggcctcaaaaaaaaaaaagaaaaaaaaaaattacctactgttgtccaggtgcggtggctcacacctgtaatcccagcactttgagaggccgaggcagacagatcacctgaggttgggagttcaggaccagcctgaccaacatggagaaaccccatctctactaaaaatacaaaattagccaggcatggtggcgcacgcctgtaatctcagctactagggaagctgaggcaggagaatcacgtgaacccagaggcggagattgaggtgagccaagatcatgccattggactccagcctgggcaacaagagcacaactctgtctcaaaaacaaaacaaaaaaacctactgttgcacatttaggttgctacattcttttttccttttatagtattttccacactactgtggaaaactagaaatttaggatataattttagacaaagaatttctgcaaattctattttttattcatattgccaacttgctgttaagattctaccaatttcttcttcctaccacagtgtaacaaagggttattttttcactctttcactgcattttgtggcaaaagtatcttcaactaacaaccatggccacagcaatattaaaaaactaagagtaggttgggcacagtggctcacacctgtaatcccagcactttgggaggccaaggcaggcggatccacttgagttaaaaaaaaaaatccctatatctcatccaaatattagcattagatgaacttcaagtaatctaattttcccagtttttgagaagtagagaaaaatatgaaaccagaaaaaaaaacctctcagtgatgtaatgctttctagatctactgctctctacagtgaaagaagcagaaaagtttttgttttgttctgttttgtttgtttgtttttcttgagagggagtctcgctctgtcgcccaggctgtagtgcagtggcactatctcggctcactgcaacctccgcccctcgggctcaagcaattctcctgcctcagcctcccaagtagctgggattacaggcatgcaccaccacgcccagctattttttgtatttttagtagaaaggggtttcgccatgttggtcaggctaattttgaactcctgacctcagatgatccacccaactcagcctcccaaagcgctgggagaaagaacttatcaatcttgttttctgagctattcttggcacaaagaacttatctatcttgttttctgagctattattacaccagcaaattttgccttttttaatgcttcatttttgccttcttctcacagactgaaaaactggctactacctaagttgagagtcctatgtccctttcacatattaatttatttcttggttggccaggagtttccaaatatagacccatttcacattttataaaatgacatgagatgtcatggagaaaagaaagctgggggctatgtccatcaatagtatgttttgcttggcagaattctaaattatattctggaataaataatggtatgtgttctattttctacagcaactcaaaatatattcaacaaatcgatatctaagtgggccatttaaatttattaacacataacctaccctgttccagaatttgaagaaatgtactggctggattaaagttacaaataagtgagttgtcaggattatatcatttatgttactttgaatgtaaatgagtattcgaatatattaataatagatggtatttctattacaatctacttcacttccactatcagatgccaaatagggagaataagtggattataattcattaagaaaaagataaacaacagagaaagcttttccttttcttgcaaagagctaaattgaactattcactcacagaaataattaacattttacttagttttacattaacaaaatctttgaggactagagacaacaaagtaatataacatttcattttaaagttttagtctcattttaaacgtttttaaaccatattttaaatatgtatttacatctctaatctcttctaataactttctaataactgcttgtatataacagtaactgtttaaaaattccttgagtaagtctgaacttcattatgatgctatctttgacttcccccattatctccaataaagatctaagttgttttgttttcttgtttgcttcaccagtaacagacaaatctcacaaaagagtattaaaattgagtactctttggcactgaaacatgattcaccattctctccatggaaatctttagtaaaaggagaaaaatttgctgggtgtggtggctcacgcttgtaatcccagcactttgggaggccaaggtgggcggatcacctgaggtcaggagttcgagaacagcttggccaacatggtgaaaccccatctctactaaaaatacaaaaaattagccaggcgtggtggtatgcgcctataatcccagctacttgggaggctaaggcaagagaatcgcttgaacccaggaggcggaggttgcaagtgagccaacatcacgccactgtattccagtttgggcaatgagagcgaaactccagccgggggcggcgggggagaaaaaaaaaagagaaaagttcatgtgatctgaagagaaaccagggtatactattctcaaatgtttacttgcaaagctttttgggaagatatttgcaggcattaaaaatgtatcaaagtcagcattcttacctcaaaacagcaccattaaatagcctttttaattgctaacgatataaatcttagactatgctgccattaagataattgtcagttattttattagaaatatacaatatatttttttttagatggagtctagcctaaaatatacaatttttttttttttgagacagtcttgctcagttgcccaggctggagtgcaatggtgcgatctgggctcaatgcaacctccgtctcccgggttcaagcagttctcttgcctcagcctccaaagtagctgggattacaggcaaccgccatcatgcccagctgatttttatatttttgtagaggcagggtttcatcatgttggccaggctggtctcgaactcctgacctcaggtgttctgcctgcctgggcctcccaaagtgctgggattatgggcatggcccctgcaccggccaatatacaattttcaaatgagtgttttattttattttattatttttttgagacagagtctcgctctgttgcccaggctggagtgcagtggcgtgatctccgttcactgcaagctccgcctcccgggttcacgcctttctcccgcctcagcctcccgagtagctgggactacaggcgcccaccaccatgcccggttaattttttgtatttttagtagtaaaatatttgcatttttagtagtagagacagggtttcaccgtgttggccaggatggtctcgatctcctgaccttgtgatccgcctgcctcgcactcccaaagtgctgggattacctccacctctcaggttcaagcgattctcctgcctcagcctcccaagtagctgggattacaggcatgcgtcaccatgcccggctaattttgtatttttagtaaagacagggtttctccatgttggtcaagctggtctcgaactctcaacctcaggtgatccactcacctcggcctcccaaagtgctgggattacaggcgtgagccactgtgcccggcctcaaaggaaaattattatgccttaatttgtgacaatcattttattctctgttagcatatacacaaacattttgttccctctcatttgtgaggtcagaatttatgatgattagtaaataaaaccaagtcaataaccaagaaatggcatcatgattctgtagaatcctgtgacatcagcatctgtgtgccgtgttgcttcacaggttctggctaacttcattctaaccttggaacagaagtaaagaagttaggagcaggggtccttagactctggtgccagggattcctttggccatttagtaaaacttatggaacccttgtcagaataatgttttctttttttaatataattttatttttttttcttaaacaaatagagacagggtttcgccatgctgcccagtctgctcttgaactcctgggctcaagtgatccacccacctcagcctcccaagtgctgggattacagacgtgagccacgtgcccagacagaataatgtttttaaatgcataaaataaaatgcaaagatagaactgtcaaaatactttaattgcaattaacaatgtgcttttaaaaaataaaataagatccagcagtgggtctaataatcacactaattttgaggtagtgataagcttaaacaatttcaagatagctataacagctgcattatggtatgaagtacatgatttctactggtgacaaagtcacaggtactgctaatacaactatggtttgttgcctacactcatatttgaatgaaattccaagttttagttataggttaatgaaaagatataatatttttcccccaaacaagttcacagacccctcgaattcaatagaccttaggggatcaatatgcagaccccaggataaaaatttctcatacaggaacagaagagcaggtcaataaagtacaaacataagttttggtttccaaaactcaataagacaaattacaaaggccctgttacctccaaaatagtctaacacaccacagcagtgtatagactttcattcattcaataatcttcaaaaggtttgtgtaggaagagcaaaatcagaaggaagacatatttttcaatcaatgatcaaatatatagcttacgatatcagtagattttgaggaaattctcctatactaaggctaagtcattgtaattaagtcagattcaacaatatcatgagttgtgattagcaacatgatagtgtagataaccaacagagttggatcttactctgcaggacaaatggtcagtgacacccttcaatggctcagcccatgcagctgcctcactggtgtggtggatgtgaacccttcttatcattatgcatactgtgatcccagaagattgttattgctagacaggtgaggtagctcacacctgtaatcccagcactttgggatgccaaggcaggaggatggcttggggccaggagtttgaggccagcctgggtaacatagtgagaccctatcactaaaaaaatgtttaaataaattagctgagcattatggcccatgcctgtagtcctagctactcaagaggctgaggtggctctgcttgagcccaggagttacaggctgcagtgaaccatgatggtttcactgtactccagcctgggcgacagagtgaatttataaatttataaattataatttatagatttataaaattataatttataaatttagaatgtataaattctatacattctatctttaaaaaaaagattgttattgcattttaatctcttctcaggatgacactaggaaccaaacatgccacctaaactagtccttccattcattgtaaaaatctcctataacactcccttcctgcaaagagaaaaatatataaactaggtagcagtattacaaatgaaaagtggggggttggacgagaaataacaaaagggacaagagattggcaccaactgcatgtggtagggcaggggggcctactaggagaaatattaagaagattcagaggttttaagcctggctaccttcaagaatggtagaatcagaagaaaaaaactaggtttggaggatgaaggaaagttgagaacaggcagagataatgagctttaagtgacatattaagttcaaaatgcccaagaagcaactggaaaagcagatcatcaataagagtgttcaacccctgtccttgaggaacttacaatctggaatccttttatagctaaagatttggatttagtagtgattctactaggtattctctaaaagctgtgggaacagcaaagtcctccaagaaagagcatgaaagaccaaaagaaacgccataaatttaaggacaaaaattttaaatattctaaatactaaaagccatttgaaatgttaacatcaagtgctaaaaacacttttacaacttaaaatagtggccttttaagaggatatacctcaatacatttaaatacatttccagaaaacgacagtgtctcaataacatagcatattgtattaaaacataaactttaacttgtccttcctattcaaactgtacctctctttatagaggtattctagttaaattaaaaataaatggtagaattaaaggcataattatttccacttgcaaaccactagtgaaataatgaaaacaggctattagtgtagtacaaagagggataaccaaatatatgcctcctgaaggaagtacacaccaatatctaggaattatacttgtcctctcccccaacactcccactcggaaatcaaacctgaactaaatttgttcagtcttcaatctagctaccaatttacaagaaatacaaaggatagagggacatattaaactaggacatgttaaatctatacctgagggacatattcatcaacatccaggatgagagaaaccggaggaaaaatggcctggttccttcaacaaatattaggttggtgcaaacataattgcggtttttcaattgccattgaaagtaatggcaaaaaccacaatgacatttgcaccaaccttacaaggaaaatacattacgaggaaaataattaagatgagggaacctatagattaaaaagtttaagagacatcccaaacaaatgtaatatgttaccttgtttggaccccaaatcaaaccaaccaattatttaaaaacaactgaggaatatttgaatactgactggatatttggcgatgttaatttttaaaggtagggtaatggcattgtggttatgactttctcgagagttatctttcagatatctatattgaaataaaacaaatgaaatcatttgtagaatttgcttcacagtaatccagtagggtctggggaaagtagataggggaagagagaaatcgtgtcgctcaactctttgtgttttgaaattttccatacttaactgttcaaaagggaaaaaagaaaaacaccattctcaggggttgccaacaaaaactgaaaacaacagtttgaattttgtctccaagccttacaagctgagcagccctggtctagtcacacaactttttagtgtccctattggttaaatggagacaaacaaataccacctaataaactcgtatttgttcaagccagaaacctgggttatatccttaacgtctctgactttcccagtctcccacatctggtctccaccaaatcctccaccaaatcctgtctgtttctctaccaaatcctgtcttgtccatcactgtggtctcacaccactccaacagcctcctttcagcctgttctccatattgcatccaaagtgatgttcctaaaacacaaaatccaatcaggttatccccagccccactgaaaatcctttttttttttttttttttgaaacagagtcttgctctgtcgcctgagctgagctgaagtgcagtggtgtgatctcagttttcattgcagcctccacctcctgggttcaagctgttctcctgtatcagcctcccaagtagctgggattacagaagcatgccaccatgcctggctaattttttgtatttttaatagagacagggtttcaccatgttggccaggctggtcttgaactcctgacctcaagtgatccacccgccttggcctcccaaagtgttgggattacaggcgtgagccaccagcttgaaaatccttcaactgctttcaatcagcttcaagacaagagcgctcctttaaaatttttttaccctcctttatcccttaaaaatccctttaatttttttaccctccttgattccttaaaatggcttacaaggccctccattttctcatactgtctatctcttcaacttctatctcttcccattctctttgacttttttatgctttagctttggtaaaattcagctcttgcattacaccctgtactcttgagtgtagcttcagtgttcatgtctggaatgttctttccacccatcatcactgtcttgcctggctagctctttcatccttcaagtctcaggttaaacagtatttcctcagagaggtctagccaaattgcttctatactaagttgggtgtcttctcacacctacacaatacagtatttgttcctacaggaacctgtacccaccctattataacagtacctacttgtttgtaaagagtatttgctgtggcaattatatatttatctgttttccagctagactataactctaggagggcaagtggtaaaatttgttcactgctgaatcctaagtctctcatggtgcctggtagccaataacaaattgccgaacatataaaattcacaacaatctggactgttttcctcatacccaagttccatcttcctagtcctcaactgcaacaaaaacaagacagctatgtaggcatttacgcagagatcttaatcttgcataggagtgagcattataaagtgaattgaaaacacgatgggaatgcagaacataaggagctgagaaatctattttcaggctgagataatttgtatccaaatttacaatctaaagaaaaatcaggagtgccaatctaacaaaaatgagtccaaagacacacatagttcccaccaaaccataacaagttttcagacctaagatgttagatcacttaatccctccagccccagtttccttatgtgtaaaacaagggatcctgatcagctggtcattaggatcctttccagggctaatatatgccctaatatttaaaggctaaaacatgtaaactagtgaaatactaatcatttgctttcatcctatagtgatatgacttttttcctttttaatctgtttaaggacattacagtctatcccgttaagcttacaactaaaccttcaaatctattcagctataaaaatcttacaaaatgctcctcagatcattaacttgcatatttaacaatggtaactgcaatctgatgaaacaacagcatctacctaagaccaaaatgaattactgaaatatattcaacttctgtgtaaataataaatcttaccacgtgttttaagtgctaaatatcttgaattgttggtcatttctatggcaatctgaaggcaaagtcgtgccccagggtgtaagacttgaatttatgggtactatttaacacctaactaaaaaactgaagatacatagtctttgcatcacctcactgggctggtggttgggataaaaaaattgttgaaaccagagtaatttttgaaaaaaaaattcaaaacaagttatagtaagttacagtaaataaagtagcttagtaagttacagtaaataaagtagcgtgtaaacattttactgttatcagtagcagcccagtttctaatcagccactggaaacccaaagaaagactaaagtagtaacaagtttgtctcctggtttagattaattacaaactagttttggcaactgcttgttccatcaaatatgtcatgacaaagtaataaaatgttaaaacgcatgctggaaaaaaaaaaagacgtacttggaacaaaaaacttgcatcggaccaagtgtaacgctatcctccagatttctctcaacagggccgccttaagtccatgagtagaagggcgctgcggcggacgctggcagccacaggttgaatgacaaagagcccccgtcagcaccactcccaggagtctgcgggctgccccgtcccctccgcaaagtctactcgaaccctgcagtcacgccttggctgtggggaatgcggctctccgcaccactctcgcaagtcaccaggtggggcaaggatcggcgggccaagaaggttggggcggacaatgtcacgaatcataaataacttctgccccgagtcccttcccttggggcagaagcggccaggagagtctggaggtaccacatgcagcagcctcatgttatcccttttccagatcaaagcatctctcgaggagcctattgaagacttaggggggaagggacttccccaccgtcaccgggcaccacgacccaactcctcggccaggcctgggaccggcatcttagcacggggcccgcggctcggctaagagaggcgctgaccccagcgcctcaaggtctccttcaccagcactgcagtccgaggccacgcggctgcctgtgaccacgatgccctctgctgggccgcctccctccgccggagacaaagtctcccaaccccggaggtcccctccgaccccaccagggcagcgagggcaccgtggggtccgcgccgcgtgccgccggctgttacccaactaaccgttatatgcgcggatcgcagcgccgagc

SEQ ID NO: 919 - DNA, 44506 bp, Homo sapiens
ttatacttgctttacttttattttttcagatttcctttacttacattccttattccctcaccaacagtaatcctcatttttatagaaggtaagagagaagaagtacgcagaggttacagacttgggtccaaagaaaattacagagtccaaactgaggccaagcctgccaatactctcagcagcagttttctcctctaacactcttcctctatctgccatgatgcccaggcatacaaagggagtttttcattgtttccttaaggttaactgctctggatgctctcagttcaaataagatggttttaaaattcccctcctccttgccttacagcaaagaagaggaaaggagaaattcaaatgaaaataaatcatatacacaaatatcaaggttcaaaagctggaggatttaattcaatcaatttagcaaggcccaaaatgaaacctggtaatgaaaatgaagacacagcaatattttcctcaagaaaatagacatttgggagaagaaatgttttcttaaaaaatgtttatttggaaaagtcagcctcttacacaaggttttgtatctatacttttactctgtcaattacagtggtattttaaatgcattgaatataattcattgaatgtctgtatctttctgcctcgatttaagtgatattaggttaaaaaaatatttacagttttcattctggtccaccttccctccttatccttatactgaatccatttctctacttttcaggtaagtgaaaggggtcacaaaatttttaggtttgtgtggagggtaaaaatgcatccagcaattctaagcacaacaattttctgtaaggccttctctgaaaaaagagaaggaattacttattaaaactaagcacacttagcaacttctttcccaatcctatctttattcgtttgcctggtgccaaatttttctggccctttttaatttgcaaaccttaaaaaaaaaaaaacaaaaaaacaaaaacaccaaacacacacatatctcacacatagcactaagctagaagcagatataaatgggaccactgtgaatcaaaggggaaaaattccaggaaaaaaaaattccaatagcttcacagtttaactgaggttttggaaaaacttaagtgaattcagctgatgtttgaaatatctgtctacatttaattagatgtgttgtatttaccaaggaggcacaaatatgtagttctgtagattttaatactaacttttccagtaagaaaaataataccaggtgatttcaaaaagggcagtgatctataaacactcaaaatgcatctttgaacaggggagcagaaatagctaatttaatgaaaacaaaccttaagcactttacttggcttctaataagcatcccaagaaaaggtacctgagaggggttgacaagtacactgtgtctagaacagccaagatgttgccaaagttttatgctttgaatttcctaaatatatagctagcagaaacatatgccagaaatctactgatgctaggaaaatatttttgtcagcattttgtaaaatctctaactttcaaccaatatttctgttcataaatcttccagtgaaaatgtctgaaatatattacatgtaacaatgaagcaagattaattttaaattttagatttgcctcaaacaagttagttgttatttttccttttaacacaacactcgaaatagatgaattcagcaaaaatggtttaagaagttaaggctctctagagttctaaagactaaaacttaaggcacatattataatctttatgacactattaaaagctaagattaaaacaaaacaaaacagaacctacttctttcccccatcctttgctaccaatcattccctcctcaaattcaggctattggtaaggagtcaaacaaaaatcccatcaatgaacaactggtatgatttccacacaaatgtctactatttgcattgagcaccactggtagattacaggccagtagaatattttcagatatcctgggtcatgaactgctcaatttacccttcagccccatggattcagactggactttcctcctccttgggccctccatctgtgtctttctggtccggagattctgctgctttggtaacttcatttggcttcccagcaacatctatactggtctcttcctctttactttcctttttctgctcgtttgctttctgttcttttgccaaaagtcgataattgatgcccatgccaatgaagagatagatacctgaaataattaggacgacgccacatgcccagtatgtgtatttgtagtctccatacatgtcattgagccgacctaaatatgtaaaacaacacaaacagttgtttctaagagtaaacagtttttttttcccccaagcaaagcttaaggatccattcagaaagatgtcaatccaatctttaaagagtcccaaaatgatgaattagtataaggaattgctgaaaattagctgatcctctgtttataatgcatcatggattttaagtggcctttgcatattctgttatttttagtaacttgaaaatagttaactcttggcaaactggaaatggaagagacgtagtgatcacctagagtcaattctcttaatacactatagaaataagtgttgctaaaagaggcttgggagtcttgtccaaggccatagtgctgtcccatttacccaggccaatgctctttctctctcagcatttcccaaagagtattcctgtaaacacttgtccagtgctaaaaatttaaaagcaatatcttacacccattctaagtgcttaatctttataacaggcagattctattatcatcctcactggacagatttaaaaactaaattacagagatgttagctaatttgtccatggtcacaaaactaataagtgaaatgacttggctttaaacctagaaagtctgactcggaagtctgcacccttaagcatgtgctacaaggatactgctttaatgtttcaaaagtcaaatgaattgataaatggcatattattttctcataaaggctttgtgaagtctggtagtaaagaaccctatttaatttgatgtttacaaattttattttggtcatgtaactttcattactgtaaaatttattagcatctcattgaactggtatctctgggaaaattctactctatgcttaaacaggacttaatacaaccaatttaaatatgattccatatggctttctaactcagggcatcattcattcaacaatatttattgagcctttatcatataccaggcactggctcagctaagccctgaggataagggtgaacagaggatccacagttcagtggacaagagatgttaatcaagtaactacacaaactgtgacaagtactaccaggagagtttgaaagaagtggggtcaagaaagctttccttaaagtgtcaacttagctgggatttgcaggataggaattatctaggagaaaggagatgggaattagatccaggcagagaactgtagtgcaaaggcgcaatggtaggagagagcatggtgtgtgaggggaaagaagggccaggttgctggggcacagagagcaggaggccagtggtagaaatgaggctggaaggacagctggggccagcccatgcagtgccttgcaagccacattagggaatttgcttttcaccctgaaagtaatgggaagcaactggagagttttaagaaatcttgaagagttctgaactggagacttcaaggagactgaagaacagctagaactgatacaggtagaccagttaggaggttacagttaggagcagcccaaacaggagacaggagctttggataagggtagtagttgtgatggagaaaaatgggcagatgagaacaagatttagagcataaaaactcatagaacttagtaactcactgggtatgagatggaagaagacagtgatctcaaaaggcagctatggatcttctgttatatactcactcactccccaaatcaaagttcctaaagtatgagtcacatccagaagaagggtcaaattattttttcactatgtgttatgtattgagctattaatttgaaagataaagtattcaataaccttcaggaatagttcccaagttgtaattaattttctagctgtatgattttagccaagttatttcaccttttgaagcctctgttcacttacaaaatggggacttaaaacggtcctacctcatatggacttgtgagatacaacaggagatacaaaatgataaggacagtctctggtacactgtgagcttacatggtagctattattatactactgctactgaaataaactttttttttttttttttgctttttgtgtgtttttaaaaaatttatggatcaggcatggtggctcatgcctgtaatcccagcactttgggaggccaaggcgggtggaccacctgaggttaggagttcaagacgagcctggccaacatggtgaaaccgtctctactaaaaatacaaaaattagctgggcatggtggtgggcgcctgtaatcacagctacttgggaggctgaggcaggagaattgcttgaacccaggaggcagaggttgcagtgagccgagatcgcgccattgcactccagcctgggcaacaagaccaagactgtcttaaaaaaaaaaaaaaaaaaaaaaaaaacttatgtgaaatatacttcatttttaaaatgaaataatcactagcgctttaaagattgggttgtttttctacatgcttttctacactaagcacatcagttttgcgatcagaaaaaaacatattttaggccaggcacagtggctcacacctgttacccagcactttgggaggctgagacaagtggatcgtttgaggtcaggagttagagaccagcctggccaacatggcgaaaccctgtctctattaaagatataaaaattggccaggcatggtggcatgcatctgtaatcccagctaccgggaggctgaggcaggggaatcgcttgaacctgggaggcggaggttgcagtgagctgagatggtgccactgcactccagcctgggcaacagagcaagactccatctcaaaaaaaaagaaaaaacactgacatttgtaacaatatttgatcccccttttgccttgatggttccatttaattagattctatatttgagcaattatgctgtgccaagcattgtcccagcatcaagggtacataaatgagaaagatttattcttacccaaatagctcactaatgtttgctttctgtcagcattcccatcttacatgcttgttttgtaatagacccacattagtagggagatatactatacctaaaagtggtggccccaggaggacaggacagcattccacaatggtcaccaatcccacagcgctggagaacctctggggtccaacaaggtccatcaatgtttcaaacaatacggagctgagccacccgaaggcaaatccaaagaatcccgcatagacacagaatccaacataggtagtggataaaggtgctagcatatgacacactccatttgcaacaacggaagccgcaaagaaatactgaattcgaggtcttattggctttgtgttggctacaagtcccatagatggtcgggctaccatgtcaacaaaagccagaatggaaagaaggaaggcagacttctcactagaataatgctgactcttcccataactactaagaaacaccaaaggtgcaaagagtccaaaaaacatgatcacatttccagagaggtatagcaaaaagcctctgtgggtgaatagggttaagtccaggaactgattaattgtttggaagactgatcgtttctcttgtttagggtgtcttccaataagatctgtatttgcatcatgcagatcttttttcacaccagattttccagctttctcaagggatgctttagacttatctttccctgccttggttggcttgggcccgattggtcgcatgagggctccagcaacacagcagtttagtagcaagcccccaagaattagaaagcttcctctccatccaaagataccgaagaaaacctgattgaggggggccagagtacagaggaacacagggctgcctgccatggccagtccgttggccaatggtcgcctcttgtagaaatacttgccaatcatggtcagagctggattcaagttgaaggcaagcccaagacctgtgaagacaataaataaataaataaataaataaataaataaataaataaataaataataagaggtataaataatggaaggaataggatataaatcctcattattagaggacatgttatgtagtggtttaaagtatgacttctaaaacagacatgggttcaaatctcagtatcagtgcttactggttgcataatctcagacatgtataccctcctatgactgcttcctaatatgtaaaacgggcacaggtcactgttgtgaggaagaaaagatttgttaagcacttagtacccagtgcccagtatgtagtaagcacttaatacatgttatttttattattgttgtttttattatttgaaggtgaataactattttgtctaatctaacaaaatcaccggaaggattattataaccatataagatcattaagtcgacagtagagataaaacaaatttacactagaaaatgcataaggccagctgcagtggctcatgtctataatcccagtgctttgggaagccaaggcggcaggattgattaaggccaggcattcaagaccaccttgggcagcatagcaagacctgtctctacaaaaagtaattcgaaaattagtcaggtatggtagtgtgtgcctgcagtcctagctacttgggcggctaaagctggagtatcacttgagcctagaagtttgaggctatggtgagctatgatcacacaactgcactccatcctgggctacagagaaagaacctgtctcaaaaacccaaaaacgaaagaaataacatatagtacaaaatgatcccttccactatagcaccaaaacttaaaaacaggccaattcctaagactccaattgtgaaactttcctgagagatcagagaatttaaaatacacacaaagttttgggaaaataaaacacaacattgctaagatgccaaggctcctgaaatgaatgtactaatttattttatttatttatttatttatttatttatttatttttgagacagagtcttgctctgccgcccaggctggagtgcagtggcgcgatctcggctcactgcaacctccacctcccgggttcacaccattctcctggctcagcctcccgagtagctgggactacaggcgcccgccaccatgcccggctcattttttttttgtatttttagtagagacggggtttcaccgtattagccaggatggtctcgatctcctgacctcgtgatccacctggctcggcctcccaaagtgctgggattacaggcgtaagccaccgcacccagcctgaatgtactaatttaatgcaatccaatgaaaatgtcagtgaattttactttcggattaaggtaaatgattctaaaggatacttacagaacaaatacagagctactaggaaatttttgatggtgcagaggaaaaagtgggaccaaccagaacaaattatttaaatggctttacaaaagctacagtcattagagcagtgtggccctgtttcaggaaccagtaaaaattcgtcagtgaaagtgcagaaacactatagaaagtccaggaacagagttgaaatacatggaaacatttaatgtaagataaagtagcattttaaattaatagagagaaattattcaataaatagtgctagcaaaagtaatattcaaagaacttcctccctgacctcatagcaaaccattcttacatttgttaataagctctacggtctatgatcccttacattttcacaaatctggttccctgttgttatgcaggtctctacttaaagttgattcttcagtgagccctgaccttcattgcttgcccagttcttccctgtcacaacactcagttaaaggctttatatagcatttatcactacctgatatttttcttatttattaatttatttatgagttgtactgtttgtctcctcctattaaagagtgtaactgcctgacttgttgctctatctctacagcacctaaaatggttcctaacacacatacagttgttgctcaataaatatttcataaataaattaataaaagagcaaatgaaccaactgattaaccatgtgggaacaaatagagttatatttcttttttctcatcttatgtcagatgttttcatccatttggaatttttaaatgtagctgggcgtggtcgctcatgcctgtaattccagcatgttgggaggccgaggcaggcggatcacctgaggtcaggagtttgagaccagcctggccaacatggtgaaaccccgtctctattaaaaacacaaaaattggccaggtgcagtggctcacgcctgtaatcccagcactttgggaggcagcggcaggcggaccatgaggtcaggagtttgagaccagcctgcacaacatagtgaaaccccgtctctactaaaaatacaaaaattagctgggtgtggtagcgggcgcctgtaatcccggctacttgggaggctgcggcaggagaatcgcttgaacccaggaggcggagattgcagtgagccgagatcatgccatagcagtctagcctggcagtgagagtgaaactgtgtctcaaaaaaacaaaacaaaacaaaagaacaacaacaaaaccagatttttaaaatataaaaactaaagtgcagtaaacagaagtggacaaatattttcataatcttggagtagaaaacaactttctcaggatgacatacaagatggaaaccataaaatacgttttgaatacataaaaatttatatgtttaataagggaaaaacattggaaaagactgaattttaaaaatactttttaacaaaattcaacatcagaaggccgggcaaggtgattcacgcctgtaatcccagcactttgggaggccgaggcaggcggatcacaaggtcaggagatcgactatactgactaatgcgatgaaaccccgtctctactaaaaaaaaatacaaaaaattagccaggcgtggtggcgggcacctgcagttccaggtactcaggaggctgaggcaggagaatgacgtgaatccaggaggcggagcttgcagtgagctgagatcgcgccactgcactccagcctgggagacagagcgagactccgtctcaaaaaaaaaaaaaaaagaaaagaaaataaggattaaaaccaagagatactgttctcacgtgttaaactggcaattatttttttaaaaaaggcaatatcccattgttgacaaaagggataatcttggaatctctgatatattgtggtgggataataagtgagtataacttttttggaggacaatttagcatacatatattaaaacaaacacacagcagttccctttctacaaatttatacgaagaatatattcatgttcacaaaactttcaacttaatactgacaaaaatctggttataaaatattagacataatttgatccttttttgctcaaaaaaaggtgtatctgtgcatagaaaaacacatggaaggatatacatagaaatgttaatgatattctttggattgtgaggttatgggtaacttttattcattatgctcatcaacagttcattatcttaatttagtgatttttaaaatggggggaggaattatgaagcgtatcctctacccctcagaaatgttatgtggacattctatcaaattgccactctcgcaccaagttgccacacacattgtatctaccactactggctattcttaggacaaggaatgcaatcattctttcaattcattcactcattcgacaaacaataaatatccattatataatggcaatttctttaaaagtttgcttttctagtacttttatctctagttcttcaaaatgataatcaagtcatttctataagaaaagaatttcactccagagatctgaaagatgaatgcaggtaaatacaaaatagccagccataaactaatgcttccaaatgaatcagtagtaactcacctccaatgactccaatacagacgtatagttgctgtacggtgttacagaaagaagctgcaatcaagccacagcctgacaagcagccaccaacaatcatgactatacgacttccatatttattcaccaggatactgctgataggacctaaaagacaaccaaaaatgtagtaatataaaggaaactgctccctcacatctacacaagtatgaatgacaatgaatgacaaatcctccaaaataaacaagcagcaatgataagaatattgttttctataattacttctgagtcacatgtgtactaaaataaagatgttagaaaacataattaattgtgcaggttctaaatctaaaaatactggatggaattttactaaaatacaaaagacctgaagttatccttaatctttctcttttatggcagggcaggctgaaaacaccttggtaatggatgttcacaaggttcttgatgtatctaggatacgattaacatgtatgtagaaagtggctgggcgcagtagctcacgcctgtaatcccagcactttgggaggctggggcaggtggatcacccgaggtcaggagttcaagaccagcctggccaacatggcgaaaccccgtctcgactaaaaatacaaaaattagccaggcgtggttggcgcgtgcctgtaatcccagctactccgaaggctgaggcaggagaatggcttgaacctgggaggtggaggttgcagtgagccaagattgcgccactgcactccagcctgggcaatagagtgagactctgtctcaaaaaacaaacaaacaaaacaaaaacatgttagtagaaagtatgttctgttttaaatttcagacacacgcagtgataggagacgtataaatgcatctagattttagagtacttgtatattatcataaatgtggtttgtggtgttgtgttttttttgagacggagtctcactctgtcacccaagctggagtgcagtggcctgatctcgcttactgtaagctccgcctcccgggttcatgccattctcttgcctcagcctcctgaaagacagggtgggcgtggtggctcatgcctgtaatcccagcactttgggaggtggatggatcacctgaggtcaggagttcaagaccagcctgaccgacatggagaaacctcatcactactaaaaatacaaaattagctgggcgtggtggcgcatgcctgtaatcccagctactcaggaggctgaggcagaagaatcatttgaatccaggaggtggaggttgcggtgagccattgcactccagcctgggcaacaagagtgaaactccgtctcaaaaacaaacaaacagcaatccctaaagccacgcggccgccaactccagggagctgatgcttccaaccactgcacgttgctcccgggctgtcgcagtctcctgttgccgccatcatgtcccggccctccacggtgttgggtgccatggagatggggcgccgtagtcacccgcgccttcctggagcacggccacaccaagatagacacggccttcgtgtacagcgacagccagtccaagaccatcctgggtggcctgaaaattgataccaaggccaatccattgtttgggaactccctgaaacctgacagtctccggttccagctggagacgtcactgaagtggctgcagtgtccccgagtggacctcttctacctgctcaggccagaccacagcaccccggtggaagagacactgagtgcctgccaccagctgcaccaggagggcaagttcctggatcttggcctctccaactatgccacctgggaagtggccaagatctgtaacctctgcaagagcaatggctggaccctgcccactgtgtaccagggcatgtacaacgccaccacccagcaggtgaaaacggagctcttcccctgcctcaggcactctggactgaggttctatgccttcaaccctctggctggggacctgctgactggcaagtacaagtataaggacaaggacaggaaacagcccatgggccgcttctttgggactcaatgggcagagatctacaggaatcgcttctggaagaagcaccacttcgatggcattgccctggtagagaaggccctgcaggccgcgtatggcgccagcgcccccagcatgacctcggctgccctctggtggatgtaccaccactcacagctgcagggtgcccacggggacgcagtcatcctgggcatgtccagcttggagcagttggagcagaacttggcagcggcagaggaagggcccctggagccagatgttgtggaggcctttaatcaagcctggcaattggttgctcacgaatgtcccaactacttccactaggcccatcgtttctcaggttgcccaaggctcttctgtaacctcttttgtttctcacactttctttaatttagaagtgcctcagtaaattcttagggatggaagtatttggacaaaaacctaacagtaaagtcaccaccaaatgaagaatgaaacctcctggggtgctgtgtgttagtctgtttgcattgctataaaagaatacctgagaccgggtcatttataaagaaaacaaacaaacaaaaacaacaacaacaaaaaaaagaaaaaagacaaaaatgcatgatcattttttccaagtttaagtagtgttgcaattaggtaatcttgattaaaaaagaaaaagttcctagttacatccaaattcaggtactaaaccaaatatatctttcaggggccaggtatggtggtggtgcatgcctgtagtcccagctactcgggaggctgaggcgaagaatcacttgaacctgggaggcagaagttgcagtgagatgagatcgtgcctgggcaacagagtgaggttctgtctcaaaaaacaaacaaacaaaaaaaacccacccaaatatatccttcagaattacttggttccatgcctatattattaagtttcatggtagtacaattgtgaaaaaaaatgcttgcaggataagattaaatcagataacagtcaacacaacgtgggtgtaacaactcaagagaataggaaatagtattatccaagaaaaccagacatttcctcagctaactatatgcatataaaaatcagcatttctagtatgtgagaaaaggaaccaaatgaaaagcattataagaaacaagaaaatattttatgcatttcatgtatcagttttttgcgaccagtctccctctgtggctggagtgcagtagcgcaatcacagctcactgcagacccaacctcctaggctcaagtgatactgccaccactgcctccaaaagtgctgggattataggtgtaagccaccatgactgacctatgtatcagtttttgagaagaggaatcaaatgtcaagtggcctttcttttttttttaaatttgagacaaggtgttgttctgtcacccaggctggaatgcagtggtactatcagggttcactgcagcctcgacctcctgggctcattcaatctgcctgcccagcctcccgagtagctgggacttcaggtgcatgccaccgtgccgggctaatttttgtattttttgtagagacagggttttaccatgttgcccaggttggtcttgtaatcccggactcaagtgatccacctacctaggcctcccaaagtgctgggattataggtgtgagccaccgtgcctggccttctcttcttacttgctataaataggtataatctgtaatttgccttttccaaatttcaaaatcttaattacaagaaagtcttatccaaacatagagtctatttctaaaaacacatattgaatgtacatatattcagaatatactaatgatcacatattggcatattctatttccataaatactatgaaaaatacttcagttacttatagtctagttttactattcagagttgcggtacagtatactaacattaaaaggataggctgtagccccagggcaccctgttttaagttttggtttcaccatattcttgtctgtttctcagaggttattattaaactactttataggattgttgaaagaataaaaaattaactaatatatgtgaggtgtttagttggtcctcaataaatactggcagtgatcatgatactggtgcacatgcttatttatgctttcacatgacacagacagaaggtgctctctttccatctccatccatatagatatagatgttatgtatgtatatatacataagataagcatgttaagaaggaattaaagcttttgattattcatgtgtttcataggaccaagtctctctaaggtgctacatcaagaactggccgttgccaggcgcagtggctcacgcctgtaatcccagcactttgggatgctgaggcaggtggattacctgaggtcaggagagttcaagaccaacctggccaacaccatctctactaaaaatacaaaaactagctgggcgtagtggtacacacctgcagtcccagctactcaggaggctgaggcaggagaattgcttgaacccaggaggcagaagtttcagtgagcagagatcatgccactgtagtcataagactttgtacagttagaattacaaagataaataccaggctaggcatggtggctcatgcctgtaatcccagcactttgggaggccaaggtgggcagattgtttgagcctaggagttcaagaccagccttggcaacattgcaacaacccatctctacaaaaaatacaaaaattagccgagtgtggtggtgcaagcctgtagtcctagctacttggcagggtgaagggggaggaccgatcacctgaggccagggaggctgaggctacagttagtggtgattgtgccactgcactccagcctgagtgacagagtgagaaaccctatctcaaaataaataaataaataaataaataataaaaaaacttaaaaaaaaaaggatcagcttgggccatagagtgagaccccatctctacttaacaaaaataaaaaattagctgagcatagtagtagggccacctgctactggggaggctgaggcaggaggatggtttgagcctcggtggctgaggctgcagggagacatgatcatgccactgtactcctggtcaacagtgagaccctgtgtcaaaaaaaaaaaaaaaaaaaatcccacaaaacaaagatcagtatcaccacactgttgactctgaggtagaagttaatactgtagaagttaaagtttttgaaatatttaaaattccaaaccacaagtgttaaggtgacccttgtggaactgataaaatttatactttcatgtttaaaaaaaaaaggaaaaacaaataaacaaaccaaaagtaggcaggtaagatctcttccccgcaaaatatactttaacaaccatcactgtatatctctgacccaaagcactaaaaaagaaaacaaaaccaaccatatctcaagacgtattagtgttcagattgtggtccaaatgaacaagttaaaggattatcacagttgtaaaagtgatgaaaactattaggggatatactatttagaaaccaaaccaaacaaaacaacccatttagtaaaaattctgcaacaaggttcatgataggcattttgtcttttagtgttatttcaggaaggataggcctaattagctatcattaaaaatagaaaggggtacggtttataggcctattataatacaaactcaaaaaaatgtgctagttatctcactaattgagtaaggacaaagaaggaactgtttccccaaaggaaagtgtcatgtgcaactaataaaactgacatcacttacttttgatgcaaaacacaagtggctttctcgctctttggtagcacagaatagcaacatgtaaacttctggtttgtagtcaacttaagaagacactgaacacctggagtacctctgggtaatgtttataccaatttcttcaagccatcatagtcaaaacctgattaaaatcctggcagaatggagttcaaagcctacaaaattattggctctcagaagctaatgcccaaagtccattttgatttctctgaacttattaaaaaaaaacactacaattaagcacttaggttctttaatttgatagacaaaataggcctatgttcaaaatgtaaaaggcacaaaaagataaacagtggaaacataagtcttcctaatcctgttcccagtcacccagtttctctttctccatggcagccagttacctgtttcttctggacgatttaattacaggcttaatgaaattatgatttcaactgcttattcctgtttcacgatcatatattactgtctcaaaaggattataaacttctcaaaggaagggatcagtgttttctgtcactcacaatacctagcccagtgctgaatatattcatagaacttgacagatattggttgactctggcaccaccttagcagcctaaggctaagttatttatagttgaaaccaagaatcattacattggctagaaacagtattttagatgatgttaagtgagcaacttacttccaacatttcctttacaatatgccaaaaaaaacaaaagagaaataaatggtaaaatttaagtttagggtgcagctgaaatgcttttaggactcataacatcgcaagtaatacggaggaggttttttcagttaattctaacatcatataaagattttacctgagaatctgaaccatgccattcaggctagtctgatttattttaatcctcccaacatcaatttttaaaaatctatatttatgtttacatttcaagagtccagcagagatcaacaaaaaaaatacagctgtgaatacatcatttttataacagtcttttaaactcaatgatacatcagttggagcaaatcaaggtccctcacaattttctcatttctgttttgaaatactacagtatactatagcaagagttgctattgttatcaggaatgaaaaatgtgactctaaacaccaaactttaagaaataacatttcaaaacatctcactgaataagacttttttttttttttaaagttacctaatacagacactctggctgcttcatgaaaattaaaagagcaggccttaatgggtacttacctccaccatacatgacagccaacattatggaggatatccatgacacttcgctggtggtggcatggaatataccttcaatctctttgaagaagacagtaattgatttgggaaatgcataagagaagccgatggaaatgaaagctccaattaccactgcccagccccagcctccatctgggggggtgtatccaactggacctccaactgctggtggcattttaagtgtagataaattccaaaatgcaggtcaaatccaaatatctgaaagacataaaattaaaatagtatgtcaatataaggcacacctataaaactcttttgtgaaataagaaatatagccaatcgtggtggatcatgcctattagtaatcccagctacttgggaggttgaggcaggaggatcatttgaggccaggagttcaagacagcccgggcaacacagatcctgtgtctaagaaaatttttaaaaaattagctgggtatggtggagcatgcctatagtcccagctactcaggaggctgaggcaggaggatcacttgtactcaggagtttgagaccaccctgggcaacataagtagaccccaactttacaaaaaaattaaaaaattagccagacatggtggtgtgtgtctgtggtcccagttacttgggaggctgaggtgagaggatcacttgaacctgggaggtagtggctgcagggagctgtgattgcaccactgcactgcagcctgggtgaaagagcaagatcctgtctcagtaaatacataaataaattggtaaacaagagacctgatgagattccaggttggtcattgcatccatgtgcagggaggatagcataccccaattccacgggggaagaggctcctgtacttggggacccttccagactttgccctatgtacttcttcatctggctttcacatgtatcctttaaagtatcctttataataaaccagcaaatattagtaagcgtttccctgagttctgtgagccttcctagcaaattaatcaaacccaaggagaggggtagtggtaacccgatttatagctggtgagtcacaagtacaggtgacaagctactacttatgtatgattggcatgtgaagtaagggccttagtcttgtgcaactgaggccttaacctgcgatctaactccaggtagctgaagtcaaaattgaattgaattacgggacacccagttggtgtctcctacaattgcttggtatatgtgggggaaaaaaacccccacacttctggttacagtagtgttttgtgatgtgctgagtgttgactgtgtaagaggaaaaaaaaaagtgtttttctccttcagaactttacacctagctctcgagtaaatgaattttttttaatgttacttatccaatagacattatcttcttttaaagacattatcagaaaaagctttagagtcatagtattgcccataattttttgtagcttaaaggaaaatagcttctcaccacttaagaaatcataattgaaataaatccctttcaataaatcagttaacatcataattccttaaattacttagataaccaaatgccccatttgacttatctgcttaacctaagataacacataatacataacctacaaacattttaggttttttttttttttttttgagacagagtctcactctgtcgcccgggctggagtgcaatagcaagatcttggctcactacaacctctgcctcccaggcggttctcctgcctcagcctcccgagtagctgggactacaggcacacgccatcacctttgactgatttttgtatttttagtagagacggggtttggccatgttggccaggctggtctcgaactcctgacctcaggtgatccacccaccttggcctcccaaagtgctgggattacaggcatgagccaccactcccagccccaatgctacaggttttaatatagcctttataagttttttaccttttccaaaatatattcttccatactcttttcattctcttatttatggctgacttaacatactaggaagtgggtgcctgactcactagatatgtagcaatttacaaaaaaaaagataattctgaacaccgaaaattttcacttaacaggctggggaattatctcagaaaagtttccttttatcttaatagctttgattcaaggtatttttccgcattatatgacaagaaactcctaaacaacagctagccaatacagttaaaatcataaatatatatatgatgtcaaaagatggtagttttaggccaggcgcagtggctcacacctgtaatcccagcactctgggaggcagaggtaggtagatcacctgagatcaggagttcgagaccaaccttatcaatatggtgaaaccccatttctactaaaaatacaaaaattagccaggcatggtggcatgcgactgtagtcccaactactagggaggctcagataggagaatccttgaacccgggaggcggaggttgcagtgagccgggatcatgccactgcactccagtctgggcgacagagtaatactctgtctcaaaaaaaaaaaaaaaaaaaaaaaagtagttttaaatcaaagataactcctttgtcttgaattcacttagtactaatgaataatgaatagcatggttagaaaatgtaaccttctgttacattttctaataagattttaataaggggcaggtgggagtgagcgtttggtggtaggttacctgttttctcatgaaggtctcctttactttaagccaacttccaccctatattacaacttatcctgtatgttagcaggtccatttcaaagtacttccactcagactatattacagcaatgaacacaggtcagagatgacaagttcactcttgactaccatgttctttagtctataacacaaacgcttcttcataatattagcactcaactccaaaacactgttccttccaacccctatgaacacttcaaatacaatttaggacactggacattgcgggagtatgatgaaaatagctccatacaagaagtttcctgaaaagcaaggatatactcaccacttatacacaacattctactataggttctagccagtgcatgcaggcaagaaaaagaaacaaaaggcataaagaatggaaaagaagaaataaaataggccaggtgcagtggctcacacttataattccaatgctttggaagaccaatgtaggagaatcgtttgaggacaaaaattcaagaacagcctggacaacacagcgagaccctacctctacataaattgtttaaaaattgggtgtggtggtacacatctgtagtcctagctacttgggaagctgaggtgggaggatcacttgagcccaggaatttgaggttacagtgacctatgatcatgctgctgcactccagagcaagaccttgtctcggccaggtgcggtggctcacacctgtaatccccagcactttgggaggctgaggcgggcggatcacaaggtaaggaatccaaaaccagcctggccaacatggtgaaaccccgtctctactaaagatacaaaaaattagccaagcatggtggtatgtgctagctacttgggaggctgaggcaggagaatcgcttgaacccaggaggcagaggttgcagtgagccgagatcgcgccattgcactccagcctgggtgacaaggggagactccgtcgcaaaaaaaaaaaaaaaaaaaggcctgtctctaaaaaataaataataaataaagttgtttttattcagatgacagatatgtataaagaaaaccctaaggaacatcaaataagtgaatttgactaggtcttaggatacaacatcaatacacagaaatcaattgtatttctatatattaacaatgaacaatccaaatatgaaaacatttttaaatgctattgtaaatggtaaactatatagaaataaatctcacaaaagatgtatgagatatgtacactgaaaactataatactgagaagttaaaatagataacctatcctctcggactgaaagactcaatatttaaatcaagcaaagatttctgaaggaacataaagaaacaactataaaaaaagttggccgggcgcagtggctcacgcctgtaatcccagcactttgggaggctgaggcgggaggatcacgaggtcaggagtttgagatcaacctggctgtctctactaaaaatacaaaaattagctgggtgtggtggcgtgtgcctgtagtcccagctactcgggaggctgaggcaagagaatcgctcgcttgaacccgggaggcggaggttgcagtgagctgagatcacgccactgcactccagcatggccgacacagcgagactgcgtctcaaaaaaaaaaaaaaaaaagttttaaaattagacttcaaaatatatgcaaaataatatactcaagaaaagacatacccagaacataaaaagaacttgcacaacgatagcaaaaaggcaaatcacccagcttaaaaaaaaagcaaaagatctaaacaggtgcttcaccaaagatacatgaatgataaacaagcacatgtaaagatgctgaatgtcgttggttatttaaaaatgcaaattaaaatcacaatctaatacatacctactaaaaataagacagataattccatgactttgtggggttataaagccaatggaactctcatattgctgatgttacagtcccttggaacacattttggcagttccttataaagttatagatatatttaacatatgagccagccattacagtgtcaggtatcacccaggatttatataaaaaattctctagcagcttgatgcataatagccaaaaactgaaaacaacccaatgtccatcaacaaatgaatggataaacaatggtacagccatataatagaatactactcagcaataaaaaggaactactgatgcatgcgataacatggatgaattttaaaagcgttctgttaagtaggaaaaaaaagctagacaaaagattgtattctatatggtcacatttatattaaattgtagaaaaggcaaaattctagcacaggtcaagcatttctctaatctgaaaatatgaaacccaaaatctgaaactttctgaacaccagcatgatgctcaaagaaaatactcattggaacatttcgaattttggatttttggattagggatgttcaactgcttaagtaactgcaaatattccaaaatctgaaaaaatctgaaatccagaacacattttatcccaggcattttagataagggatagaaaacagatcagtggctaccaggggttggggagaggagactgactgcaaagcagtatgagataacttttagggtaaatggaaatactttattatcatgatggtgacagttactcatcaaagtatacattcaagttagtaaattttattatgtcaattatacctcaataaagctgatcaaaaccaaaagaaagtccaaggacagtgacaaggggaataaaatttgttctgtggcacagggagacaatacagaagcaaaaggagagggcaggcaaacttctttgtcttagttatctagacggttaaaagaaagaggaagaagacaaagatgaggataaagaaaaggagacaagaggaggacagaagattcttctgagaattcacaactcaggccagtgtgagctcatgcttggcagggaattatctgtagaatatctttgttgttcttccagagatacactatatttgattttgctagcaaagatttcccacaaaggcctgccaaacataagctcacaattgtgaacacatcaagaaccaattaaccgtgagcaaacgcaatgccaatctaacacagttggattagacactcaggaactataggcatagcaatatgaatatttaaatgactaaagacataaaacaaggcatttaaaacattagaaaaaactgtgtatttctctaaaattatgtctttctctaaaaaagatccatagaagaagattaattgatttgaaatagaactagaaatggaaagtaaagttagccaggcatggtggcttgtgcctgtaatcccaacactttgggaggccgaggagagtggatcacctgaggtcaggagttcgagaacagcctggccaacatggtgaaaccccatctctactaaaaatacaaaaattagccaggcatggtggcacatgcctgtaattccagctacttgggaggctgaggcaggagaatcgcttgaacctgggaggttgcagtgagctgagattgcactactgtactacagcctggtgacacggcaagactccgcttcaaaaaaaaaagtaaagtcagtgaaattaataacacattaactggaagactggatgtagctatatacagagtcagtaaaccttaagaataggtttgaagagattagtcagaattcaggggagtgtcattctgaagctatgaaagaaaggctttagaatgggaggatctgacatttatctaatgggactttggaaaaagagaatagagaatggagaagagacaactgtctgggtaaatgactaagggttaatgactaaggatattatagacttgatgaacaatataaatcctcagtttgagaaaacaagataaagagaaaaatcttagaagacaactacttagaaaatacagatgactcagctaacaaatattcatactgacaaaacagtcttcctgacaattttgaaaaattctcacctattatgtcttcaaatattgcttctcccccattctctcttttcacttttctcagactccaactggatatgggttggaccttcccatgctatctactctcttactctcccttctatgttgtcatgttatcattcattcctttgtttctctgaacttcattctggatggtttcttctgtactttagctgtgtttggcactaaagattaaggtgatgtaacttaagattaaggtgatgtaacttacaggaaatagctggccagtcctcattttcaaaccaatcaagtaaaagagatttctgttaaacaaaagcacacttcattttaattcaaataaatgtgttgatacacatctctgtgataactatctcatttttataataataattctaacttagagaaggcagccgggggcagtggctcatgcctgtaatccaaacactttgggaggccgaggcgggtggatcacttgaggtcaggagttcgagacctgcctggtcaaaatggtgaaaccccaactctactaaaaatacaaaaattagctgggcatggcggcaggcacctgtaatcccagctacttgggaggctgaggcaggagaattgcttgactctgggagacagaggttgctcagtctaggtgacacagcatgactctgtctcaaaaaaaaaaaaaaaaaaaaaaaaggagaaggcaggagtttgttgtccagatgaaataatttttcaatattctccaatatttctgacctaatctctttttggatttctatcatgggactctctctaggactatgcattctggaattttcccttcctttgagatttttattgcttaggacagtgaaccaccataagaaatgggatgaataagagatacacctctcttttgtagtgggagtaaaaggcttttggataactcaagttggaaaagaaaaagtagagatcaggcatccattctcaagaggtaatttttagctaaggttatctctcaacctgaggatgtgcagaataattccttcaaaaatataacccagtttaaaaattgaaggtctttgtcctagggcatttcatctacctaggatttgggtgagataaaaatatttacaagttaaggtttcctaaaatttctactggaatgaatatgattaaaagctatttaacaggtcagctctgctaacagcaacagcctgaattctaaaatgatgttaaataaaactgctgcaggcattgattttatgagctttttcttcttctaagtatgaaaaaagagaacacttaaaaaatttcaaagaaccactaaaaagattaattcatctcagaatatttacacacatagaacacccacacacagacagtagggctgtttaacacatcaagctctgactagaacagctaatacgtgctggacgtgattaaactttgagtttagctgccagctatgatttgtcccaattaaggcagttacaatttttagtcactaaagcttgcctcatcaagttaataccttattccacagtgccaaaattagatttaaagcctcaagaaactttagaaaaatttaaaaggaaataagaaagtataagaaataagagcatgcaaaatcattatgaaaaacagaacacttcaaaaaaccacacacagattcaacacaattctgccaccacctgacaaatggctatccctgttaacttaaaaatactgatggtacataactgaaaaaaaaaagtcagttaatattatctaagcatattatttccttttttaactggcaaatctcagctataaacagaagggctcattcaaaaagtaaattatgagagcaggcccccttgcagagtactcagagttcccttgagaaagcagagcacatgcattctttgtatgctaaagcccagaggctaaaagggactaaagtttaagattttaatccttacaatatgcacagtagctttcctatcagcttagctattactgcccaagagtgatggggagactaaaaaacaaagtgatagggtaatgagaaaaattcttcattaattcatcttctaaaggatgatagaaaacaataaccctaacttttcttggcaatgacggtgataagaatcaccttctagattttctgatatttttttctcgtaactctcatgaattgtgctagtaaactaatctggaaagccgaagctgtgctccatacctgccatgtccttgccccactcccaaagagaagagctacaaaagccttgaaaatagtattcatcatgttctgtacactttcctcatcaacatttaaaatgaagccactgtcttttcctaaaatgacaatgaccagtttgtgaacttaaaagaagcagaaagtatctaaaaccaataaccttaaaataatctgttaatgagtgtaaactagttttaggtttcaaacacatggaaacattcaaatccagaaaggctgatttcctgaagctattgctgctaaagtagataacctgttgttctctgtaactagccctaatgcagcttcatggtttacagaaccacctgtcccaagttaactcccaagattcaaagtctaggaaacctcactttcgtttcttttccactttgaaactgaatacattgaggaaaccaaaacaatgaaaaaatcaagcagaaagcgctagtcaaagaaggaatgtaactactggatctggctagccaaacactcagcaattacgaaatgcataattttgatcaaactgcatataaagaatcttaaaaaatataaacctgtctctgcaaacttccaactctctttacctaccctgccattctgggaaaatcctatccacattacaagaagttaaatatattatgcttataagagaaattaacaacttgctaactcgaatgcttaaagaaggattttaggcctatctttcagaattctgtttatgataattgattttagaccttgcttttaattcatatttataatccctaaaaaaatcagtattttagttaataatttacagtttaaaattatttacatagaccactctaccaataaatagaaagcatttcttttttttttttttacctttttttcttttttgagatggagtcttgccctgttgcccaggctggagtacaatggcgcgatctcggctcactgcaacctccgccatccggtttcaaacgattctcctgcctcagcctcctcagtagctgggattgcaggcacacgccaccatgcccagtttttttttttttaacttttagtagagacaggttttaccatgttggccaggctggtctcgaactcctgacctcgtgatccacccgcctcagcctcccaaagtgctgggattacaggcgtgagccaccgtgcccggccaacgtatttctttttaaagacagcagatttccaaagaacaagaattggtaaggatgtggagaaaaggaaacccatgtacactgttggagggaatataaactggtgtagctgttatgcaaaacaatatgaagattcttcaaaaaattaaaaatacaattaccatttgatctagcagtcatacttctgggtatatatccaaaggaactgaaatctggatctcaaagagattacctgcacactcccatgttctctgcagcatttttcacaatagccaagatatggaagcaacctaaatgtccatctacggaggaacagattaagaaaatgtggaaaatacatatagttggtcttgtcgcccaggctggagtgcaatggcatgatctcggctcactgcaacctctgcctcccaggttcaagtgattctcctggttcagtctcctgagtagctgggattacaagcatgtgccaccatgccggcctaatttttgtattattagtaggaaggggtttcaccatgttggccaggctggtcttgaactcctgacctcaggtgatccacccacctcggtctcccaaagtattgggattacaggcgttagccaccgtgccctgcatttgtcagctttttaaaatgagttatgtattatttctttcatcattctaaacaaaaactcagcctcatactccctccactccccgcccctgcccatcccctggcacaaaaagacaacaaatctcaaagtttttgttccaaggcagaaatgtatttggaaaagggagtattttaatagcattttcagataattgaggatattcctctttgatactacaccaaaacctgatgggtgatttttttttttttttttttttttttaaagacagtgtctcgctgtgtcacccaggctggagtagagtggtgcagtgcctcactgtagctcctgggctcaagtgatcctcccaccttagtctcacgagtagctgagattacaggcatgagacaccatgcctggctaatttttgtatgttttgtagagatgaagttttgccgtgtttcacaggctggtcttgaacgcctgggctgggctcaagtgatccgccggcctccgcctcccaaagtgctgggattacaggcatcagtcacggcccggctgatagtttcatgatgattagtttaagtgaaatctaaagacctcaatcgtgagagagtcttgaggtccttgaaggatccaaaaaaaccacactttgagaacggctgtttttttaaatcattaattcaatttgatcacaaacgtgactaaattgatacctaatggtttattcagactgcatatcatcttggtgcattcaactgaatcagaatcaggttagacaatgtttttttcagcactacagtaaattctgatgtataacagggatgtattaattatagaaaaaagctgatatatatgtatactggaaaggatggtcagagatggtgcagaatacactatttttcactgtacatcatttaggctctatttaaataatatatattttatactttgataaaaagtatgcacatacttcttattaaaataattttgatcaaggatgtcaaatttactatttttagtcagttaaaaaagaacatgcaaaaattctattatagaacaaaataataattcactttcctttacgagttctttagacaaaatcatgtcctttgcaacaacatgaagatggtggccattatcctaagcaaactaacacagtaaaccaaatatttttctcacttataagtgtgagctaaactttgggtacacatggacataaagatgggaacaatagacactggggaatacaagatgggggagaagtgaagaggggcaaagggttgaaaaactacctattgggttctatgcttacttcctgggtgatgggttcaattgtactccaaaccttaccatcatgcaatatacctttgtaaaaaacctgcacatgtaccccagaatctaaaataaaagttgaataaataaataaataatgatgtagtataaaaaaagagttctttggcttatcaagtttatcccctatagacctcttcacaccttttttttttttttttttttgagacagagtttcgctcttgctgcccaggctggagtgcgatggtacgatcttggctcaccgcaacctccgcctcctggattcaagcaattctcctgcctcagcctcccaagtagctgggattacaggcatgctgccaccacacctggctaatttttgtatttttagtagagacggggtttctccatgttggtcaggctggtctcaaacccccgacctcaggtcatccgcctgccttggcctcccaaagtgctgggattacaggtgtgagccaccatgcctggcccacatcttcttgtagtcctaaataccatacgtattcttggagagcattctccaaaccagaaatttgtccaaagtttttcctaacaagaaagctcgcaatgcacacttgtcaggagtctacaggaccataaaacatacgaaagctaacatttgtaactgtcctcatctctactgtgatctagaaaagccctgttttgtttcaagtaaatatagcatgtgctaaatttgtgatacgtgatgaaatggagagtgtttgtaagatctcagggccctttcaccacctaaagtaagacagaaggaggttgagaggagggtttctccagcataaacaatatcccttaatttccagcctttctgacacctctctctgtccactgcagttcaagtatgacccccttttttttttgagatggagtttcactcttggttgcccaggctagagtacaatggtgcgatcttggctcactgcaacctccaccttctgggttcaagcaattctcctgcctcagcctcccaagtagctgggattacaggcgcgtgccaccatgcccagctaatttttgtatttttagtacagacagggttttaccatgacggccaggctggtctcaaactcctgacctcaggtgatcagcctacctcagcctcccaaaatgctgggattacaggcgtgagccactgtgccaggccagtatgacacttttctaccttgtgaatgacttttggtgaagaatctttgctaaatattagtccaactgagtcagctgagcaaagcttcaatgctgaaattttttgaaaaggcataaacaaagttcaagtaacatgaaggcatgtggacataaagaaccagccttaagaaatttccagagaatgggatttaactaccaaataacatgtattataaatatttctggcttgttaggtgaaatgggtttaagttttcctagacagctgcctggcaatcaatgtttctgctaaccagcattaagagctacttttgctatatcatgaacaaagccagtcaagctgtttcaatgaaaaataaacaaatggaaaatgttggctttctatttgcaacttcaactaaatttcattaagatacaatatgcctgagtaagaatcaatcttcatttgtatttactgggcatatgttgatatataattccaattaatttgacttgactttaatactctacaataccctatgatgctactattgtgaccccaatcctaatcctcttgtacagtagttgttttagatatgaggaggattaaagtagtatagagaactgatgaagtgaacatatttgtaaatgggcaaactagcatgcaaacttaaaggtaatgaacatagatatacatatatgcacgcacttgtgtgtatatatttacttatttaatcctcttttgtcaatctcagccaacgttatgttaaataatctgaatctagtagcaaacactcttaattctccttgtaagaaaatgacttacatcatttgttcaaccaaataagcatgattttatttagggagaatgaggctattatataagaaaggtgtgggggtataaaatggatcacttacttttgggataagtacccacatcagtacaacttttttcaaaagatagtgacccattcattttaaattgaaaaccggaattttccagtgtctactaaaagcaccacagattagccgggcatggtggcgtgcgcccggagtcccagctactcagaagactctcttgaacctggaaggcggaggctgcagtgagtggaaaggaagaatggggtatactttgttagctaacaaagaaagatttgtagaagggcaatattttaggataatagccaaagaagatcaaatatcaatgtcctaaattatcaaacttcatcgtattgtttttgcaattaaaattgcaaaccggctgggcgcagtggctcacgcctgtaatcccagcactttgggaggtcaaggcgggtggatcacctgaggtcaggagtttgagaccagcctggccaacatggcaaaacctcgtctctactaaaaatacaaaaattagccgggcatggtggtgggcgcctgtaatcccagcttctcaggaggctgaggcaggagaatcacttgaactcaggaggcggaggttgtggtgagccgagatcacaccactgcactctagcctgggtgacagcatgagactccatctcaaaaaaaaaaaaaaaaaaaaagattgcaaactaagatttaaaaaattacacaccatacaactgtatcatcatttttaaaaagtatatcaggatatacaccaaactttttggccattcattcaacaaatctgagtgcctggagtaaaggcagtaaaagagaaaaagagacagacataatccctgccttcatggagcttagattctgggaaagaaagaaagtaaataggtaaacaaattaattaaataaatatgttctaataggcatacttaaaatgccatattgctggaggttgagaaggggagttaatatgctctttccatataactatgttgactgacttgttccaatgaacatgtattacctgatagtaaagaaaatatggccaggtatggtggctcacacctgtaatcccagcactttgggaggcagaggcgggaggatcacctgagtccaggagttcaagaccagccttggccatatggcgaaaccctgtctctacaaaaaatacaaaaaattagacagcagtggtggcacacacttgtggtcccagctacatgggaggctgaggatcacttgagcccaggaggtggaaattgcatgagccaagatcacgccactggaccccagcctgggcaacagagtgaacccgtctcaaaaaacgaaaaacaaagccccacaaagtagtagttttaaaacatgacaagttatacatgtgtgttatagaaaaattaaaagatatgtgtgaatagaaaataaaatttacctgtcattctaccatcctcatttaaagttatttatgttttgatgtaaatcctgacttccttttatgatagtcatgcatatgaataaacataaatatggaatatgtatgtatatgctgcttaatagacattttccattaatatcagaaacttccttttttttgacggagtctcgctctgtcgctgaggttggagtgcagtggtgcagtcttggctcactgcaacccctgcatcccaggttcaagccattctcatacctaagccccacgagtagctgggattacaggtgggcgccaccacatctggctactttttatatttttagtagacatggggtttcaccgtgctggctaggctggtctcaaactcctgacctcaaatgatctgcccgtctcggcctcccaaagtgctgggattacaggcctgagccactgcacccagcctcttttttttttttttttttgtttgagacggagtctctctctgtcacccaggctggagtgcagtggcgtgatctcggctcattgaaacctccacctcccaagttcaagcgaatctcctgccttagcctcctaaatagctcggattacaggtgcctgccaccgtgcctgcctaatttttgtatttttagtaagggtagggtttcgccctgtttgccatggcggtctcaaactcctgacctcaggccacccgcctcagcatcacaaagtgctgggcttataggcataagccactgtgcctggccggaaacattttttgatgtgtctagttccacaatgctgtttttgaagaacagcattctggtctatggatgtattatactttaaaacattacctactgttggccgggcatggtggctcacgcctgtaatcccagcactttgtgaggccgaggcgggtggatcacctgaggtcaggagcttgagaccagcctggccaacgtggtgaaaccccgtctctactaaaaatatgaaaattagctgggcatggtggcgggtgcctgtaatcccagctacttgggaggctgaggcaggagaatcacttgaacccgggagtcggaggttgcagtgagccgagatcgtgccactgcactccagcctgggcgatggagcaagactcggcctcaaaaaaaaaaaagaaaaaaaaaaattacctactgttgtccaggtgcggtggctcacacctgtaatcccagcactttgagaggccgaggcagacagatcacctgaggttgggagttcaggaccagcctgaccaacatggagaaaccccatctctactaaaaatacaaaattagccaggcatggtggcgcacgcctgtaatctcagctactagggaagctgaggcaggagaatcacgtgaacccagaggcggagattgaggtgagccaagatcatgccattggactccagcctgggcaacaagagcacaactctgtctcaaaaacaaaacaaaaaaacctactgttgcacatttaggttgctacattcttttttccttttatagtattttccacactactgtggaaaactagaaatttaggatataattttagacaaagaatttctgcaaattctattttttattcatattgccaacttgctgttaagattctaccaatttcttcttcctaccacagtgtaacaaagggttattttttcactctttcactgcattttgtggcaaaagtatcttcaactaacaaccatggccacagcaatattaaaaaactaagagtaggttgggcacagtggctcacacctgtaatcccagcactttgggaggccaaggcaggcggatccacttgagttaaaaaaaaaaatccctatatctcatccaaatattagcattagatgaacttcaagtaatctaattttcccagtttttgagaagtagagaaaaatatgaaaccagaaaaaaaaacctctcagtgatgtaatgctttctagatctactgctctctacagtgaaagaagcagaaaagtttttgttttgttctgttttgtttgtttgtttttcttgagagggagtctcgctctgtcgcccaggctgtagtgcagtggcactatctcggctcactgcaacctccgcccctcgggctcaagcaattctcctgcctcagcctcccaagtagctgggattacaggcatgcaccaccacgcccagctattttttgtatttttagtagaaaggggtttcgccatgttggtcaggctaattttgaactcctgacctcagatgatccacccaactcagcctcccaaagcgctgggagaaagaacttatcaatcttgttttctgagctattcttggcacaaagaacttatctatcttgttttctgagctattattacaccagcaaattttgccttttttaatgcttcatttttgccttcttctcacagactgaaaaactggctactacctaagttgagagtcctatgtccctttcacatattaatttatttcttggttggccaggagtttccaaatatagacccatttcacattttataaaatgacatgagatgtcatggagaaaagaaagctgggggctatgtccatcaatagtatgttttgcttggcagaattctaaattatattctggaataaataatggtatgtgttctattttctacagcaactcaaaatatattcaacaaatcgatatctaagtgggccatttaaatttattaacacataacctaccctgttccagaatttgaagaaatgtactggctggattaaagttacaaataagtgagttgtcaggattatatcatttatgttactttgaatgtaaatgagtattcgaatatattaataatagatggtatttctattacaatctacttcacttccactatcagatgccaaatagggagaataagtggattataattcattaagaaaaagataaacaacagagaaagcttttccttttcttgcaaagagctaaattgaactattcactcacagaaataattaacattttacttagttttacattaacaaaatctttgaggactagagacaacaaagtaatataacatttcattttaaagttttagtctcattttaaacgtttttaaaccatattttaaatatgtatttacatctctaatctcttctaataactttctaataactgcttgtatataacagtaactgtttaaaaattccttgagtaagtctgaacttcattatgatgctatctttgacttcccccattatctccaataaagatctaagttgttttgttttcttgtttgcttcaccagtaacagacaaatctcacaaaagagtattaaaattgagtactctttggcactgaaacatgattcaccattctctccatggaaatctttagtaaaaggagaaaaatttgctgggtgtggtggctcacgcttgtaatcccagcactttgggaggccaaggtgggcggatcacctgaggtcaggagttcgagaacagcttggccaacatggtgaaaccccatctctactaaaaatacaaaaaattagccaggcgtggtggtatgcgcctataatcccagctacttgggaggctaaggcaagagaatcgcttgaacccaggaggcggaggttgcaagtgagccaacatcacgccactgtattccagtttgggcaatgagagcgaaactccagccgggggcggcgggggagaaaaaaaaaagagaaaagttcatgtgatctgaagagaaaccagggtatactattctcaaatgtttacttgcaaagctttttgggaagatatttgcaggcattaaaaatgtatcaaagtcagcattcttacctcaaaacagcaccattaaatagcctttttaattgctaacgatataaatcttagactatgctgccattaagataattgtcagttattttattagaaatatacaatatatttttttttagatggagtctagcctaaaatatacaatttttttttttttgagacagtcttgctcagttgcccaggctggagtgcaatggtgcgatctgggctcaatgcaacctccgtctcccgggttcaagcagttctcttgcctcagcctccaaagtagctgggattacaggcaaccgccatcatgcccagctgatttttatatttttgtagaggcagggtttcatcatgttggccaggctggtctcgaactcctgacctcaggtgttctgcctgcctgggcctcccaaagtgctgggattatgggcatggcccctgcaccggccaatatacaattttcaaatgagtgttttattttattttattatttttttgagacagagtctcgctctgttgcccaggctggagtgcagtggcgtgatctccgttcactgcaagctccgcctcccgggttcacgcctttctcccgcctcagcctcccgagtagctgggactacaggcgcccaccaccatgcccggttaattttttgtatttttagtagtaaaatatttgcatttttagtagtagagacagggtttcaccgtgttggccaggatggtctcgatctcctgaccttgtgatccgcctgcctcgcactcccaaagtgctgggattacctccacctctcaggttcaagcgattctcctgcctcagcctcccaagtagctgggattacaggcatgcgtcaccatgcccggctaattttgtatttttagtaaagacagggtttctccatgttggtcaagctggtctcgaactctcaacctcaggtgatccactcacctcggcctcccaaagtgctgggattacaggcgtgagccactgtgcccggcctcaaaggaaaattattatgccttaatttgtgacaatcattttattctctgttagcatatacacaaacattttgttccctctcatttgtgaggtcagaatttatgatgattagtaaataaaaccaagtcaataaccaagaaatggcatcatgattctgtagaatcctgtgacatcagcatctgtgtgccgtgttgcttcacaggttctggctaacttcattctaaccttggaacagaagtaaagaagttaggagcaggggtccttagactctggtgccagggattcctttggccatttagtaaaacttatggaacccttgtcagaataatgttttctttttttaatataattttatttttttttcttaaacaaatagagacagggtttcgccatgctgcccagtctgctcttgaactcctgggctcaagtgatccacccacctcagcctcccaagtgctgggattacagacgtgagccacgtgcccagacagaataatgtttttaaatgcataaaataaaatgcaaagatagaactgtcaaaatactttaattgcaattaacaatgtgcttttaaaaaataaaataagatccagcagtgggtctaataatcacactaattttgaggtagtgataagcttaaacaatttcaagatagctataacagctgcattatggtatgaagtacatgatttctactggtgacaaagtcacaggtactgctaatacaactatggtttgttgcctacactcatatttgaatgaaattccaagttttagttataggttaatgaaaagatataatatttttcccccaaacaagttcacagacccctcgaattcaatagaccttaggggatcaatatgcagaccccaggataaaaatttctcatacaggaacagaagagcaggtcaataaagtacaaacataagttttggtttccaaaactcaataagacaaattacaaaggccctgttacctccaaaatagtctaacacaccacagcagtgtatagactttcattcattcaataatcttcaaaaggtttgtgtaggaagagcaaaatcagaaggaagacatatttttcaatcaatgatcaaatatatagcttacgatatcagtagattttgaggaaattctcctatactaaggctaagtcattgtaattaagtcagattcaacaatatcatgagttgtgattagcaacatgatagtgtagataaccaacagagttggatcttactctgcaggacaaatggtcagtgacacccttcaatggctcagcccatgcagctgcctcactggtgtggtggatgtgaacccttcttatcattatgcatactgtgatcccagaagattgttattgctagacaggtgaggtagctcacacctgtaatcccagcactttgggatgccaaggcaggaggatggcttggggccaggagtttgaggccagcctgggtaacatagtgagaccctatcactaaaaaaatgtttaaataaattagctgagcattatggcccatgcctgtagtcctagctactcaagaggctgaggtggctctgcttgagcccaggagttacaggctgcagtgaaccatgatggtttcactgtactccagcctgggcgacagagtgaatttataaatttataaattataatttatagatttataaaattataatttataaatttagaatgtataaattctatacattctatctttaaaaaaaagattgttattgcattttaatctcttctcaggatgacactaggaaccaaacatgccacctaaactagtccttccattcattgtaaaaatctcctataacactcccttcctgcaaagagaaaaatatataaactaggtagcagtattacaaatgaaaagtggggggttggacgagaaataacaaaagggacaagagattggcaccaactgcatgtggtagggcaggggggcctactaggagaaatattaagaagattcagaggttttaagcctggctaccttcaagaatggtagaatcagaagaaaaaaactaggtttggaggatgaaggaaagttgagaacaggcagagataatgagctttaagtgacatattaagttcaaaatgcccaagaagcaactggaaaagcagatcatcaataagagtgttcaacccctgtccttgaggaacttacaatctggaatccttttatagctaaagatttggatttagtagtgattctactaggtattctctaaaagctgtgggaacagcaaagtcctccaagaaagagcatgaaagaccaaaagaaacgccataaatttaaggacaaaaattttaaatattctaaatactaaaagccatttgaaatgttaacatcaagtgctaaaaacacttttacaacttaaaatagtggccttttaagaggatatacctcaatacatttaaatacatttccagaaaacgacagtgtctcaataacatagcatattgtattaaaacataaactttaacttgtccttcctattcaaactgtacctctctttatagaggtattctagttaaattaaaaataaatggtagaattaaaggcataattatttccacttgcaaaccactagtgaaataatgaaaacaggctattagtgtagtacaaagagggataaccaaatatatgcctcctgaaggaagtacacaccaatatctaggaattatacttgtcctctcccccaacactcccactcggaaatcaaacctgaactaaatttgttcagtcttcaatctagctaccaatttacaagaaatacaaaggatagagggacatattaaactaggacatgttaaatctatacctgagggacatattcatcaacatccaggatgagagaaaccggaggaaaaatggcctggttccttcaacaaatattaggttggtgcaaacataattgcggtttttcaattgccattgaaagtaatggcaaaaaccacaatgacatttgcaccaaccttacaaggaaaatacattacgaggaaaataattaagatgagggaacctatagattaaaaagtttaagagacatcccaaacaaatgtaatatgttaccttgtttggaccccaaatcaaaccaaccaattatttaaaaacaactgaggaatatttgaatactgactggatatttggcgatgttaatttttaaaggtagggtaatggcattgtggttatgactttctcgagagttatctttcagatatctatattgaaataaaacaaatgaaatcatttgtagaatttgcttcacagtaatccagtagggtctggggaaagtagataggggaagagagaaatcgtgtcgctcaactctttgtgttttgaaattttccatacttaactgttcaaaagggaaaaaagaaaaacaccattctcaggggttgccaacaaaaactgaaaacaacagtttgaattttgtctccaagccttacaagctgagcagccctggtctagtcacacaactttttagtgtccctattggttaaatggagacaaacaaataccacctaataaactcgtatttgttcaagccagaaacctgggttatatccttaacgtctctgactttcccagtctcccacatctggtctccaccaaatcctccaccaaatcctgtctgtttctctaccaaatcctgtcttgtccatcactgtggtctcacaccactccaacagcctcctttcagcctgttctccatattgcatccaaagtgatgttcctaaaacacaaaatccaatcaggttatccccagccccactgaaaatcctttttttttttttttttttgaaacagagtcttgctctgtcgcctgagctgagctgaagtgcagtggtgtgatctcagttttcattgcagcctccacctcctgggttcaagctgttctcctgtatcagcctcccaagtagctgggattacagaagcatgccaccatgcctggctaattttttgtatttttaatagagacagggtttcaccatgttggccaggctggtcttgaactcctgacctcaagtgatccacccgccttggcctcccaaagtgttgggattacaggcgtgagccaccagcttgaaaatccttcaactgctttcaatcagcttcaagacaagagcgctcctttaaaatttttttaccctcctttatcccttaaaaatccctttaatttttttaccctccttgattccttaaaatggcttacaaggccctccattttctcatactgtctatctcttcaacttctatctcttcccattctctttgacttttttatgctttagctttggtaaaattcagctcttgcattacaccctgtactcttgagtgtagcttcagtgttcatgtctggaatgttctttccacccatcatcactgtcttgcctggctagctctttcatccttcaagtctcaggttaaacagtatttcctcagagaggtctagccaaattgcttctatactaagttgggtgtcttctcacacctacacaatacagtatttgttcctacaggaacctgtacccaccctattataacagtacctacttgtttgtaaagagtatttgctgtggcaattatatatttatctgttttccagctagactataactctaggagggcaagtggtaaaatttgttcactgctgaatcctaagtctctcatggtgcctggtagccaataacaaattgccgaacatataaaattcacaacaatctggactgttttcctcatacccaagttccatcttcctagtcctcaactgcaacaaaaacaagacagctatgtaggcatttacgcagagatcttaatcttgcataggagtgagcattataaagtgaattgaaaacacgatgggaatgcagaacataaggagctgagaaatctattttcaggctgagataatttgtatccaaatttacaatctaaagaaaaatcaggagtgccaatctaacaaaaatgagtccaaagacacacatagttcccaccaaaccataacaagttttcagacctaagatgttagatcacttaatccctccagccccagtttccttatgtgtaaaacaagggatcctgatcagctggtcattaggatcctttccagggctaatatatgccctaatatttaaaggctaaaacatgtaaactagtgaaatactaatcatttgctttcatcctatagtgatatgacttttttcctttttaatctgtttaaggacattacagtctatcccgttaagcttacaactaaaccttcaaatctattcagctataaaaatcttacaaaatgctcctcagatcattaacttgcatatttaacaatggtaactgcaatctgatgaaacaacagcatctacctaagaccaaaatgaattactgaaatatattcaacttctgtgtaaataataaatcttaccacgtgttttaagtgctaaatatcttgaattgttggtcatttctatggcaatctgaaggcaaagtcgtgccccagggtgtaagacttgaatttatgggtactatttaacacctaactaaaaaactgaagatacatagtctttgcatcacctcactgggctggtggttgggataaaaaaattgttgaaaccagagtaatttttgaaaaaaaaattcaaaacaagttatagtaagttacagtaaataaagtagcttagtaagttacagtaaataaagtagcgtgtaaacattttactgttatcagtagcagcccagtttctaatcagccactggaaacccaaagaaagactaaagtagtaacaagtttgtctcctggtttagattaattacaaactagttttggcaactgcttgttccatcaaatatgtcatgacaaagtaataaaatgttaaaacgcatgctggaaaaaaaaaaagacgtacttggaacaaaaaacttgcatcggaccaagtgtaacgctatcctccagatttctctcaacagggccgccttaagtccatgagtagaagggcgctgcggcggacgctggcagccacaggttgaatgacaaagagcccccgtcagcaccactcccaggagtctgcgggctgccccgtcccctccgcaaagtctactcgaaccctgcagtcacgccttggctgtggggaatgcggctctccgcaccactctcgcaagtcaccaggtggggcaaggatcggcgggccaagaaggttggggcggacaatgtcacgaatcataaataacttctgccccgagtcccttcccttggggcagaagcggccaggagagtctggaggtaccacatgcagcagcctcatgttatcccttttccagatcaaagcatctctcgaggagcctattgaagacttaggggggaagggacttccccaccgtcaccgggcaccacgacccaactcctcggccaggcctgggaccggcatcttagcacggggcccgcggctcggctaagagaggcgctgaccccagcgcctcaaggtctccttcaccagcactgcagtccgaggccacgcggctgcctgtgaccacgatgccctctgctgggccgcctccctccgccggagacaaagtctcccaaccccggaggtcccctccgaccccaccagggcagcgagggcaccgtggggtccgcgccgcgtgccgccggctgttacccaactaaccgttatatgcgcggatcgcagcgccgagcgtgtgcgtgacgtggtggcgcaggctggagttccacggggcccagggtccggctcccgtccttcgctcgctgcctcgtttgcttgttccagtacccacgcagctagccagtcacgtcgcagctcaccactttgtctggccgggccagcgaggctgccttataacccgccggggccggagcatgcgcgcagggggcggagtcgtctctcccggccgccgccccctccccgccacacagacatccgaactgcagcccgcgcctccacacgctttcagccgcgcgcgccctct

SEQ ID NO: 920 - DNA, 49919 bp, Homo sapiens; identical to SEQ ID NO: 716

SEQ ID NO: 921 - DNA, 49919 bp, Homo sapiens; identical to SEQ ID NO: 716

SEQ ID NO: 922 - DNA, 49919 bp, Homo sapiens; identical to SEQ ID NO: 716

SEQ ID NO: 923 - DNA, 49916 bp, Homo sapiens; identical to SEQ ID NO: 719

SEQ ID NO: 924 - DNA, 49916 bp, Homo sapiens; identical to SEQ ID NO: 719

SEQ ID NO: 925 - DNA, 4921 bp, Homo sapiens
aatcggctaggagcagcgagcggcgcggctgaggcgcggcggccccgtggagcagcgcagtatggcgggcggggcccgggaggtgctcacactgcagttgggacattttgccggtttcgtgggcgcgcactggtggaaccagcaggtgaggtcagccggcagctgcccccgaggagcccttcgggatctacagtcccgacgttcagccggcctgcctcgtcctctctgcttccccaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtgaggtggtggcagagttagccgatgccccttatttcccttccgcgtgcctagtccttgcgctgccgttatcttcaagaccctcccactttaccgagctccaggaccggagatgaggagctgagcacaacatgccaacactcgaggggcccacgacagttgctcaagagccatttcgggaataggctgctaggccctggagacagtgaggacttgaactgcagcactcctgtcagacccctggatgtggttccccccgcgtcccacagctaatgactaagctgggaaccgaaagatggaatctagattctcctaagccaaggtttttcccccaactagtgtatatcccagaaagcttggaagagccaagtgctggagagatggtgacagcaggttgtcaggtgatcagaggaaggttagctagaggggaagggtgcccaggctttgacctaacattgtctctgttatttctgtacaggtagtttgagctccctaaaagaggaaggtggactctacagggacaaacagttggatgctgcaatagcatggtgtgtaactgatgtatggataagggtggggatcgtgtatgtacgcagaacgctggataactctgatcagagtgcagtttctttgatcaatctccaaactctttcaggcaggggaagctcaccacacacaaagaggaactctatcccaagaacccttatctccaagactttctgagtgcagaggtgagggcctctgtcctgaactttttaacccggtgccacaacctgagggtctccataggggcaggtaaacggggattttaatcattttaaatgtcttagaatgatattttgggaaaaagcactccttttcctaaggactgcgactcggtgaacagaaaggaggctatgcggtgtggccagccaactcaaggaggatgaagcaacctttgcctctaaactgcctggaactaaatgtcgatttttctgacccctcccagggagtgctgagtagtgatggtgtctggagggtcaaatccattcccaatggcaaaggtgagacttctccagatactgatggatgggggcttgggtagagcagaaacatggagaaaggtacatttcctctgcttgtcttcaggttcctcaccactccccaccgctacaactccaaaaccacttatccctacagaggccagcatcagggtctggtcagacttcctcagagtccatctccatccccggagcatctgtatgattcagaagtacaaccacgatgggtatggggaccccagaggctttgaggcaagaaacatgggtccccaccaatgcaggatgaggctcttgaggccatcttccctgcccttccccaggacaagaggctgaggagttgagggaagagatgtaagtcttggatcgtgtttacttgtggcagggaagcaggtcggctggaggcttttggccaaggggaaagtgtcctaaaggaacccaagtaccaggaagagctggaggacaggctgcatttctacgtggaggaatgtgactacttgcaggtagtggcgtggcaatgtgcactccagggtggaagctcttctcatcctgctaactatctttcgtcactcacccccgcccagggcttccagatcctgtgtgacctgcacgatggcttctctggggtaggcgcgaaggcggcagagctgctacaagatgaatattcagggcggggaataataacttggggcctgctacctggtccctaccatcgtggggtgagtggaacttggaggagtaaacattcgaatcccattgggagagtggcttaatgcaaactggtttttttctttacgaggaggcccagagaaacatctatcgtctattaaacacagcttttggtctcgtgcacctgactgctcacagctctcgtctgccccttgtccttgggtgggagcctgggcctgcgacctgagccacctgtcaacttcccttacctgcattatgatgtaagtctcggtgctcttgttctgactgcggcaggctacagggcctcctcatgctcccagtcagtcgctgtctgtactggctctgttcctgaggcccgagcttgaactcagctgtgatgtggcctctcagatcacactgtcctatgcttgtccagcctggggtcaaacatacccctgattcatcccctgggtctctctggtgttaacattctgcctccacacattcttttccaggcccgaggccaagtgcccctcttggtgtcttcttacaggccattctgcccttccactgcagtgccatcctggctacagccctggacacagtcactgttccttatcgcctgtgttcctctccagtttccatggttcatctggctgacatgctgagcttctgtgggaaaaaggtatgaagctttgtgaggggttgggtcagtgctgagaaaatgtcctataacgtgttctcttccttctctttaagtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgagggtatagacagagcatgccacacaaggtgagagctgttggtccttaggagtccttgtcagatttttgtttcatgtccttttccccctaatttctcgggcattctaatgatgttgttccctccccaccccttaaaaaggataaaaagaagggctttgaatatcttgatccagctgatggcctgataacataaaaattcttaagtttcttgggctaggcatggtggctgacgcctgtaatcccagcactttgggaggctgaggtgggcagatcacctgaggccaggaattcgagaccagcctgaccaacatggtgaaccccatctctactaaaaacataaaattagccaggcatggtggcacatgcctgcaatcccagctacttgggaggatgaggcagaagaattgtttgaacctgggaggtggaggttgcagtgagccgagatcacaccattgcactccagtctgggcaacaagagcaaaactctgtctcaaaaagaaaaagaattcttagtttgttattcatgctgccacagactaatggtggttttggctttgttatggcagccagctcaccccagggacacctccaccctctgcccttcatgcatgtaccactggggaagaaatcttggctcagtatttacaacagcagcagcctggagtcatgaggtcagtgtaacggttgctcctgcccttcttgccaaccgcaaccctcccttgacttcttacgcacttaatggctgttctctgcccccacagttcttcccatctgctgctgactccctgcagggtggctcctccttacccccacctcttctcaagctgcagtccaccgggtatggttctggatggttcccccaagggagcaggtatgtaggaggtgaagaaaactgagatttcaagtatgggagaggttttactatctccattcctggattaaaagtgctgaaaaagtccacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctatttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactaccccctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcaca

SEQ ID NO: 926 - DNA, 107463 bp, Homo sapiens
cacagttaaacattcctttattcaccctatggctcccaagaaaagcattcttcctctggagtactggtgtactaaggggacaatacaccaaatttgttgagtttacaatcaagtctactaaggttggacttccttatcagtttggcgagtcccagggcagaataatcatccatctacaggtctctgtttcctctccctccacagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctatttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactaccccctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaacggtgggaaacctaagaaaggaggagggctgtattcactggtcttttttttttgtttttgagacggagtctctctctgttgctgagactggagtgcagtggcactgtgtcagcttactgcaacctccgtctcctgggttcaagcaattctcctgcctcagccttcagagtagctgggattacaggtgcccaccaccacacctgactagtttttatatttttagtagagatggggtttcaccatgttggccaggctggtctcaaattcctgacctcaggtgatccacccacctcggcctcccaaagtgttgggattacaggaatgaaccactgcgcccagcctcactgatgctttgtaacaatgttaacatttatgaagcacaatatactgatttgaaaaatctcttgtttattcctcacagcaaggttgggagagctatgtcattatagataaggaaactcaagaggctaaatgttttgcccaaagtcacacaactcctaaaaacaaaactggaatggaaactggggcttccactttaaaatcctggccgggcgcagtatctcacctattcccagcactttgggaggctgaggcaggtggataacctgaggtcaggagttcaagactagccttgccaacatggtgaaaccccgtgtctactaaaaataaataaattagcctggcatggtggtgggtgcctgtaatcccagctactttgggagaggctgaggcaggacaatcacttgaacctgggaggtggaggttgtagtgagctgagattgtgccactgcactccagcctaggcgacaagtgaaactgcgtctaaaatacataaataaataaaaatttaaaaatcctcaaaatctagtgtcctttctcttctagaaccactaccaccctgatgagtcaagcctttccttagatcaaacctttacaaaaaccacttattatcttggatatcaaaactccttctttggcctttctgtctgttagttggccaccttgacctctttttgccaggtcttcaccccaacccgcacctacctcagcaggggtcttatttcccagctgctgggagatgatgttgaaggtctgtggctgtgccccttgctcctggcacatggtgaggatcacacggtcagcttccctgtaacccaggtatcatgattaaccctagggagccacatggatgtggtctatgctcttttccaaacacacgtcatccacccttacctaccttgtccacaggacaaccttttccccagtggagctgaccttgctgttgttggcacacaccgtagcttctgcggcctttggctgctgctccccctctggacccttggcctgtgttccactgtctttagccaaaccccctctaggggctttgggagaagtctctgaggtgtcaattcctgatggagattcatggacagggcacgtcctgtctcttgtcttcacccgagctctgcttgagggcagccatctctcttgagtgtctggtttcccggacacatgtcttctccctgcatctctggtctttgaggaaacaggactcaggaaggaagcagggggttccacggtaccaggcaatttctcagtttctgatgcatcccagaccagcatcaaagcctctgactcactcactgccttttggccctccctctctttctgaagtctgggggatgccttggggcaggagcgaacctcaggcccaacctggtttctcttaacagtgtacagtacagctccagttgtggggggaaattgaggagtctctggtgaatgaggtggtgggccatccaggaggagccgttctgtaacagtcacttctcgaggggatggcaaagtgctccccactgccaatcctgcttaggaggaaaataaggatctcagggtactgtcaggttcaagatgcacctaagcacgagaaattacctgtggccaggtactgtgcaaaaattctaataaaaaagagggctgggcatggtggctcacacctataatgtccgcactttgggaagccaaagtggtgggactgccaggggtttgagactagcctgggcaatatggtgagactccatctctacaagaaaatataaataataaaagagttgggtggaggtggggggcataatgtcacttatgcaaagatataaagtcctactgccaaagctgagaacggcccagtctttaggatgtagattacactagatttggagacagggggaagggtttttggaataaaacacaagacaatgttgaattgcatgaaatttgtggcattcttaattctgcaagaggagtgaggccatatgatagaaaaagcctgaacagcagaagggcttcctatgggtccatcagtgaaagaggtggtatatccatccctgaaaaggctatttatccaggctcatggaggttcctgtctggagtacaggataacgagactgaggaacagaagggctgcgttggcaaatcactcacctgaaacaggcatctctccctttctggtggtcctgacagtcctgctctgggtggcctcagtgctctcccgctcctctggggcttcctcttccatcatatccttgccctgcccagcttccttagcaccaggcataggactagcctctcggtgggggctgctgcccaccaactcatggggctccttgctcttgtaggatttgctgtcacagacctgcagggatggtcttccgggtcaaaggtgttctgactgcctatgtctttggttggggcccaccaaaggaagaagccctgcctgatgctcatcaagtcaacccacatgcatgtctgctccaacaattttgttgacagagtttcaactgggtgcagtggtacatgcctataaacctagttacttgggaggctaaggtgtgagcatcacttgagcctaagggttcaagatcagcctgggtaacatagtgagactctgtctcaaatgacaaacaaaaagaaaagatagacagagacagggtctcagatgacacagattatcttgcccaggctggagtgcagtggctgtttacacaggcatgaccatggtggtacactatagcctcagactcctgggctcaagtgatcctcccacctgagcctcctgagtgccctgttgcccagctattcctccaaggatttgattttttttttttttaaacacggtctcactctgtcacccaggctggagctcagtggtatcatcatggctcactgcaacctctgcctccctgctccaaggattttaaatggccccgaatagagtattggattccacaactccttctctcaccaagaactgtgtttttcctgccaaccaactccattctagagaaccaggattacttgtagagactattttcacgacagaggtttatttcattttctaatatctgagggaaatattttaactggtattttgtttttccaattccaaaagctttactcacagaattctctttaaaaaacaaaatctatcacgtatttctagcagattccatttattttgcatatgtacacatatgtgtatactgaatgttatttatatatgtgcctttttaggaattcagtaaggtacaattcttggtagcaaacaatcccccagcagctctgataccctcgggacccttgatactttcctcaccttgctgctacagtggctacagctccgccttttgctcttcttcagcttggaatctggacctccttcatggcaggagcaggcacagtccttggccccatctggccattcagtctcctaggagatacttgggcttgattagctgccaagttgtttttttttttttttttttttttgagacagagtctcgctctgtggcccaggctgggttgcagtggcacgatgtcagctcaccgcaacctctgcctcccaggttcaagggattctcctgcctcaggctcctgagtaactgggattacaggtatgcgccaccacacccagctaatttttgtatttttagtagagacagggtttcaccatgttggtcaggctggtctcgaactcctgacctcttgatctgccctccctcagcgtcccaaagtgctaggattacaggcatgagccactgtgcctggccgtatttttggtaccaagagaggaagctaaagttgtgagccatatgaacacaacacagcccaccctctccccatgctttttttttttttttttttttgagataaggtctggctctgtcacccaggctagagtgcagtgtcacattcatggctcactgcaacctctgcctcctgggctcaagtgattttcccacctcagcctcccaagtagctgggactgcgcaccaccacgcctagctaatttttttttttttttttttttgagatggagtctcgctctttctcccaggctggagtgcagtggcgtgatctcagcttagcgcaacttccactccccgggatcaagcgattcccatgtctcagcctcccaagtagctgggattacaggcgcatgccactaagcctaattttttttgtattttcagtgagatgggatttcgccatgttgaccaggctggtttcgaactcctgacctgaagtaatccgcccgccttggccttgcaaagtgctggcattagaggtgtaagccacagcacctagcctatggctaatttttgtatttttagtagagataggaattcgcaatgttactctggctggtcttgaactcctgtcctcaagtgatccacccacctcgacctcccaaaatgctgggattacaggcatgagccaccacgcccggaccccatcctcttttatgtatcaactcctcacatcgcctggggaaatcaatagcccaaactagattaaggcctattatgaatccctgaaacaatccctaaatgacctaaagactgacatatcccaattgccccagatgtttcaagaaatatttaagtcagacataatctgaggcaaaatcactggagagctccatcatgagatataatgtctttgtttctgtctctctgtgacttcagctctcccatctcttccaatccccttcagagagaactttgtacccatggaaagcctactcagtgacactgtttaataaacccaagacgtaagtaagtaccattatcatcccaatttatgatgaagaaactgaaacaaagagaggttaaatacgtttcccaaggtcatacagctactaagaagcagtttctccccagaaaagagaaaaaacgcttggtcaggaaacacgaattaaaaaaaaaaaaaaaaaatactgcttgaagagcagtgacaaccagtagactccacagatggcttacctgaggagttcatatcctagcaccaccacttactaaatatgagaccctgacaacagcctctctgcacttcagttatgtcttctgtaaaatgcaaacaagagcaatctctccataggattactgtgagaattaaatgtgtcaataatccattaaaatacttcccagaatgcctgacactttgtaatacaactaagtattagctgctatcattattattaatatggggaatcttggttctattttatttttttaataacaagctcatcctcaattggctctattttctcacatgagcaaaaatgaaaaaagttgaattaagggtaataactctgagctagacagaaaaggggaagaaacaaatccttctaactagggaatcctggggcccctgcaacaactgcagttttcccaaaggctctgcatgtctgtatcagcctgacctttggtttgttctccgtgatcgtctcagatcctagagcctttgaactagaaaccttgggccatagtaagccacagaaatgttcagtgagaaaacgcaaggcttgattcatgaaacatagataattttcaataacttggcataccttatcatgattttaggccaggcgtagtggctcacacttgtaatcccagcactttgggaggccgaggcgggtggatcacttgaggtaaggagttcgagaccagcctggccaacatagtgaaaatccatctctactaaaaatacaaaaatttgctgggcgtggtggctggcgcctgtctgtaattccagctacttgagaggctgaggtgggagaatcgcttgaatctgggaggtggaggttgcagtgagccaagattacgccactgcactctagtttgggtgacagagcgagattctgtctcaaaaacaaacaaataaacaaagaaaataccttatcatgattttggaccccgatctcttttttcctcttgttctttgaggctgtgggtatcttgggaggctcctcctcttcttccacatcaggcagggccacttcttcaaagccatcaaactgagaaggagttggtgctgctgagcacagacaccaggccaatatccctcccacgtgtggccttcccccttcataaggctacagcagccttaggtcctatacctcatactccttttcctcagtccaattgatctcttcaaagtcacccatccggctagctgctgggcgcaagtggtcaaagaagatagaaaactcatcctgcaggtggtcgtggcccttgaggagctgccacatctgtgtcttgagctgaggagagtcacagagggaaagaggaagtctccagagcctctctaggctgcccttcccaatcaatcccacatacttccatgttctgctttcccagtcaactgggaaacacacagagactctgcctggtaacaaagaatactaaaactttctcttcctccttagctgcctataggggaagggtactaatactggatttgattcctaatgattccactctccactccaccctactgatctccagctagggcactattccaagcagagcaaggaggtaaggcccctcccaggtcccagaacctccttcgctgaacatcccttccagcacatccatggcattcctgagcctgtgaagatcagacaggctccggtttcaggtagcaatccctccctatcccagtgctttatgctttgggtgagcctgaaaagtccttgcctttttcatctcctccaggaagcccatgagcctccagaggcaaaaaggtatggagtaggttggggaaagagacaagggaaaggcctaaggcccggaagacaacaggaagaaagcaggacaggaaagaatacctcggtgatctcctggggaaggcagtctgcacagccttggaggaccttgataatcttctggtggtgtgaggggttctctgcaaagcaaatctccagctgccgaaggaacttgcggctcttctcaaaagcctgctgctcctcaaactaccagagtggaaagtgggcaaaagaggagtcatgatacagctagagcaggacttgagggttctaaggataagaactagtggactaggacacaagagatgacagaaccctggtttaaaattctagtttacaactattgagatctaatttaaaaccctaacctccatccaccttgggccactggtgggtagccacccaaagcaattaagatgtgagcaacagcttcaagagatgtatatatttcaagttgtttgctgttttaaggattgtgaaatcagccaccaaaattcatatgatactttagagtttatattacaaagaactttcaggctgcacaaggtggctcatagctgtaatcccatgttgggaggccaaggcaggaggatcgcttaaggccaggagttcaagaacagcaacatactgagactatgtctctacaaaaaaatttaaaaattaggcaggggccgtggtgtacacctgtagcttgagctacttgggaggctgaggcaggaggatcccaggggcctgtgttgtccaggctcatctcaaactcctgtctacaggccagctgtggtggctgatgcctgtaatcccagcacttcgggaagccgaggtaggcaaatcacctgaggtcaagagttcgagaccagcctgaccaacatggtgaaaccccatctctactaaaaatacataaattagataggtgcggtcatgcatgcctgtaatccctgctacccggaaggctgaggcaggagaatcacttgaacctgggaggcagaggttgcagtaagcagagatcacaccactgcactccagcctgggtgacagagtcagactttgcctcaaaaaacaacaacaataaaacaacaacaacaaaactcctggctacaagggatcctcccaccttagcctcccaaagtgctgggattacagatgccagccactgtgtctggccattgtctctctcttttttgtttttgagacaaggtcttgctcttgtcacccaaactggagtgtagtggagcaatcatggctgagtgaagcctcaacctctcaggctcaagtggtcctcccacctcagccacccaaatagctgggaccaaaggtgtgcaccaccacacccagttagttaatttttttattttatgtaaagatggggtcttgctatgttgtccaggctggcctcccaaagtgctgggataacaggtgtgagccaccatacctggctgacattatctctttaaaaaaattttttggccaagtgtggtggctcacacctgtaatcccagcaatttgggaggtcgaggtgggcagatcacctgaggtctggagttcgagaccagcctgaccaacatggagaaaccccgtctttactaaaaatacaaaattagccaggcgtggtggtggcgcatgcctgtaatcccggctactcgggaggctgaggcaggaaaatcgcttgaacccaggaggcggaggttgcagtgagccgagatcacgccactgcactccagcctgggcaacaagagtgaaactccatctcaaaaaaaaaaaaatttttttttttgttcacgtatacactgattggaacctcataataccagaagagaaaatgggcatcacacattatatgcagaactaccccactgtcatttaaccccaataaaactcttagaataatcccgttcctccctttgttcctatttttatgacgataagtccaggactactgggatatccctcatgtttagcctcctattctgcaacatttcacgttaccataccacagtggccttcccagaccgctgtgtataaaaccacccctctagtttcctttcctgctttatttttctgtaaaacatgatcactataaaacattgtatactatatattttgctgtttatatttatttttataatttatattttatatattatatatatatatatatgatatatatatatatatgttttctggagtatcatctgaatttcctcatgataacgtaagctccacgagggcaggaattttagtcttttgtaattactatattcctagcaattgaggtcaggaattgctaggaattcctgacagttaggaggcacctaacaaatatttgttaaatgaatgtctggcttgataccagtgagaagcagagagcatatgactcacctaaggtgtcctttggcaactataggtaaaaccctctcatttatcatgtaaagaaaatgggagaatgggattggaaagataataccctgaaaagacagaggcttttatcactctgggctaggggatggctgtgtgtctggaaggagctgggagactgaaagagtcttattcaaccccattcaatcccagtctcactctgacccaggagtcccagtgtactttttttccccattcacttactaatccacaggccagagcttgctcaggtaacaggaaagcagcaaagtctttcaacagctgaggccagtcttggagcagaatttgcaggcttttgtagagatctacagccgtccgtctctgggtacttgactcaaattcatagatgacttgaaggaagtcttcatacttgccagggatatgttgtagggcttctcgcacctacacgggaagactttcaatcatcaacaccctttatttgggccacaacaagcaataagggtacaagggagaaggcagggttatggttagagagctccaagaattatccatcagaggctgtgcctccaacagatcttaacatctgactgttaatggaagacacagagcaataggcaaggtaaagatctttttctgggagtgagcaagtgaaaaatcatcttccacgttccacagttctacccacaaaaccaagcaatgcttttctctaggtcacagccctaacctttccttactgattacagccccataatgaaataggtaacatgtgtttgtacatgtatttcagcatgggcgtaatttgagagtaaataatacataagttaggaatgtcagtaaaacattaggagataagaaaaagctatgactatcattgccagtattctgctttccagggggataaaggaatcaggtggttaccaagagaaggacacagttctccaggacactaccaagaagtggttagcttatgtgtggtttttttttttttttttttttttgagacagggtctcattctgttgcccaggatggagtgcactgatgcaatcatggctcactgcagtctcaaccacctgggcccaagtgatcctcccacctcagactcccaaagtacctaggaccacaggcatgcaccaccatgcttagctcactattttttttttatttttgtagagatggaggtctcctgtgttgcccaggcttgtcttgtcttgaactcctggactcaaggatcctcctaccccagcctcccaaagtgctggcattatatgcaagggccacagcgcccagcctggttcattttttttttttttttgagacagagtgtcgccctgtcaccaaggctggagtgcagtggtgcgatctcggctcactgcaaactccgtctcccaggttcaagtgattcttgtgcctcagcctcccccgtagctaggattacaggcgcccaccaccacacccggctaatttttgtattttagtagagacagggtttcaccatgttggtcaggctggtctctaactcctgacctcaggtgatccacccacctcggcctcccaaagtgctgggattataggtgtcagccaccacgcccagctggttcatgtcttaagagcaatgtattttcctgaaatccacttgctggccagtgtacccactatctttcttctcaagccaaaggttctataaaggtccttatcagcgcacccagtaaagtcacaacctcccactgatgatggtggtatcatctttctgccaatctctggtcaacagaaggatgatggcagggtactaacaataaacatacttatgattgaattctatgtctccttgtggttctgtcacagagatcttttgccagaaaagccaagatagaggaatatgaagcctgttgcatagcctgaaaaacagactttatgttgaaaaacatctcccttgaagaagcagccacattcatagagactggcaataacaggaagcagcatttgcctaccctggtcagataagcttgggcaaaggccaagtccttctgctccctgagtggatctcgctcgagaatgtcctcatcatacagcaacagcagcttggaggtgtccttgctggcccgagcccgacttccccgcttgttgcgagctcgatgattgttccggccttttccagcagctttgatgctctctccttgtagcacacatgaaaaggattgtttccctgtccctgcaacctgtgttcttcccattccaccacatgcaccaccccagccaaatcctattcaatattatggagcaattcaaggaaaaggtttttgggaaaatggtatgagaactaagtccgtcaagtcagttctacgcagagtctgcagtgtaactgccttaattgggatgacaacaagataatcagctacttcatattgagaaaggaagtctaaagagcaagtgtggcttctgtagtgcttttgagagactatgtcttgatgaggaacaagcagtgttttctgaaataaacatgggtcttagccccacacatgacagataaggtaacaatcagtttaacaaagtgaactgccaggcacagtggctcacgcctgtaatcccagcactctgggaggccgaggcgggtggatcataaggttaggagttcgataccagcctgaccaacatggtaaaaccccatctctactaaaaatacaaaaattagctgggtgtgggggcagatgcctgtaatcccagctactcaggagggtgaggcaggagaatcgcttgaacctgggaggcagaggttgcagtgagccaagatcgcaccactgcactccagcctgggcgacagagcaagactccgtctcaaaaaaaaaataaaaaaataaaaaaaagaaagaaagtgaacgaagctaatataaatctagcaacggatgagaattgaattaaaaatttctgagtatctgttctccacaaagataccacattaaacatgttttgggggaggggtgttgcagaagagatccagagggtttcctctggaaatcctccacctggtttataagctacccaccctgcacactgtcctctagacaatgaggttaagtgagaatggtccttcagtataggtttgcctagctcacctggtggagttctgctggtctccacttctggagcagtctcaggtgaagcaaaagtaggaggcttctcagcagagtctccaactgcttcatccgtcatttcatcctctttctgcaggctttccattccttctgcttcttcttcctcctcttcttctggctcagagttctcctcctgagaattctcttcttcagactcaccctcctgactcatgcgcctttcagatgccagccaagtcagtttctccattgtttcctgtaaaaccctccaaagagtacttataatggctcttagtggctcatgaattgcaaacaacacaaagctatatcaggataatctgaagttaaacaatggggagcccactacagctgtcctgaggggaattccttgagttatgaaatcccagcaatgggccaggtacagtggctcacgcctgtaatcctgacactttgggaggccgaggtgggtggatcacttgaggccaggagttcaggaccagcctcgccaacatgatgaaaccacgtctctactaaaaatacagaaattagtcaggcatggtggtacatgcctgtaatcccagctacttgggaggttgaggcatgagaattgcttgaacccgggaggtggaggttgcagtgagctgaaattatgccactgcactccaatccgggagacagagtaagactccatctcaaaacaaaaacaaaaacaaacaaaaaaaaaacacagaaaaaaccacacacaaaacaagacaaaaaaaagaaatcccagtgatagctgacattcggcctgacagcaggagaggggaagaagttcccttttacaaacttctgtaacctgaagatagttttcaggctggagtgagatggtgcaatcgtggctcaccgcaacctctgcctccccggttcaagcaattctcctgcctcaacttcctgagtagctgggattacaggcatgtgccactacgcccagctaattttgtatttttagtagggatggagtttcttcatgttggtcaggctggttttgaactcccgacctcaggtgatctgcccgccttggcctcccaaagtgctgggatttataggcgtgagccaccgtgcccagttatttactatttttttttttttttttttttttttttttttgagacagagccttgctctgttgcccaggctggagagcaatgacgtgatctcggctcactgcaacctctgtctctcgggctcaagcaattctcctgcctctgcctcccaagcagcagggattacaggtgtccgccaccatgcctggctaatttttgttatttttaatatagatggggttttaccacgtcggccaggccagtctgaaactcctggccttgtgatccacccacctcagcctcccaaagtgctgggactacaggagtgagccaccaagcccagcctattactattttttaaggcatttaaagtatggtcaggtgattcaatttaatgtgtaaacgagtttaatataataagtaaaatttcatcctttccatctcatttcacctcaactccacaatcatgtcccataatgcattcacaaatcaaatacaaatgattttaggactatccatagtgcagcaagcaagcaggtggcatatcaataagtgatacatattactgagtccacgaaatacttgagaatattctccagctctcacctggagttctgggacagaaagcacagattcctcagaagctgatgacatttcatcttcctcatcttgggtgaggtcatcaaagtcctcttcttcctcttcttctggcccattcttctctcctccagtttctggcccaactggagtccccactgactgaccatcaacactggatgaatcttctggcttccctggggggctactaagcctcacttcaggatccattgaggacaaagcattctttgatgatcctttgttcacatctgtccctgaggttccttcatcagggggctcttgagaagatgaaggggttttagttggctgactcctctcctcttccttctgtaagactgtctgtttcgttacttctccagcactgctcaactcctcgcttggggcaccagtgtccaattccacagcatgttccactttgatgtcatcacaaatatcacgctcaggggatccactgatttcctctctagcttcttcaggttccatcttgacaatttcctctaaatccccaggggtagggttgtttagagactcctggatgccctgagggagcggctccagagcttgcctcccctcctctgttttcacaacggtccagcgacaggcactattctctgacaatccttcttggcactctgcatctgctagtggaggccctgggctatgttccactttcgggaaaacagtagcagagagaggagatagttcctggggctctaatttgggttctaggccctgaaaggcattttccccatcagccacagcacaagcaatgtccacattcacgtgggccttatcttcaggggtggatggtataggaagattcacagaattgccagaaacaattaagggtgagacagaggaggccacaagggactggttcaatggacaggggaaggaagtagggttaaccaagagggtagtgatgggaatagtctggggactctgggccacagccgcattgacaggctggatcatgttacagccaccgccaaggctcacaatcttcacagtggtagcaggaacagtgaagataacagatgcagggtggtggataacaggggcaggtttcatacagggagaggccttgactcctcttctctttgagggtctccgtctcacatatggctttcgaaacttagaaggggcaagggagggcagcattaccttgggcacaggggcagaagagagcaaagtctgggactcagacagagggaagcttgtcctggcctcagggggcacagcaggcagtgctgcaggagactcaaaactctcacctccactgacccccagtggagggacacctggaactgtctgtaaaacagtggctggctgtattgggtgaggaatccggagcaccattttgctcggaggggcttctgaatgagttgatcgggctggtgttttcccagggttgaagctgggctggagagaggggctgggttggataaggaggggcttcaggactgatgaacgcttctgtctccaagccttcctggggaaacgggtggcaactggcttcagtttcaggactacacccttaggcaatagcagtgggtaccgagattcactccccaactccaaattgtctttttctaggcttcgatctgagttgatctcagtggttccagtcatatttcctacctctctagcaccatcagccatgtgccgcagttcttcctggatggatggcagactggcctattggaaacaagaacactctgatccagcatatgtcagaatttgggaaaaagaggcttggcacagtggctcacgcctgtaatcccagcactttgggaggctgaagtgggcagatcacttgaggtcaggagttcaggatgagcctgaccaacacggtgaaaccccgtctctactaaaaatacaaaaattagttgggtgtggtggcatgtgcctgtaatcccagctactcaggaggcggaggcaggagaatcacttgaacctgggaggcagaggttgcgagaagccgagatcgcaccttagcctgggtggacagagcaagactctgtctcaaaaacaaaacaaaacaacaacaaaaaaagaatttgggaaaaacaatagggctttctaggttttagagaccttagacagtctcaaggcatctttccaagaagggtctctctgcatatcaaatctacaaagaccacattctaattatacactttagaaacttctgtgaatttcctttagcaaattattattttacctattattttgaaaatgctgtagaatcacccagagaagggcagaaaagtaagggaagaaaggtgaatcaggaagatttctaaagtcctagttctacaactaaagcattagacgattaaggaagcccttgatattctctcagaactttcagtgaccttctgcctcctacagacttcgaggaagagggctgtacctttaaccagaatgggagccggtgttcttctctctctataggtggcttccactgatgtggctggatctcttcacagcattttcctaggactggcagctgtttggtcttcttataaaacttaacatgaaaaaaatgcgcatgaattacattccttctggaaacactgtcccctgtcaggctggtgaatggggtggtggtggatcaagagaaacacacacacacacacacacacacacacaagaccacatacacaaacatccatgaacgcacatatataaatagcatatgctgaatacttgtacatttcaaattaaactaatctctatttaaatatttcacaattattcaatattttctaactgatgatctccattctggttgccaggaaggggagagtttaggtcacagagagaaaaggaagcagatgctcagagcaatcttatgtaagatttgttcttgatcaacagctgcaaagacaacatcgtaatctataccttggacacatgaaagcttccttttaagcaaatggtggtgtgaaaggcattagaagagaaggggggaaaaaaagagcctgagaaagttcaattttaagagtaaatgaaggttgggcgtggtggttcatgcctataatcccagcactttcggaggtgggcagattacctaaggtcaggagttcaagaccagactggccaacatggcaaaacccctattcctacaaaaatacaaaaattagccaggcatggtggcacgcacctgtaatcccagctactcagcgggctgaggcaggagaattgcttgaacctgggaggtggaggttgaggtgagctgagatcagagacagtgccactgcactccagcctgggtgacacagtgagactccgtctcaaaaaaaaaaaaaaagaataggccaggcgcagtggctcaccttgtaatcccagcactttgggaggttgaggtgggcagatcacgaggtcaggagattgagaccatcctggctaacatggtgaaaccccgtctctactaaaaaatacaaaaaattagccaggcgtggtggctggtgcctgtagtcccagctactcaggaggctcaggcaggagaatggcatgaacctgggaggcggagcttgcagtgagccgagatcacaccactgcactccagcctggatgacacagcaagactccatctcaaaaaaaaaaaaaaaaattgagacaggtctcacttttttgcccaggctggtcttgaactcctgggctcaagtaattctcccaccttggcctcccaaagtgctgggattataggcgtgagccacggccccatttaactcttgaatattcatgtaacacctgtttctcccaacctctgatagcatgtaagatttttcctttggctccaatgttttgaaaattcatgataatatggcttagaatttgtctagtttcatccgtggtgctaaggcacttgataaaccgtattctgctgcagaaaaatctttttccttcacgtttgagttgtgtgtcattttctgtgcacatctttgtactttttgtttgtttctctgcttcttgatctttgagacagagactcctctgtcgcccaggctggagtgcaggggagtgatccacgcttactgaacctctgtctccctagttcaagtgagttttgtgcctcagcctcccgagtggctgggattacaggtgagtggcaccatacctggtcaatttttgtatttttagtagagacggggtttcaccatattgcccaggctggtcttgaactcctggcctcaggtcatctgcctgcctcagcctcccaaagacctgggattacaggcctgagccaccgtgtacggcctcaatttttaaaaatttagaaaaaaattaaaataaaaaatgctactagaatgtgtttcactaaaggaaggaagtaaaacaaaaacacagatgtagaattcaggaaataagaagatccaacacagtaagaggcaaaaagaattcccaggatgatggggaggaaaaagcccaaaacatcagtgcagcaagcccagagagcaacacgcttagagtggaatagtgtcagagggctcaaggagcaattccttcaagatgaaagtgacggaatatctagaaggccagacacgctgaaaggagattaagaaaatttaagtaacctttactgttgacctgggaataattacataataaaatcaagtccagccccatccccctaaaaatgcgattatttactccaagaaaaacaaaatgttcagcaggaaaggcaaggtatcacaataacatagctgtgaagagtatttatacagtccttaaaatcttatagtgtaaaccctgaatacaacctaaccaaaattgtgacataattactagcgaggagattggagagcagaaaatgtgcatgtttgtggtgggagtaagggagtgaggagacaggtaaatcctcagcttccttggcttatggttaatggttaataaataaggcctaaatccaatataccaggaagtagcaattagaggctgagacaggagaatgcctaaggccaaaaattcgagaccagcctgggcaatatagggacactccatttcttaaaaaaaaaaaaaaaaaaaaaaaaaaaaaaaaaaattaataggcaagcatggtggctcatgcatataatccccagctccttgggaggctgaggtgggaggaatgcttgagcccagtagctggagcttacagtgagctatgactgtaccactgtactccagcctgggtagcagagtaagaccctttctcaagaaaaaaacaaaaacaaaacaaaacaaaaggctgggcatagtggctcacgcctgtaatcccaacactttgggaggccaagctgaggcaggcggactgacacatgtcaaaacttcaagaccagtctgggcaacaaagtgacacagcatctccacacaaaataaaataatgagctagccttggtggaacacgcctgtagtccaggatacttggaaggctaaagtggaaggatcacttgaacccaggagtttgaggctacagtgacctatgactgagccaatgcactccaaacaggatgatagagcaagaacccgtctctaaaaacacaacataaatatctaaataaaaaagaagaaaccaggtgcggtggctcatgcctgtaatcccagcaccttgggaggccaaggcgggtggatcacttgaggtcagaggttcaagaccagcctggccaacatggtgaaacctcatctctactgaaaatacaaaaattagccaggtgtggtggtgcatgcctgtaatccaagctacttgggacgctgaggcaggagacaccgaggcaggagaatcgcttgaacctgggaggtaaagactgcagtgagccaagattgcgccactctactcaagcctgagtgacagagcaagagtctgtctaacaacaacaacaacaaaaagcaaataagtggaatactgccagcggaatattgcccaaaaggcaataggggaattaatctagtgtaaagtgggagaaattagctttagataaaagaaggttcctcttttctttgagaataacaagataaaagaatgggtacatattggtgaggtgcccggatggcgcatgcaggaaacactcactttaatgatgttgtcaggagctctgttcatgttgaggttcttgattctcactgtcagttggtgggcagttttgcaggttagaaggtacttgctgattagaggattaggaaactcagttccttcaaaatgcttcagtcctaaagctaacaaactgagaaaggagaataacactaaatctcacttcacagtccttccttctaaagggtctccccagactaacacattttacaatctactctttcatttttttcttgagacaaggtctcacgctgtcacccaggctggagtgcagtggcaccatcgcagctcactgcaacctctacttcctaggctgaagcaattctccagtctcagcctcccaaagtgctgggattacaggcatgagccatggtgtgtggcccaatctaccttttcattttttttcagacagggtcttgctctgttgcccgggttggagagcgggtggcatgattacagcgcactgcagccttgaatgcctgggctcaagcgattcccgtacttcatcctcccaagtatctgtgaccacagacgttcaccaccatgccgggctaatttttttcttccattatttgtagagaccagttctcactatgttgcctgggctaatcttaaactcctggcctcaagcgatcctcctgcctcagcctctcaaagtgctggtattacagttgtaagcccaccatgcctggtcaatctactttttgtaaatctaattcttgtacaagttggtgactactcaacagaaaatttcagatacttagtgagtactgattaagtattatgaataagaataaggccaggcgcaatggctcacgcctgtaatcccagcattttgggatgccgaagcaggcagatcacctgagtcaggagttcgagaccagcctggccaacatggtgaaacctcgtctctactaaaaatacaaaaaatagccaggtgtagtggtaggtgcctgtaatgccagctacttggtcaggagaatcacttgaaaccgggggcgaaggttgcagtgagccgagatcgcaccattgcactccagcctgggtgacaaaagtgaaactctgtttaaaaaaaaaaaatcaaatacttcacaattatgtgggaacataagaaactaggcataaatcattaataaacgtgagatcatgatgagctgtatcatgacgagctgtatactaacaatacaaaggaagttcaaagagaatagaaaggaaggagaataattctaataaaactaatacaaaatgaataggtaccctgtcagacaacttaaaccggcaccaatactaccctctaacaacatatatgatcgtggttacatatacacatatgtgctgataacagtgtggcaatacacacaaagggccataaaaatgttcataatctggtgggtgtggtggctcatgcctgtaatcccagcactttgggaggccaaggtgggaggatgccttgagtccaggagtttgagagatgcctggataacacagagagaccctcatctctacaaaaaaaaaaaaaaaaatttagccatgtatggtggcacacgcctgtggtctcagctgctccgtggaggctgaggtgcaaggatcgcttgatgtcaggagttcaaggctgcagtgagctgtgactgcctgggtgacacagtaagattctgcctctaaataaataaataaataacataaaataaaataaaagcgaacctcctgccttggcctttcaaagtgctgggattacaggtgtgagccaccatgtccggtctaaaatgctttaaaaatgtgtgtgacatctcccaaaaagcagtatttggcactgctagaacaagcacgtcctagagggctctgctcatctatattgcttttccttttgtcttttgtgtccgtgtcttattatacaagtcttacttcccctaaactcctcaaaggaactacatcttctccttgggatgttctgctgttttgatcccccagagtaaacacttacttgtcctcagccttggtgaagacgatcttatcctggggattctttgccttcagggaacacactggaagtaactctggatacatgaaaaccttgcttgtggccagaatccaagccacttgctttggcaaacagggaaattcattcgctataagaaaataaatctcggataaatcaacttctaggacaaaagagggcttcataaaagcctgtgaatgcatttttgcatttaggtaggagctatccttacctaacttgattccctcccatctgcccaccatccccccaaaagtttccagtctttcttaagctaacattatatctaaagggagtcccattcaatggcaataaaagttgactcattctttcttatgtggaacactttattcactaagtaaaacaaacacttaaaaagcacctagtaaaataaggtgctaacaatagcgtatgctcaaaaatgttttacctccttccccccttaaatacttgaaggataagagaccttcaacaatgctttctttcttccagaataagattccaacttctttaatctccctcacaaatctggtattccaaattttacttttatttgattcttacttaagttctcccagattcctcctgaggctgggaacaaaagaaccataaaaggaaggagacaattcagtctcattcatttctctctccctctctcagcctctcactttcaggcacctctgcatttctagagacaaaactactatatccatatttctccttccataagtgttatttttatatccccagaagaaagcaacaggtcaacagatgtgtaagatattattataatttggtgttaaatcaagttttcattaccatttcatatcatttaatatagctgttaaagcagtttgggatccgtgtctatgatataatacacttaaatacaactattttcaacttaacgataagactcagggatttaaaatagaatccaaagacaaacccaaatccagaacaaaccacaactaatttgctaaatcaagaaacaaatcagaagcaaatatttggcttaagtaaatagcaagtattttctaaaaaatactaaactaatgcaaggtagaatctaaacttgcaaatttctttaaaatactgaacatggcaaatgtataatctctaacttatgcctaacttgcaagtcaatatttcattcagaatggagatatcacttatgctgcagtcagtatggtaaataaagttagttgatttttttttttttttttttgagactgagtctcgctctgtcgcccaggctggagtgcaatgatgctatcttggctcactgcaaactctgcctcctgggttcaagcgattctcctgcctcagcctcccgagtagctgggactacaggcgcgtgcccccatgcctggctaatttctgtatttttagtagagacggggtttcactgtgttcgccaggatggtctccatctcctgacattgtgttccccgtgcctcggcctcccaaagtactgggattacaggcgtgagccaccgcgcctggccttagttgatcttaatgaagacagtaaaaagctaaacatgaccaaactttaccacctgactttcatctttaccaggccccagtttatctcgatctgactcctaatacttacccctcatattgctgtagtccaattcttagcactgagcctcagatctctacctcccatattcctatactgtccactgcctccacactttacccaggcccagagattatcatgtaattctagaacttggataatgagtacaaagggaggataaaagagagaaggaagaaattacaaatgtcctgtgtcctccattcctaggcaagtatccttagttatctatgggataagattcccaccacctctcaccgcaagtaaaaacttaaagctgacacatctgtctcctaccagtcttcttgacagttttatgagggctgcagtcaatgctgacatgtgtgctgaagtcttcaatcagctgcatagctcccatcaagttacagggttggaacagggtctgaaacttggggttgtactgatggtgaagggcgatggagctttgagcaaaggttcccagctctttctgggaaaacaggacacaagaaagatttaagacaattccagacaattaataccagtagccttcagaatctaaatgagaagctgaccttcctactacaggataaaaacaggtaaaaatcatcataaagtctttcacaataaactactctgttaagattatgcctgagttcccagatattcagggattgtattcttgttttacttttagacttagtgagaaacactaaggaatatatggtctagctcctgaactagaagtaagattatgaagaatgaggactcattttttttttttttttcgagacggagtttcgctctgtcgcccaggctggagcgtagtggtgcgatcttgactcactgaagtctccacttcctgggctcaagcgattcttctccatctacctcccgagtagctgggattaattacaggcgcccgctaccacgcccggctattttttgtattttaagtagagactggatttcaccatgttggtcaagctgttctcgaactcctgacctcaagtgatccagccacctcagcctaccaaagtgctgagattacaggcacaagtcaccgcacccagccaagaattaggactattacttttattttatttatttatttattttgagactgggtctcactctgctgcccaggcttgagtgcagtggcgcgatctcagctcactgtaaccctcacctcctaggctcaagctatccttccacctctgcctcccaagtagctgagactacaggtacgcaccaccacatctggttaatttttgtattttgtagagacgggctttcggcatgttgccccagctagtctggaactactggggtcatataatctgcctgctttggcttctcaaagtgctgggattacaggcatagccaccgtgcccagtctcaacatctataaaacgaacagtggtaccaaaaacctaagaagttaggttggatctaaagatgaggaggattcaataaaaatatcagaaagacagtattaagaaaattgaatacactccttgtcctttcatgggaatcagtggcttacgttctctcagcaaacacaggaagccttaacagaaagcaggcaaaacaatcaaaaatacccgagagaagaataaatatagattatgatcagtgaataactgagaaataacctgccaagctaatttcatactctagtctttagagttatggatatttggaaacttacaagaaatatcctggtggtagtggcctccggattgaggttggggttgcaggtggcaagaaggtggatttgggtcaagagctgaacgtgctggggatggaaagaaaatgatgaagtgacatgttaccacattgtcatttcaggaatccagagagatcttttttttttttcttcttggagaaaggatctctctctgtcactcaggctgatgtgcagtgatgcaatcatggctccacgccctctcaacttcctgtgctcaagcaatcctcccacctcagcctcctgagtagctgggaccacagatgcatggcaccatgcctggctaatttatttttattttttgcagagacagggtctcactatgttgctcaggttgctctcgaactccctggctcaagcaatcctcccacctcagcctcccaaagtgctgggattacaggtgtgagccaccgtaacccagcccccagagagacaataaccaagatgtttgcaactttatcacatatattttgctttctgaaaggagtatgaaaataacataggatcttggcataaatctctcagacatgttcccttgaacaaaatgacagaaccagaggaagcttaacctcaatccagagggactgaggttagaaaaaggaaaaacaaacctacttctcacagtgaaggttgttaaatttcagaatagattactaaggactctttgaaatctatatttctgaataccattagtgtccttgtgtgctctcttccttgagccataaggcatgaacatgatgacttctcgagctcctaatgatgtgaagatactatggttttaggaggtggtaaggtaactatctctgacttttacaaagctgttaatttctggcctcagagttaggccttggtataatccagtattaacagcagggcgcagtggctcacgcctgtaatcccagcactttaggaggccgaggcgggcggatcacaaggtcaggagttcgagaccagcctggccaatatggtgaaaccctgtctctactaaaaatacaaaaattagctgggtgtggtggtggatgcctgtaatcccagctacttgggaggctgaggcaggagaaatgcttgagcccagaaagcagaggttgaagtgagccgatatcgggccactgcactccaggctgggagacagagccagactctgtctcaaaaaaaaaaatccaatgttaacatgaccaagaaaagtcctacctgctgcatctgctgctggagtctcttcctctgtgctgggtccagaatcagagtctgatgaactttctcactctggggtttaaccttctctacttcctgcagctgtttggctgaagatttcttcatcttcagctgttcaaatagctccttcactgtccgatgttgttcatttaacaggttggccagtggttcctcaaacctattcccaacagggagatgactgaatttgagtgtttccgtaggtccacaacacatccaattcgttccaatgatgagcaaagagcctgaacaattttcattccctactaatcccccatctcactttagccaacagtcaaactctcagccttttacaaatcttttgccaaagtagttagcatgcatcaaatatgatgattctatattacactctatcccattcctctaaaattcctcttctaaataatatacaaataaagaaaaaattaaaatgctaggaacagagaaatatctggataagaaagcagccaaggagctggtgggaactcatcattctcatttcttctctcatttacttgttactcccatcccaggttcagcttgtcccatttccctatccactcaggctgcactgccttgcatttttttttcaaaatttaaatattttttgagacacagtctcgctctgtcgcccaggctggagtgcagtggcacgatctcagctcactgcaacctccgcctccagggttcaagcaattctcctgcctcaccctcccaagtagctgggactataggcacgtgccaccacgcccagctaattttttgtatttttagtagagatgggatttcactgtgttagccaggacggtctccatctcctgacctcatgatccacccatctcggcttcccaaagtgctgggattacaggcgtaagccaccatgcctagccctcaaaattttaattttaagtttcagaatacatgtgcaggacatggaggtttgttacacaggtaaacgtgcaccttggtggtttgctgcacctatcaacccatcaccttggtattaagtgcagctgcattagcagtttatcctgatcctctcccttcccccgctcccccaacaggccccagtgtgtgttgttccccaccctgtgcccatgtgttctcattgttcagctcctacttataagtgagaacatgcagtgttgtttttctgttcttacgttagcttgctgatggcttcacctccatccatgtccctgaaacggacatgatatcatacctttttatggctgtatagtattccctggtgggatactacattttcttatttatctactgctgtaatatcggggattccttgaaatatgataacctgcttgttggccggacgcggtggctcacgcctgtaatcccagcactttgggaggcagaggtgggcggatcacgaggtcaggagatcaagaccatggtgaaaccccgtctctactgaaaatacaaaaaattagctgggcgcagtcgtgggggcctgtagtcccagctactcaggaggctgaggcaggagaatggcgtgaacccagaaggtggagcttgcagtgagccgagatcccgccactgcactccagcctgggcgacagagcaagactctgtctcaaaaaaaaaaaaaaaaaaaaagaaaaaagaaagaaagataacctgcttgttgtagctacataaacagatttttttttcttttgagacggagtctcgctctgacgccaagctggaatgcagtggcatgatctcggctcactgcaacctccgcctcccaggttcaagtgattctcctgcctcagcctcctgagtagctgggactacagacacacgccatcacacccagctaatttttgtatttttagtagagacggggtttcatcatgttggccaggatggtctcgatctcttgacctcatgatccacctgcctcggcctcccaaagtgctggaatcaggcgtaagccaccaggcctggccaacagatcttaccctgactgcatagggtatcagcacatgcttaatcacttagctatcttattctccttttacttcagaactgacatgctgggtttttgaatttttgcttcagccctggaaaaagtctcccaggagggtaggggtgggaagttagggttgggaaccttagaagaggaatttatttatttatttatttatttattgaaatggagtcttgctctgtcgcccaggctggactgcagtggcatgatctcggctcactgcaacctctgtctcctgggttcaagtgattctcctgcctcagcctccagagtagctggtattacaggcacgcatcaccacggccagctaatttttgtatttttttgtagagacagggtttcgccacgttagccaggctagtctcgaaccactgacctaaagtgatccacctgccttggcctcccaaattgctgggattacaggcgtgagccactgcacccagccaggaagaggaatttaaagggctaaaataaaataccttcatggagagcagtagggtaatatttgaaccaaccactcagttctgttcaggtaaactatcattactttagttattttagtatatccttttcctgcttcatgctagaagatttttgacttgttaagaaagcaagccttgccagtcagaatgacaattattaaaaggtcaagaaacagtcgggcgtggtggctcaagccagtaatgccagcaatttgggaggccaaggcaggtggatcactttaggtcagtggttcgagactagcctggctaacatggcgaaaccctgtctctatgaaaaaatacgaaaattagctggccgtggtgatgcgtgcctgtaatcccagctacttgggaggctgaggcaggagaatcacttgaacccgggaggcagaggttgcagtgagccgagatcgcgccactgcactccagcctgggcgatagagcaagactccatttcaaaaaaataaaataaaataaataaataaataaaataaattcctcttctaaggttcctaaccctaacttcccacccctaccctcctgagagactgtttccagggctgaagcaaaaactgaaaaacccagcatgacagttctgaagtaaaaggagaaaaagatacttaagtgattaagcacgtgctgataccctatgcaatcaggataagacctgctgatgtagttacaacaagcaggttatcatatttcaagtaatctccaatattacagcaatagataaataagtgttttcaatagttaatttttaaaagttatcatttatctattggggataaaaatcattctttcttttatagtatttactgtgggtttgggcagcacagggtaaaaacctaaagcctgtgggactgtcttatgcaatcttctgagaactgaaaacctgatcacctgcactactaccactgaaggaacagaagaccagaagcataaaaaagtaggtaatgaaaacatagcctgcacgtagttgtattttttattattattattattattactattatttttttttgagatggagtttcgttcctattgcccaggctggagtgcaatggagtggtctcggctcactgcaacctctgcctcccaggttcaagcaattctccttcctcagcctcccaagtagcggggattacaggcacctgccaacacgtccgactaattttttttgcatttttagtagagacaaggtttcgccatgttggccaagctggtctcgaactcctgacctcaggtgatatgcctgcttcggcatcccaaagtgctgggattacaggtgccagccaccacgcctgatctataattattattattattattattattattttttgagatggagtctttttctctctctcaggatggagtgcagtggcatgatcttggctcattgcaacttctgcgtcctgggttcaagcgattctcctgcctcagcctcctgagtagctgggattacaggcgagtgctaccatgcctggctaatttttttatttttagtagagacggggtttcaccatgttggtcaggctggtctcaaactcctgaccttgtgatccgcctgccttggcctcccaaaatgctgggattactggcgtgagccaccgcacccggcctattattattttttgagagacagtttcactctgttgcccaggctggagtacagtggcacaatctcagctcagtgcaacctccgcctccagggttcaagtgtttctcctgcctcagcctcccaagtagctgggattacaggcgtgtgccaccacacccagctaatttttgtatttttagtagagatggggtttcaccatgttgaccaggctggtctgaactcctgacctaaagtgatctgcctgccttagcctcccaaagtgctgagattacaggtgtgagtcaccacacgtggccttgcacctagttttaataagtattacttggataactgacaagggaagcacagataactcactttcccagggtttttgttttgttcttttttttcctctctcttctttattgtgttttaagaagtttttactatctatggacttacagaatccaggatgctttatttagtcaaagattataacaggtttgcatttgcaactgaaagagaagcagcagctgcccaagtacagtcatgtgccacataatgtttcagtcaataatgaaccacatattcagagatggctccataagattactgtaccttttctatgtttacatacatatgtacttaccattgtgttacaactgcctacaatattcagcagaataacatgctatacaggtttgtggcctgggagcaatatgttataccgtatagcctaggtatgcagtaggctaaaccatctaggtttatccaagtgctttctacacaatgatgaaatcgtttaatgataacatttcacagaatgtatcaccatgagatgatatatgactgtattctactgaataccagaaggtaactgaattctaacaagagttttaaattatttctatactttacaaattttatttattttattttattttatttttttgagacagagtctctctctgtcaagcaggctgtcatctcagctcactgcaacctccgctttccgggttcaagtgagtatcctgcctcagcctcctgagtagctgggattacacacacccgccaccatgcctggctaatttttgtatttttagtagagatggggtttcaccatgttggccaggctggtctcgactcctaacctgaggtgatccccctgcctccgcctcccaaagtgcagggattacaggcatgagccactgcgcccagcctacacttcccaaattttaagaagttacaaagagtcaatcagcagaaccaaaacacgtttatagatcaaatcccattatatgttcccaggatgaatggttccattctgctataacagaattttgttgtatgagctgtaacttaaaataatgggtcaaatactgacttagcaatcttgaggtttttgatgtagttgtattgtgatatttgttgtaatggagaattactggtatttctagtttttagacattggttggcatatcttatcttttttcactaaattgaaaaatctctaaaggtctagctttcagatggatcccaagctctctgcttagtaatgctgttaggttcaaacccaggacgaattacagggactattctctttgctttgttccacttatggcacaaactgcatcctgacatctagccatccatctaatgactacatgctgctactcgcaatggataacaatacaataaagtgcagatgcaaatccaccacaaaatgaggaaaaaattaaagcctctactttctggatgctgtaacacaagtgccaactttaggcaaaaaggtcagcacgtatgtttcagactccttactgcaggtgcttcagggtttgctccactaatgcctaggtgactaacaaattttcagtcacatttagcagatattaatggcacataaaaagaacaaaagggacagacaggatattacaatatggggtagtttgtgtggctggccacattgagtcctacatacctctccagcaccactcacccggagaagtggatatggatgccagctactgttttttctcccttcccaaacggatatagcttggcctacagctgcactgccccataacaaggagacttcacttgacacctaactcctgacagggctctgcatccttacatcagtaacagaagctggtttgggatgaaaaattatcaattgcaacttctgaaaaccttttcagaaataaacttttcctctattccaaatctcaaggtcttcaactagcctaccgtagagcttgaggggtgttaaagttaggacgaggctcagctacacactcctcctcttctgggccatcatcttccatgttggagaatcccatctcatcttggaactgtgggcaaaggaaagggagggttttcctggggaatgggcctctgaatgttgctccagtattgggaaggaagagtgaaaactatagattacaagactataataatgctggcacccagaaagagccaatgtcagaactttctcacttcaggattcccacaaacccacacttgggatggctattatgccaagaaagaagtcattcaaccagtcaacttgtaacagtaaggacagagcgtggataactcaaaattatcaatctctctctcctttttttttttttttttttttttttttttttttttttgagacagagtcttgcagtcttgctctattgcccaggctggagtgcagtggcacaatctgggcttactgcaacctccgcctcccaggttcaagcaattttcctgcctcagcctctgcagtaaccgtgactacaggtgcccgccaccatgcctaatttttgtatttttaatagagacagggtttcatcatgttggccaggctggtctcaaactcctgacctcagatgatccacctgccgtggcctcccaaagtgctgggattacaagcgtgagccactgcacccagcctcaaaatgatcaatctcttaaaatgaaaaatcttttgaaacaaatttatgaaaaaggtaattatttgtacacaaagtagtttaaaactagttgacaatctttaaggacacaccaaatgacagtaggggaagtcatcaaaagttttccaggggccaggcatgctggctcacacctataattccagcactgggaggcccaaggcaggaaaattgcttgagcccagaagttccagaacaacctgagcaatgtggtaagaccctgtctctacaaataaaataattagctgggtgtgttggtatgtcccagctactcaggaggcttagacgaaggactgcttgagcctagaaggtcaaggctgctgtgagctgtaatttcaccactgcactctggcttgggtgatggagcaagaaccccctcaaacaaaaagaagtttcaaggaaaatgttaataagaacaacatacatgtatataatcaagagtctagtagttagcaaaattcccttgtcattatattctttcccaggtagactaaaaggagaattggttcagtcagaccccctctcctagagggagcatcacagagaccaaatgacacatcttgctggagaactgacttaaaatcccgtgttctcactcgaggatcattactcacagtttcaaacagctcttccatcagctcatttacttccttttctgcaagaaagccagacagtatattgttggtataaattagattttacaataaggaggaattccatgaagacaatgtataatgttttcaacaaggcatgacaaattcttcatatctatccttctttttttgagatgggtctcactatgtcactcaggctggagcgcagtggcacgatctcagctcactgcaacctccgcatcccctccctggtccaatcgctcctcccacctcagctccccaagtagctgggaccacagacgcatgccaccatgcctggctaatttttgtatattttgtagagatgagggttcaccaggctggtctcgaactcctgagctcaagtgatcagcccaactcggcctcccaaaatggtgggattacaggtgtgagccaccatgactggctatccttcattcatttattcaaaaacatttattgaggccgggagcggtggctcatgcctgtaatctcagcactttgggaggccaagacagatggatcacaaagtcaggagattgagaccatcctagctaacatggtgaaaccccgtctctattaaaaatataaaaaattagccagccgtggtggtgggcgcctgtagtcccagctactcgggaggctgaggcaggagaatggcgtgaacccgggaggcagggcttgcagtgagccaagactgcgccactgcactccagcctgggcaacagagcgagactctgtctcaaaaaacaacaacaacaacaacaacaacaaaacacatttattgagcactatgcttcaatccatgttttagatgcttgggatatatgagagaatgaaagagagatagagagagagagttctattctcatgaagcttaaattctaaaaggaagaagacaggagaaaatgtgagctagatgattttataattagatgacctatccaaatccacacagtactgaatggaatcaagagatgagtctcctagcctgggcaaaatgttgaaaccatatctctacaaaaaaatttagctgggcttggtgacgcacacctgcagtcccagctactcaagaggctgaggtgagagaaatctcttgagtccaggaggcagaggctgcagtgtgccaagatcatgccactgcattccagcctgggcgacagagcaagatattgtcttaaaaaaaaaagagagagagaaagacaagtttccagcagggtttcacaggacgctgtctttggatctgaactattcaagaactccatcggtgacttagaagacccagagaacatacctaacacatctgtagatgatgtaaagctgaaagggactgccaatccaacagacggaaaattcaaaattatattttctcaaatcaactggatgcaacatatacggataaatttaaagttctatgtttaagaatttttttttttaatagaggcagcatgttgctatgttgcccaggctggtctcaaactcctgggctccagcgatcctcccaccttggcctccctaagtgttgggattacaggtgtgagccacggtgcccagtcctacagttaagagttttttcgtttttttttttgagacggagtcttgctctgtcgcccaggctggagtgcagtggcgcgatctcagctcactgcaagctccatctcccaggttcacgccattctcctgcctcagcctcctgagtagctgggactacaggcgcctgccaccgtgcctggctaattttttgtattttttagtagagacggggtttcaccatggtctcgatctcctgacctcgtgatccacccgcctcagcctcccaaaatgctgggattacaggcgtgagctaccgcgcccagcaagagttttaaagatcagtttattaactgcatgaaaaggtgacgtggcttaaaaataatgtgaacaagacctgaaagttttggttgttacaagaatctgaggaaaaaaaaaagttttggttgatatcaagttcaataagacacagttgctccaaaacggggctcataaccaacaaggcaaacatatcactgaactagagcagagtctaacactatgtctggaggactgtgaacaattctataaaggcccttcttaagaggacattaaaaaaattaagatccaggccacgggcagtggcttacgcctgtaattccagcactttaggaggccgaggcaggcagatcatctgcggtcaggagttcgagaccagtctgaccaacatggtgaaaccccgtctctactaaaaatacaaaaattagccaggcatggtggcatgcacctggaatcccagctactcgggaggctgaagcaggagaatcacttgaacccaggaggtggaggttgcactgagccaatacagcaccaatgcactccagcctgggcaacagggcgaggactccatctcaaaaataaataaataaataaattagccagtcatggtagcacatgcctgtaatcccagctacttgggaggctgaggcacaagaatctcttaaacccgggaggcagaggctacgctgaccagagatagtaccactgcactccagcctgagagacagagtgagactctgtctcaaacacaaaacaaaaacaaaaacaaaatcatttaagtaatttaattattttttattttatttttttgagactgagtctcactctgttgcccaggctggagcgcggtggcgcggtctcagctcactgcaacctccaccttccggcttcaagcaattctcatgcctcagcctcataagtagctgggactacaggcatgcgccaccacgcctggctaattttttgtagttttagtagcgacggtgtttcaccatgttgcccaggctggtcttgaactcctgacctcaagtgatctgcctgcctcagtatcccaaagtgctgggattacaggtgtgcgccaccatgcccagccaacaaaaaaaattaaaatccaaatgttactgaggatgtagagcaaccagaactctgataagaatgtaaaatggaaagccactttggaaaatggtctggcaatttcttataaaactaaacataccctgtgacccagtgatttgtctcctatacagctgacccaagataaatgaaatacggcttttctaactcataggtgggaacaaatgaaagagagagagaaatgaagcatttccacaaagacttgcacaaaaaagttcagcgcagctttattcgttacccaaaattaaaaatagcccaggtgatcaacacaaaaatagataatctgtagtatatatacacaacgaaattctactcaacaatataagggaacaaactaacgacccatgcaacacaaatgaatctcaaaaatattatgctgagtgaaagaagccttacacacaaagcacatcctatatgattccatttatgtgaggttctaaaactggcaaacataacctgtgattaagaaaaaaaaagccgggcgcagtggctcacgcctgtaatcccagcactttgggagtccagggcaggtggatcacaaggtcaggagatcgagatcgccctggctaacacggtgaaaccccgtctctactaaaaatacaaaaaattagccgggcatggtagcaggcacctgtagtcccagctactcgggagtctgaggcaggagaatggcgtgaacctggtaggcggagcttgcagtgagccgcaccactgcactccagcctgggtgacagagcgagactccgtctcggaaaaaaaaaaaaaaaaaaatcagaacagtggttgcctctgaagggatggtgtggggattgacttggaaggggcatgaggaaacttcctggggtgaggattctatatcctgacagggatttgtgtcacataggtacacacatgtcaaaattcattaaatggtacacttgagatgtgtgtgatacactgtgtgtaaaattacctataaaaagaaatcataaacaaatatggagctctagttcattatatgcgtgctgaagtggttaaaagtgaagtataggctcatgcctgtaaacccaccactttgggaggcagaggtgggaggatcacgaggtcaggaattcgagaccagcctggccaagatggtgaaaccccgtctctactaaaaatacaaaaaaaaagtgacatatagccaggtgccattgtgcacacttgtaatctcagctggtcaggaggctgaggtgggaagatcgcttgaccgcaagagttcaagaccaacccatgcaacatagaccttgtctgaatttaaaaaaaaaaagaaaaaaaagtgaagtataatttactctgaaatgcatttgaaaactaagatgcatccacagacggacagggagatggacagctgcatgataaggcaaataaagtcatccctcagtatctgtggaggttggttccaggagccaatctcctggaaccatttcgtatccatggataccaaaatctgaggatgctcaagtcccttatataaaaatgatgtagtatttgcatataatctacacacatcctcctgtataccttatctctagattacttatcacctaatacaatgtaaatgcttgttataccttattattttttatttatttatttgagacaagctctcactctgtcacccaggctggagtgcagtggtagtggtatgatcacagctcactgcaaccttgaacttctgggctcaagggatcctcctgactctgtctccagagtagctgggactacaagcacacaccaatgcacccagataattttttttttttgagacagcgtctcactctgttgccctggctagagtgcagtggcgcgatctcggctcactgcagcctccgcctcccaggttcaagcgattctcctgcctcagcctccttagtagctgggactacaggcgtgagccaccacacccggctaatttttgtatttatagtagagatggggtttcaccatattggccaggctggtctcgaactcctgacctcgtgatctgcccaccctggcctcccaaagtgctgggattacaggcgtgagccaccatgcccggctgcacccagataattttaaagttttttgtagagatggaatctcagtatgtcgcccagccgatctcaaactcctgtgctcaagcgatcctcctgcctcagcctcccaaagtgctgggattacagatgttagccactacgcccagttagtattattttttgctgttgcatttttttttctcagaatattttcaaggttggttgaatctgcagctgtgaaacccgcacatatgaaaggcgcacagtttatattaacactactgaaagtttggccgggcacagtggctcacgcctgtaatcccagcactttgggaggccgaggtgggcggatcacaaggtcaggagatcgagaccatcctggccaacatggtgaaaccctgtctctactaaaaatacaaaaattagctgggcatggtggcgcgtgactataatcccagctactcgggaggctgaggcaggagattcacttgaaccagggagtcggaggttgcagtgagctgagatggcgccacggcactccagcctggagacagagcgagactccttctcaaaaaaaaaccaacaaactatagaaagtaggtggtgaggctgggcgcagtggctcgcgcttgtaatcccagcactttgggaggctgaggcgggcagatcacctgaggtcaggagttcgagatgagcctggccaacatggtgaaacctcttctctactaaaaatacaaaaagtagccgggcatggtggcaggcgcctgtaatcccagctactcaggaggctgaggcaggagaaccgcttgaacctgggaggcggaggctgcagtgagccgagatcacaccattgcactctagcctggggaacaagagtgagacttcgtctcaaaaaaaagtaggtggtgagtatatgaatgttagctgtataatttttcaatttttctatatatatttttaaatttcataataagatgtaacaggggaaaagtttaaagaaaataaatgctagaatccagagaagagtaatgtgcatggtgagaggtctggacaccaaggctttggagaagaagaaacctggcagaagaaacttgaaactttcctatgttttgcatagggaaaaaaaaaaaaaaacttaagaaacatcttttaatatgtacacttgggaataaattgcttttttttttcttaacaacaaaagacaaataggaggccgggcacagtgcggctcatgactgtaatcccaacactttgggaagccgaggcaggtggatcacctgaggtcaagagttcaagaccagcctggccaacctggtgaaaccccgtctctactaaaaatacaaaaattagctgggcgtggtggcgggcacctgtaatcccagctattctggaggctgaggcaggagaatcgcttgaacccaggaggcagagtttgcagtgagctgagattgcaccattgcactccagcctgggcgacaacagcgaaactccatctcaaaaataacataacataacataacataacataacataacataacataacataacatcacataacataacataacataaagacaaataggaggaatataaaaggattgatcttcctgctttgcattcaaatttgggttcaataaggaaagtatctgaatttgcattcagatttgggttcaataaggaaagtattaattgaggaggtgttcaagtttacaatacactatctgcagaattgttgagctccctgtcactgaaggtatacaaacaggactaaaaaggccacctcagaggaggtgtaaacaaattctcaagcgggcaaaaaacatgtgaccacatggagcttttcaaactctgtgattctatgctttttaatttttttattttagttatccatataaggataagtccttttaaagagattataatcaaatatgacaatgagacacaagaggacaagaggcagaaaaaaaaattaaaaattctactccagctttcactatcattacagaactgtatgactagaaagactgcccttcatttacccatctctattcgactggcaaatattgccaccagctttacagcaataaacaaaacaaagctcttgagaagttcacagtctaggggagaagacagatattaaataagcaattatgaggtgatcagtatataaaaggacaaaaagagtggtacgggaatgcaaagcaagaagatcaatcctaacgaaggaggatctccctgagaaattatacgtaaactgaagaaagtaacaatcaaaaagggaaggcaaatatattccaggatgatagctgaacttaagatctgcttttgtgctttaagcagatgtttctttacttgtttctttactgttgaccattctgtccttcttgaaagactctttttttgaaacagggtcttgctctgacccaggctggagtacagtgttgggatctctgctcgctacagcctccacctcctgggctcaagtgatcctcccacctcagcttcccaagtagctgggactacgggcatgcaccacgacaactaattttcattttatttttaaaatgtttttgtagagacaatgtctcactatcttgcccaggctggtcttgaactcctgggctcatgcgatccttctgcctctgcctcagcctcccaagtgccgggattatagccatgagccactgtgccccagccaaaagactcttcctttggtttctacgacactagattttctaggtttttcttgtaccttcctagattctcctttcagttttctcaaagcctaaatcctcaaaccttttcattctacattttctctaattcctggtgctttcctttcaatgcttccactatccctgtcatagtatatcaaaataaatgaaagatcttcacaaaggaaatggtattctaatcttaaaagcaaggtgaaaggcacaataaagcaataaaataaaatgtaagttctaaaggattgtatttacataattctctttacacaaagaactgcattaattaggtatatcttggatgtttataaagctctctgcataacctggtcaagagccagcatcttaccttctccatgtcgtgtatattattccagtacagggtcatgcatacatgcaataaaaatcaatggcttatgaaatatattttttatttttctttctccccataggtagaatttcttcaggatgaaatgtatgttttctatgcttgacacactagccaatgatataatttttttttgagtcaggatctccctctgccaccaaggctggagtgcagtggcactatcatagtttgctgaatccttgacctcctgggctgaagcaatcctcctgcctcagcctcctgagtagctaggactacaggtacgtgccaatacattaggctaatttcttaaatttttagtacagacaaagtttctctatgttgcctatgccggtctcgaactcctaagctcaagcaatcttcctgccccagcctcccaaagtgctgggattacaggtgtaagccaccactcctagctcaatgatataattttttatagaaataactcaagctaagttatcataattgttttccatacctccagtcttgttcactttacctaacaaattaatacattaaactggtattaaatcaaagtgatctttctaaaatccaaatcagttcctactgatttactgcttaaacctcttttttttttcaggcggagccttgctctgtcgcccaggctggagtgcattggcgtgatctcggctcactgcaacctctcccgcctgagttcaagcaatttttctgcctcagcctccggagtagctgggattacaggtgcctactaccacgcctggctaatttttgtatttttagtagagacagggtttcgccatgttggccaggctggtcttgaactcctaacctcaggtgatctgcctgcctccacctcccaaagtgctgggattacaggcgtgagccaccatgcccgcccttaaacctcattttgagagcttaaaaatcctccatgatgtaaacactacctaatcttatctaccacttctctgtcttttcactcatacaccaccaccaaagtacttagtattttccaaacatacttttttgatgttttacaattctgtggtttgcagatgctcttctatttgcaatattcctctctgtccctattcaccaaatttcttattcctccttcaaaactaagataaaaagccatttcattctgcaaattctttcctaagttctcctatcctagtccatatcatacactaggagatgacactctcttttaggtcattattataccttatgtaaaacctgttacagcatttatcactttgtattgtaactttttctgtttctatcaccctactaggctgaactcctacagcacagatgccatgtcttattcatcttgcacaatccctgccaaacagtaaggactgaatacacgactgtgggatatacaaatgaataactgatgggctttctgaatatgtacctaaatttaaagaatcagatcaataaatgggtaaaggaaacctaaatgtcttaacatggatgagctgcaaacttcacccctaaaaatctacaaagtaaacaaagacagctgcaaagcagtcaagagcaggacttagaataaacacagactcactggtgattctcactgcccggtcagtccggaaatcctctgtgtctggttcatcgaggtcttccaggaaattatattctggatcatcatcatcatctgcttcatctaggaaaaaaaagtgtttcagatgctcattaactctgttctcaaacttctaagaatctgttccaataaagcacatttattctttatttttttgagacagggtctcactctgtcgcccaggctggagtgcagtggtacagcctcagctcactgcaacctccacctcccgggctcaagtgatcctcccaccttagcctcctgagtagctgggaccacaggcatacgccaccacacccagctaattttgtgtagtatattccatgaaaataatactttctgtaaaagctacttgtacagtgaagctgacagtgaaaaaaggagtggcccaaattcccaacaattagagaatgactatataattataatttcttagtataaaatagtacaggttgagcattccaaatccaaaactccaaaatctgaaactctgtgagtgcaaacatgactctcaaagggaatagccattggagcatttcagatttcaaattttctttttccttttttttgagacagggtctcactctgtcacccaggctgaagtgcagtggcacgatcatggctcactgcagccttgactgcccaggatcaggcgattgtcacacctcagcctcccaagtagctgggattaggcacatgccaccatgcccaactaatttttgtatttttagtagagacagggttttggtatgttgcccagactggtcttgaactcctgggctcaagcgatctgaatgcctcggcctcccaaagtgctgagattacagtgtgagccattgcaccctgcccagatttcaaattttcaaatttagtatgcttatctgttaagtataataatacatatattctaatatctgaaaaaatctgaaatccaaaatacttccggtcctgagcattttggatgaaggggatactcaacacgtacacatataaaatgtgaatatgtaaccattctataaaagttcaatacatgtatgacaaaagtacaatatatacataataatcataagcatgaaaaattatatccttacaataagaatcataaataactaaaaatatacaaaaataataaacatttgttaggttagaataatagaaatatggatgttcttctcccttttaattttcttttttcttttttttttttgacatggagtctcactttgtcacccaggttggagtgcagtggcatgatcttggctcactgcaaactctgcctcccagcttcaagcaattctcctgcctcagcctaccaagtaactgagattacagatgcccaccaccacgcccggctaatttttctatttttagtagagacaaggtttcaccatgttggccaagctggtctcgaactcctgacctcaggtgatccgcctgcattggcctccgaaagtgctaggattacaggagtgaaccacagggcccagcctaattttctttaatgttaatgctaaactgtcttttcaattactaagtaaaaattatgaaggagtcattaaattatggaattattatatattaaggtaatatttttctccagataattttagatcagtgttgtctaacagaactttctgtgatgatggaaatgatctatacatgtattgtattgtatcatacagtagccattagccacatgtgacttgagaaatgcagctagtgtgactgaggaactgatttaaaaaaaaaaagaccaaaaagagaatacctaaatttcttactatcatgtatccattaaatagaagaggtgatctctatgtattataatggaaaaatatatgttatactgctaagtgaaagaagcaagttgcagatgaagaccaatatgtatagtatgattctttttgtggaaaaaaattcttgtttgagataaatacatgcttgactgaacacccacagagtatctagaaagaaacacataaaactattaacaaagatttctctgtgtaccctcccacaatattttttttttctttctttttttaaggtggagtctcgctctgtcgcccaggctggagtgcagtggctcgatctcagctcactgcaacctccacctgctgggttcaagcgattctcctgcctcagcatcccgagtagctgggactacagatgtgcaccaccatgcccagctaatttttatatttttagtagagacggcgtttcaccatgttggtcaggctggtctcaaactcctgacctcaggtgatccacctgcctcggcccctaaaaagtgctgggattacaggcgtgagccacagagtctggcgcctcttccataatgttttaacttttcataataaatgagcatcttttttttttttcgagagggagtttcgctcttgttgcccagactggataccgtgcctggccataaataaacatcttttgttataaacagacatatacagcctggggccaagcatggtggctcacgcctgtaatcccagaactttgggaggccgaggtgggaagatcacttgaggtcaggggttcgagaccagcctggccaacatggtgagaccccccccctcccgtctctaccaaaaatacaaaaattagccaagagtaatggtgcgtgcctgtaattccagctacttgggaggctgaggcaggagaatcacttgaacccaggagacagaggttgcagtgagctgggatcatgccactgcactccagcctgggcgagagtgagactccatctaacaagaaaaaaaaaaaaaaacacatatatatatcctgggcaacacagtgggaaccaatctctacaaatgactttttaaaaattagccaagtgtcgtggtgtgtgcctatagtcccagctactcagaaggctgagctggaaggactgcttgagcccaggagtttgaggctgcagtgagtcatgatcacgccactgcactccagcgagggtgacagagtgagaccctgtctcaaaaacaaatatatattttttatataaatataaatatatataaatatatatatacttatacagacacacatttaaaattcacaatcactgaaaaatctgtgctgattaaaccctaatctaacttgataattctttactcaacatttatactcagcttataatatattaatttgcattctttacacataactaattatcaaatctttttcatctatttgtgggtttaacttatcagtacagattctttatttctttaggaatagaatactgtcttcataattcataatctctatagtactttctatataagtctcttcacagcaagttctttttttttttttttttttgagatggagtctcactctgtcgcccaggctggagcacagaggggcgatctcggctcgctgcaagctctgcctcccgggttcacgccattctcctgcctcagcctcccaagtagctgggactacaggcacccgccaccacgtcaggctaattttttttttttttttttttttttagtagagacggggtttcactgtgttagccaggatggtctcgatctcccgacctcatgatctgcctgcctcagcctcccaaagcgcagggattagaagtgtgagagacactgcgcctgatcaaaaagttcttaacaaacattgctgaataacgaaagttctggaagagcccataataatgagtagtgtgcacaggtttggactccatctgtttggatgcaagaactgcaatagatagttctgcccacaccacacaaatgggtcagcgaatattattctcagagcactcatttaacaaagatgctgaaaaatcatttagggggattcttctgagttctgcttagcttttagtaccctgattgtggaatatgtcctctgagcttaatcacttttttgacttattaacaatgtcagtatttacccagctgatatacccctcctgtattgtcttttaactcaactggtagatctggaggccacacccatcctaatcattggctttgtgtgctcttttaaaaatctgtccgaataggcacatacaaaaatactgaagttgctgggcgtggtggctcacgcctgtaatcccagcactttaggaggccaaggcgggcggatcacctgaggttaggagttcaagaccagcctgaccaatatggtgaaaccccgtctctactaaaaatacaaaattagctgggtatggtggcatgtgcctgtaatcctagctactagggaggtggaggcagaagaagtgcttgaacctgagaggtggaggtggcagtgagccaagatcacaccattgtactccagcctgggtgacaagagtgagaccctgtctcaaaacaaaacaaaacaaactgaagttttattttaagaaaagaggattttcaccctccccctaaccattagtccaattccccaatcaacctttatcatgcactcttacctttcccagaccagtagtttccaatcctttagatatatcagaattagatccctagaccatactcattagattctgattcagtaggtaaggggtgaagccctgaaatctgtatctttaataaacatcaccctacatatccatacactcttcaattctgattcaagttctcggaaccaaattatgagaaacaaaatcctgaaagtcagttctgcctggcctttccttcccaatagctaccatcttaggcctttgaaccaaagtgatgaaaatgagcaccaaagctgctgctaccaataacgctaggagaacctgactttcttactgtaattattttgtattagcctgtgccaaagataaaaagcacagcttattatgaaggctaggagcagtggctcatgcctgtagtcccagaactttgggaggccgaggagggcggatcacctgaggttggaagttcgagaccagcgtgaccaacatggagaaaccccatctctactaaaaatacaaaattagccaggcgtggtggcacatgcctgtaatccagttacttgggaggctgaggcaggaaaatcgcttgaacctgggaggcagaggttgcggtgagctgagatcgtgccattgcactccagcctgggcaacaagagcaaaactccatctcaaaaacaaaacaaaacaaaacaaaacaaaaaacacagctcattatgaaaagtcatatacttttaaaaaatggtttaggccgggcgtggtggctcacacctgtaatcccagcactttgggaggccaaggtgggtggaccacttgagatcaggagtttaagaacagcctgaccaacatggtgaaaccctgactctactaaaaatacaaaattagccaggcatggtggcacatgcctgtaaacccagctacttgggaggctgagacaggagaatcgcttgaacctgagaggcggaggttgcggtgagccgagatcgcgccactgcactccagcctgggggacaagagtgaaactctctcaaaaaaaaatggtttaggccaggtgcggtggctcaagcctgtaatcccagcactttgggaggctgaggcgagtggaacagaaggtcaggagttcgagacaagcctggccaatatggtgaaaccccatctctactaaaaacacaaaaattagctgggcatggtagcgcgtacctgtagtcccagctactctggaggctgaggcagaagagtcgcttgaacccgggtggaggttgcagtgagcagggattgtgccactgcactctagcttgggcaacagagccagactctgtctcagaaaaaaaaaaaaaaaaaaaaaggtttaacttaccgtgaaacctgtctgattgagacatgttcctagaatattaaactgggttctactcctaggagtataacaaattgattctgtaactttgagcaagacaatgaatttctctgagatttcactgcctacaaagtggttagaactatctgtccttgggcaacccactcgggtcccctaccacgttgtggaaactttgttctttaactcttcacaataaatcttgctgctgctcaaaaaaaaaaaaaaaaaaaaaaagaactctctgtcctgtctattcctttttgtggagatttctgaacctggtagaaacaggaagtgtcaataaactttaaaagatatgtatctcccaaaaatcatataaaaatttcatgtatttggatatgtacatttttttctgggggaaggctgcatagttttcatcagattgtcaaaggggtgagtaatggaaaactcagaagcttagactcctatcagaatgactaatgggataatatatcagttgctaattatgaaggaactgattctatactttgcatgttaatgactcagcttcaaactccatctttttctccttacacaatttttttcattttgtggcttgttagcccctctactacagagggtgggtaaaaaaaagaaatatgataagatttaaaacaatttgcttcttgttattttctctctcttttttaaaattttattttattttaaaaatagaaatgccaggtgcggtggctcatgcctgtaatcccagcattttgggaggccaaggagggtggatcacctgaggtcaggagtttgagaccagtctgaccaatatggtgaaaccctgtctctactaaaaatacaaagattagccaggcaaggtggcaggcgcatgtaatcccaactactggggaggctgagacaggagaatcgcttgaacccagtaggcagaggttgcagtgagccgagatcacaccactgcactccagtctgggcgacagagcgagactctgtcgaagaaaaaaaaaatagaaatgaggtctcactgtgtttcccaggctggtcttgacttcctggcctcaagcaatcctcatgccttggcttcccatagtactgggattacaggcatgagccaccacgcctggactatcttttctaaatgtttgagaaaagtcttaaatttaaatttaggactaaaatttaattatttttatccccacattaatgtggaaaactaaaaagtaactacacattgaaaactctcacagatgcataccaaagtattatcagtagtccctctggggaaccaaacttgaaccttggtgtcaaaggctttggaaatgactggtaggaaaatgaagtgccaataaataaactctaagagatacataaaccccaaaaaaatcatatgaaaaatttcatgtatgtagatatgtacattttccttggggggggggaaggctttaattgttttatttctgtaatatttgatttctttataccaagcatatattactcttacagttttacagtgaaaaaagagaaaactctggaaagaatatatcctacagaatccagcatatagagtatatcatgtcacttctactcagatgccttctctcttccctgtcactgttttcaaaaatctttccaaggtccatttcaattaccagctctttcatgtagctgtctctgatcatcctaaacaaaagttaccctgtcctcttctaaaatcttacaacagcatttatgccactttgatggcatatctgagtttattcaacaacttcattcatttacaatatactggctgagcgcgatggctcactcctgtaatctcagcactttggaaagcagaggcaggaggatcgcttgagcgcaggagttcgagaccagcctgggcaacatggcaaaaccccaactctacaaaaaatacaaaaattggccgggcatgatggcacaaacctgtattcccagctatttagaaggctgaggtgggagaattgcttgcgccaaggaggtcaaggctgcagtgagctaagatctcaccactgcactccagcctgggtgacagagtgagaccctgtctcacacacacacaaaaaagtacaatgtattgtgaacctaacaatgggccaggcaccctgtcattcataaagcttttattccatgaccaaatgattatgctcctttatccctcacagattctagcacaatgccttgtataaagaaagtactcaaacatttgccaaatgatatactatataactattaatagtatcataaggtacattcaaggacctgttattttctttcattcacttatcctgacttactcctagcattacctacccagccatttactcagtctatttctttttcttttttttttttttttgagatggagtctcgctctgttgccaggctggagcgcagtggcgcaatctcggctcgctacaaccttcgcctgccaggttcaagtgattctcctgcctcagcctcctgagtagctgggactacaggcgtgcaccaccacgcccagcaaatttttttatttttagtagagacagggtttcaccctgttggccaggatggtctcaatctcttgaccttgtgatccgcccgcctcggcctcccaaagagctgggataataggtgtgagccaccacgcccagcctacttagtctgtttccatccaaacttttatctgatcaatatttcttccccatttctgataataccattacttctttagggtcaccacatacttcaaccacactgttctatgaggtgctatcaatcaccagactccatgctgaacagtctccctatcaatcccatgtagtaccaagagactgggcatgagatcaaaccaagtcgatctgacttgttcccctggattttataactggagcttgcaggggagagtcctgaagtgtagacaaagcaaaaagtaatcacggagtgtttatgaacagagctctaaccttgtagaaaaataaatgtgagaatggagctgagtgacaaaaggaagtaaaatagagaggaaagggggatcctaacagtgcctcagttccactgctgatttactacacttcccaaagtctggtttcatttcaccccagcaagatagagttaggattctttcacttgcatcatgaagacccttaactaacacagtgttcttttggtaaatcactgaaccctaatgaaatcatacataaaattttgagtgggccaggcacagtggctcatgcctgtaatcctagctctctgggaggccaaggtgggaggatcacttgaggcaggagtttaagaccagcctgagcaacatttctctacagaaatttttaaaaaattagccaggcaaggtggtgcgtgcctataatctcagctacttgggaggctgagacctgaggacgatctcttgagcccaggagtttaaggctacagtgagctatgatcaccccactgtgatccaccctgggcaacaccctgttttgggacagtgtctcaaaaacaaaagacaacaacaaaactacatgtgcatgtatgtttcaagggattcaaatcttagcattcaacaatcttaggattcaaaagattccttacccagaaaaagaaatgttaagaattggcccaggcacggtggctcatgcctataattctagcattcaggaggccaaggtaggaggattgtttgaggccaggagtttgggaacagcctgggcaacatagtgacatctcgtttctacaaaaaataaaaaattagtcgggcacagtggcatgtgcctgtagtcccagctactcagtgggataaggggtaggattgcttgagcccaggaggtcaaggctgcaatgaaccgtgactgcaacactgcactcagcctgggtgacagagtgagaccctgtctcaggaaaaaaaaaaaaagaaaaattaactactgatttaagataaattatcagttaaatacaaattaaatcaattaacccaaaccattccattctatacccttccaaatactaaaaattttacaacagataatggacagtatacataataaatcacaaaccaaaacttaccttcattccccacatcatcattcataagtccccccagccacatcttccagtcctcatcatctgccgtattggggtcatacatatctggagtgatgtctggagcttggagctctgcctctaattggcccaggggaacatctttcaggggcatcttagaacgcgttcgaaatgcaatgagactgtcatccatgggctggacaatggagaaagaaaagtcactgagtgagtgatgtttccaaacctcatcatcactccttttcttctcatcttagcttaagtaacaggatccttcctctaaacaatttggatttattattgtttgagaaactttaagaaacacgacataaaaaagaaataaaataaatgacatcagtttgaaaccaacattttaggaaaatttataacagctttattgatatacaattcacataccataaaatttacccttttaaagtgtataattgaaaggattttcatatattcacagagttatacaaccatcaccattatctaatttcagaacattccattaacccaaaaagaaatcccatacccattagtagtcgcttccctttccccctcctcccagcccctgttaagcattaatctattttctgtctctatggatttgtttctgctggacatttcacttagatggaatcataaaatgtgtggcctgtctctggccgctttcagttagcataatgcatttaaatcccaccctgttgtaatatctatcaatactttttttttttttttgagacatagtcttgctttgttgcccaggctagaatgcagtggtgccatctcggctcactgcaacctctgcctcttgggttcaagtgattctcctgcctcagcctcccagggagctgggattacaggcaccagccacgacatctgactaatttttgtatttttactagaaacggagcttcaccatgttgggcacgctggtctcgaagtcctgacctcaggtatctgcccacctcagcctcccaaagtgttcggattacagctgtgagccaccatgcctggtgtttttttttttttttttaagagatagagtctcaatctctcacccaggctacagcactggcacaatcagagctgactgcagcttcgaactcctgggctcaagcaattctcctgcctcagcctcccaagtagctgggactatcggcatgctctaccatgctcggctaatttttttttttttttttagatggagtcttgctctgtcacccattctggagtgcagtggtacgatctcggatcactgcaacctccatctcccgggttcgggtgattctcctgcctcagcctcccaaatagttgggactacaggcgtgtgccaccacacctggcaaatttttgtatttttagtagaaatggggttggccaggcttgtcttgaattcctgacctcaggtgacctacctgctcagcctcccaaagtgttgggattacacgtgtgagccactggatccatactcagctaatttttttcattttttgtagagatgggggtggggggactccctatgttgcccaggcaagtttcaaactcctggactgggctcaagtaatcctcctgccttggccttcctaactgctgggattaaaggcatggtggtatgtgcctgtggtaccagctactcaagaggctgagtcaggagaattgcttgggtttaggagttcaaggtgacagtgagacacgtaccactgcactccagtcaccatgcctggccccgaattccttttttcacccaataatatcccattgtatagatataccacttttgtttatccaattatctgttgatggaattcagattgtttccactgtggggcaattaagtataataccgctggctgaatgcattggctcacacctgcaatcccaacactgtgggaggcccaggaagaactgcttgaagctaggagtttgagaccagcctgggtaacacagtgagacctcatctctgccacaaacaaacaaattagttgcgtgtggtggcaccaattgtagtcccagctacttaggaggctgaaagagaaggatctcttgagactaggagatcaaggctgtagtgagccatgattgcaccattgtactccaacctaagcaagagagacatctcaaaaaaaaaaaaaaaacagggccaggcacagaggctcacatttgtacatctgtaaacccagcaccttgataggctgtggtgacaagatcgcttgagtctaggagttcaagaccagctgggcaacacagcaagacccccatctctacaaaaaataaaaagttagatgggagtggtggcatatgcctgtagttccagctatgcaagagccaacgtgggaggatcacttgaacacaggaggaggttgaggctgcagcaagctgagatcataccactgcactccagcctgggcaacagagcaagactcttatttaaaatatttattttaaaaaaatgaggctgggtgcagtggctcacacctgtaatcccagactttgggaggacaaggtgggcggatcacgaggtcagaagatcaagaacttcctggctaacagtgaaaccccgtctctataaaaaatacaaaaaattagctgggcatggtggcaggcgcctgtagtcccagctactcaggaggctgaggcaggacaatggcatgaacccgggaggcagagcttgcagtgagccgagatcgcactactgcactccagtctgggtgacagagccagactccgtctcaaaaaaaaaaaaaaaaaaaaaagaaaatcagaaagtgtgagacctccatctttgtactttttaaagactgttttggctattctgggcctgtgcaattccacatgaattttaggattagactgttaatttccacaaaaatggtagctgggatttggatagggactgcattgaatctgtagatcaatttgggaagctctccctagactacactgcatcaacctgctaatgggtttctgtttaccctcttgctttactctagtccatttcccacacgttaaccaaaaggaatttttaacattaatccaaaaatatcacaaaaatcttttcttatttatttatttttttttttttttgagatggagtctcactctttcctagactggagtgcaggggcatgatctcagctcactgcaacctccactccccacattcaagcgattctcctgcctcagcctcctaagtaactgggattacaggtgtgcgccaccacacccaggacattttttgtattttttgttagagatggggttttaccatgttggccaggctggtctagaactcctgacctcaggtgatccacccgcctcggcctcccaaagtgctgggattacaggcatgagccaccacactgggcatctgttctaatgtttaaaataaaatctacaccccttatcatggtttcctaagaccttcatgatctagctcttgccttgctctctgacctcatttctacctctttttcacgatcccacccttcatgtagtttctgttccttaaccatgccaaggttgtttctatcttagcgacttagaatgtgctgtttcttccatatggagcactttttctccccagatcttttacatgcctggcttcctctcattcggatctcagtttaaatgccatctcctcaaagaggccttttttctttttgttttttgtttttttgacagtcttgctctgtggcccaggctagagtgctgtagcatgatcacagctcactgcagcctcgatctcctaggctcagcctcccaagtagctgaggctacaggtgtgtaacaggatgcccagctaagttttgtgttttttttggtagggacaaggtctcactaggttacccaggcttgtcttgacctcctgggctcaagtgatccactctccttggcctcctaaagtgttgggattatggacataagccaccaaaccggaccctgttttttaaaattttttttaaaaaagttctcatactattacccatgctggagtataggggtgcagtcatggctcactgtagtctcaagctcccaggcttaatcaatcctcctgcttcagccaccaagcagctaagaatacaggcatgcgccaccacacctatataatttttctgagtttttggagagatggagtctcactatattgcctaggctggtctcaaactcctagcctcaagcaatcttctagcctaggactcccaaagtgatggaattacagccaaggaggtcttttttgatcagcctatctaaagttctctgacaggaagtttcatatttcctcattttaatttagttcatagcacttaaccacatccgaatttacttgtttatatgtttatagtctatctctcctcaacagactaagttccatgaagaacaattttttctgtcttctacactgttgtttctcaacttcaaccattcagtatgtgtttggtaaataaatgattacataaaaaactattactgctcctactactacatactccaaagcatggtgattaaatgactcagagctattccattcaatattctatttttaattatatacttatatataattataaattatatacttataaattatatacttatatatacttataaattatatacttatatatacttataaattatatacttatatatacttataaattatatacttatatatacttataaattatatacttatatatacttataaattatatacttatatatacttataaattatatacttatatatacttataaattatatacttatatatacttataaattatatacttatatataattataaattatatacttatatataattataaattatatacttatatataattataaattatatacttatatataattataaattatatacttatatataattataaattatatacatatatataattataaattatatacatatataattataaattatatacatatataattataaattatatacatatataattataaattatatatatatataattatatatatatatatatttttgaaatgtagtcttgctctgtcacccaggctggagtgcactggcgccatctcggctcactgcaacctccgcttcctgggttaaagcgattttcgtgccgcagcctcccgagtagctgggattacaggcacttgccacaatgcccagctaatttttgtatttttagtggagacggggtttcaccatgttgaccaggctggtctcaaacctgacctcgggtgatccacccgcctgggcctctcaaagtgctgggattacaggtgtgagccaccacacccagccttaattatattttttaattttaggatttctttttaaattattatatcatactttaaaattttaggacagacatttttcattgacctgcaagaatgataggggaaacttggaacattaaaatttactggctaaggccaggcatggtggctcacgcctgtaatcctagcactttgggaggccaaggcaggcggatcatgaggtcaggagatcgagaccatcctggctaacacagtgaaaccccgtctctaccaaaaaatacaaaaaattagccgggcatggtgtgcacgcctgtagtcccagctactcgggaggctgaggcagtagaatgacatgaacctgggaggcagagcttgcagtgagccgagatcacgccatcacactccagcctgggcgacagagtgagactccgtctcaaaaaaaaaaaaaaaaaatttactggctaaggccaggcgcagtggctcatgcctataatcccagcacttaggaggttgacaagggtggatcacctaaggccagttcaaaaccagcctggccaacaataaaaccctgtctctactaaaaaatacaaaaaattagctggcgtagtggtgtgtgcctctggtcccagctactcaggaggctgaggcacgagaactgcttgaacccgggaggcagatcagatgttgcagtcagctgagatcacaccaccgaactccagcctgcgtgacagactgtgactccatatccaaaaaataaaaaattactcactaaatgttagaattacaaagtcatcatttgacaacgaccatagtaaagactgtttcaagaaagaaaatcaggccaagcgtggtggttcacgcccgtaatcccagcattttgggaggccgaggcaagtggatcatgaggtcaggagatcaagaccatcctggctaacacggtgaaacccccatctctactaaaaatacaaaaaattagccgcgcatggtgcgggcgcctgtagtcccagctactcgggaggctgaggcagtagaatgatgtgaacctgggaggcggagcttgcagtgagccgagatcgcaccactgcactccagcctagaggacagagcaagactccgtctcaaaaaaaaaaaaaaaaaaaaaaaaaagaaagaataatcaatggatgctaatattagtgtgagaaaaataatttgattgattgggctgggtgcattggctcacgtctgtaatcccagcactctgggaggctaaggtgggcagatcacttgaggtcaggagttcgagaccagcctggccaatgtggtgaaaccccatctctactaaaaatacaaaaaattagctgggtgtggtgtcagtcacctgtaatcccagctactcaggaggctgaggcaggagaatcgcttgaaccccgaagtggaggttgcagtgacccaagatggcaccactgcactccagcctgggagacaggcaagactctgtctcaaaaaaaaaaaaaaaaaaaaaaaaagaaggctgggcgcggtggctgacgcatgtcatctcagcactttgggaggctgaggcgggtcaggagatcaagatcatcctggctaacacagtgaaactccatttctactaaaaaatacaaaaattagccaggcgtggtggtgggcacctgtaatcccagctactcaggaggctaacgcaggagaatcacttgaacccaggaagcagaggtgcagtgagctgaggtcgcgccactgcactccagcctgggcaagagagtgagactccatctaggaaaaaaaaacagaaagaaaggaattcggctttgaagtatatccccacatgatatatactaattaaaaatggaaaataataactttacaatgggaaaaccaagcacacaccaccttaaccaagtgatgaaagttaacattacagggatcacgtgccttctgatatgatgcaatgagaaacacacatcactcttccagtatttgtaacaaaagtgcaaaacctgaatctaagaggaaatattagaaaaataaaaattgaagaacattctacaaaataaatggtgcatactcctcaaaactgtcaaggttataaaagacaaagactgagaaactgttccagattaaaggagactaaagaacaagataattaaatagatatttaatccagggttgaatgctgaatagggaaaaaaaaatttttttcctccaacataaagggcattgttgggacaacagataaaaccagaataagcactttaatatattatgtaatattactgtatcctgatttttttttttttttgggacagagtctctctccattgcccaggctggagtgcagtggcgcaatctcagctcactgcaacctctgcctcccgggttcaagcgattctcctgcctcagcttcccaagtagctgggattacaggcatgcgccacgacacctggcaaatttttgtattttcagtcgagatgggggtttcaccatgttggccaggctggtctcgaactcctgacctcaagtgatccaccaaccttggcctctcaaagtgctaggattacaggcatgagccacagcgcacagcctgtatcctgattttgattaacactattatactgtgttaatacaagataataaactcatttttagaaaatatacacaaaagcatgcagaggtaaaatggcatcatgcctgcatcacactctaaaatgatttagaaaacactatgtgtatatacagagaaagaggaagagaaccatcaagcaattgtggtaaaaggttaatttgggggaatttgggtgaagctttttcctatgttctacattttaaaatgctctctgctacatagttcatttcttccttagaaactgccattctcagccaggcacggtggttcacaccagtagtcctaccactttgagaggctaaggtgggaggatcacttgagcccaggagttcaataccagcctgagcaaaaatatagggagacctcatctctacaaaaaactaaaatattagccaggtgtggtggcatatacctgtcccacctattcgggaggctgaggtgggaagatcacttgagtctgggaggcggaggttgcagtgggccaagatcacaccactgcactcaagcctgggtgacagggtgataccctgtctcaaaaacaaacaaacaaacaaaaaaaaccccaaactgccattgtcactttgagcagaaaatagcactagccaaatacaaagtatcaaagactaactcttacttatataaaattgtagttatcttttcctctcccttcccagcctgagcaacaactacattactccacttgactttctcagttaagtacagttttaatatttacctggaaagaatccatgcagactggactggaagccagctcctcatctaccgcatgtaacttctccatgaaagtactatctctggtctgtttcggctttggagggggcgggggccccatgggcactacctcagcactgatgtgcctgatggctggtgtggtgactttctcagcctgattaaaagaggtgactgcatcaaaaaaggaaggaggtaagaaagaaagagaaagcaaaaaaaggaaaaaaagagagggaaaaagaggcagactttccatacaccattgtcctttctcttctctagttagagttacataaaaacaaagacaccaagtgtattgatctaattagttttcatcctatttctagagaagtcaacagaatgctacttagtttaccaaaatgtgggaaattaataacaatggctttaggacaatattaaaaagcacagatatgaaagaagagaagggtaggagaaaagaaactctgctagttgcacatttttggccccttaatgagaactcagaaaagttctttggctatcactgagttctagccttctctgaactgtttactaacttaagaaactttgaaaaagggtgacagcccagaatcaccatggataaataatctacttatacagttaaaaaatctacttagacagttatgtctaacatctcttttgtatgatgccgatttacctctgataatatgccactctcctcatctgtttcagtcatctcagaagactgcctcaatctggatttctttgccccacgtggagatgaagcagtgctttcaacatcactttccaataagctctacaaaataaatccagttcgccttaatatttatgcccctacctcattccacaaagtctgaagtatctcaagagaaggaatcataaaatatcaatcactcagcctggccaacatggtgaacacccgtctctgctaaaaatacaaaaataagccaggcgcggtggcgtgcacctgtaatcccagctactcgggaggctgaggcaggagtatcacttgaatccaggagatggaggttgcagtgagccgagatcacgccactgcactccagcctgggtggcagagcgagactctgtctcaaaaataaataaataaataaataaaatccatcactcaactagttacagtaacagaaaataaaatttaaatagaaacttaaaggccaggtgcagtcagtgtcttatgcctgtaatcccagcactttggaaggccgaggcgggtggatcacttgaggtcagaagtccgagaccagcctggccaacatggcgaaaccccatctctactaaaaatacaaaaattagccaggcatggtagcgcacgcctgttaattccagctactcaggaggctgaggcaggagacttgcctgaacccgggagatggagatggcagtgagccaacatcgcacactgcactccatgggcaacagaggagactcaaaaaaaaaatcctaaaggtggggacagggatcagatcactatcctaatctgcattacaaagtgtaaggccttggtctaaaatccttttacaaaacaattcaaagaacacattaagaaacaagtcaaagaacatattaacacagcaatgaaagggaacgaagtatagctaaaaccaatagtataaatgaatctcaaaagcttaatgttgaattttaaaaagctaggaacaaaacatataaacatgggtccatttatataaagttcaaaacagtaacaattgaactacagtgtgtagagatacatattgaggtgatacaactataaagaaaagcaaagaaataattactaaaaggcagggtagtggttatttttagggggagggaggtgattgtgactggggagggtatacaggggttgtcctagtaatgatatatttcttgactttgctatgagtttcatgaggatttgcattataataaccaaagctatacatttttattctatgcacgtttctatgctgtatttcataatacaacaaattctaaaattaagggagtataaagggcagaaaaacagcttaaagcacagaaatgagctgaaaaaagaaccatgtctcaatcctctctacaagtgacattactaaggaagcaaagtataccctgctctattaagacaaatattaccaactaacattcactgacctcttcagcagtttcatcttcttcttcatcatccggctggtattcttcatctgaggaatcatcttcttcaaggtggatatccacaaactgaggaggctacattagtacaattagaaagaaatgaagtaatgggaaacacaaatcatacgtatttggaaaataaggggaagaagcagggcagaaaaaaaaaaaatcctaagagcataatgtacagctaaagcaaataacacgaggcagaggttaaagtgaattccatgagatacaaacctaagagtaatagaatggaaaaaaacaaagctggaattaaaacaaagattgatcaagaaaagttaaagaggaagtacttaagtttcaaaaccgatgaagtctttctggaaaagaataacaattatttcttccaagtttaccttaatttcattggccttcttaattggtgaaatattccatgttggaattacctaccaacaaagaatataaataattaagttatcttaactgaaataattgtttttcatgtttacttcctctgtaccatcactaacagccatatacttaacaagtaactgcagtgatctagaggtgttgattatccctgagggtatactctcaattatttgtcagagttagaaagaagaaaccaggaaagaatctattactgtcattagcatttctgccttacacctggtaagcctcacttctttctataaatgaagaaaacaatgtctaccttgttcatatcacagctgcggtttacatggaacaacagatgtgacaactatttataaactattaaactacacaaacctaagatattttggttacagtagtcttttaacagcaatatatttttgtaatcagttacatgaatccaccataagtacaactccaaaaagccagccatgaaaagcttttatggactattctgcctatggggtagccctgctctgcctatgggcttttttttttcttaaaaaaaaaaaaaaaaaaaaaagcttttaccagggcatttagggcaaagtttcatgttgtccacacttatttttccaatagtacaggaaaaaacaacacagagagatataaagcaaatatggcaaaatattactcttggaatttagattcattgtaacaatctttcaactttttgaatgtttgaaaatttttataagagctagggggaaagtttttcttgtttttgtttttgttttgagacaggatcttgccctgttgcctaggctagagcagcagcacaatcagagctcactgcagcctcaaattcctgagctcaagcgatcctcctgcctcagcctactaattagctaggactacaggcatgcctcctcaccaggcctcactaattttttaaattttttgtagagatggagtctcattaggtttcccaggctggtctcaaaatcctgggctcaaacaatcctcccaccttagcctctcaaagcactgggattataggtgtgagccaccacatctagcctaaagaacttttttaaagttcttatatactgctgataaaatgccattgaggatgtataatttcttgaccatttaattgtaacccaaccaaaagcaccttatgaacaaaagccaactggccattaggttctgtctctaaaaggagtcttagcttctcaaatcaaatcagccctgctatgttctgaccatttatctagtgctgtgtaggtgggaccaatatagggtaaagggaatgatgtgattcaggcccatttccctttcctacctactgccaaatccattagaaaggcaagccagcattcagaagtgtgttggagtcagtctagtaagaattaagaaggccaagtatagcggctcatgcctgtaatccccccatgttgggagatcaaggcagaaggatcacttgagcccaggagtttgagttcagcctgggcaacacattaagaccctatttctacaaaagaatgtttcaaaaaaaccaattagctggacatggtggcacatgcctataggcctagctgtctgcgaggctaaggcaggaagatcccttgagcacaggaaggagttcaaggctgcagtgagctatgattaggccactgtactctagcctgagcaacagagcaagtcactgaaaaaaaaaaaaaaaaaaagaaagaattaagaagcaagagacctacattttaatacttgctctcctacgtaaactataccgtcttggatggcccaacttctccacatctatattcatggccaataaacataattcagagcctaatttgatctccttggattttttttccccaaatcaaataaagaattaatgttaattatattcttttttttttttaagacagagtcttgctctatcacccaggctggagtgcagtggcatggtctccgctcactgcaacctctccctcctgagttcaagcgatcctctcgtctctgtagctgggattacaggcgcccaccacacgcccagctaactgttgtatttttagtagagacggggtttcgccatgttggccaggctggtctcaaactcctgacctcaggtgatccagctgcctcggcctcccaaagtgctgggattacaggcatgagccaccgtgcccagccatgttaattatattctatatgtcaagtagacttcatagaacttcctcactgatggctgctttcatcatagctaccacctattcatttgtgaacacatcctagagaaagatgaaatttcaatttatgcaacaagagttagtcaaccagaccaaaaaaagtgatgtgattgccaaaaacaaaggtcaatttgaccttaggctacattaggagaaatatgtaatctggaacactgtggagataatctaactactagtcaaaccatatctggttcagtagagtcttcttttggcatacttttaaaaggatatgggacgggcacagtggctcacgcctgtaatcctagcacattgggaggacaaggcgggcgatcacatgggtcaattggaaaccagcctggccaacatggtgaaaccccatctctactaaaactacaaaaattagatgcgtgtggtggtgcatgcctataatcccagctactcagcaggctgaggcatgagaatcgcttgaacctgggagccagaggttgcagtgagctgagatcgcaccactgcactccagcctaggtgacagagtgagactccatctcaaaacaaaaaggccaggcacagtggctcatgcctgtaatcccagtactttgggaggccaaggcgggcagatgatttgaggtcaggagtttgaaaccaggctggccaaacatggtgcaaccccatctctaataaaaattttaaaaaatacaaaaaaattagccgggcatggtggcacgcacctgtaatcccagctactcaggaggctgaggcaggagaatcacttgagcttgggaggcagaggttgcagtgagccagaattgtgccactgcactccagcctggacgatgaagcaagactcccaaaataaaaagggggggagaaattgggggatgtatagccaagaaaagaatgttatgaaataacatactagttttcttcaactgtaggaaaagtaatgtggaagaatacaccaattccttttcttgcttttttttctagacaaggtctcggtctcattacgttgcccaggctggtcttgaactcctggcttcaagcaatcttcctacctccacctcccaaagtgctgggattacaggcatgagccaccaagcccagcctagacctgtttcttctatcagtctccaaggaataaaaccaggacagataaaacctatgatacatattttcggtctgtaaggcaaatcttccttactatcagaaatataatgaactccctcatgactattacctgccttgtaagcacaaactagtcaagtgcttattaagaaggatatagcacagctccaagcaccaaagagcttgctgcacagaatacttcagatgtcttcaagtggttctcaacactttagtattcaaaagaattaactgttgtgtttttgccaatgcatattccaaggccctgcccatgggtcctgattctcaggtctggggtgggctcaaaagtatggagatttttttgtttgtttttgtttttttgagacagtttcactccgttgcccaggctgtagtgcagtggtgcaatctccactcactgcaacctccgcccccgggttcaagtgattcttgtgcctcagcctcccaagcagctgggattataggcgcacaccaccacacccagctaatttttgtatttttagtagagacagagtttcactatgttggccaggctggtctcgaactcctgacttcaagtgatccatctgcctcggcctcccaaagtgctgggattacaggcatgagccactacacccagccaaaagtatgcatttttaataagcatgcctgagggatcccacaccaaagtgatttttatgcaactggcccctggaacacactatgaaaaatactaaacactttgcaacatgtgttgtaacataaatagaaaaactggtctcacctattgatttcaactattccaaatggttatctatctagcaattccaaaaagcaatgcttcatatctactaaaataaactatgattatcatagcttatgatcatgtagaaacaattctactgtcttttataaatatttctttaaagaggcaaattcagaccacaatctttcctatatttttccctatgggtgaattagatcctattcaccaagctaaaaaaaaaccaacaacaaaaaaacagaatacttaccactcctttttccactacttccttcagtttagagcgtgtcattttaggctcctaaggagaaaaaaacagaaaggaaatcctcaataaaaatcacagctcagtgaggtggctcatgcctataatcctagcactttaggggccaaggtgggaggatggcttgaggcaaggagtttgagaccagcctgagcaacagagtgagacaccctccctacaaaaaaattgttttaaattagctgggcatagtcgcatgttcctgtagtcccagctactcaagaggctgaactgggaggatcgctgagtccagcttaggagtttgagtccagccttggtgacagagcaagaccctgtctctaaaaaaataataataataaaataacaaggccgggcgcggtggctcacgcctgtaatcccagcactttgggaggccgaggcgggcggatcacaaggtcaggagatcgagaccgtcctggctaacgtggtgaaaccccgtctctattaaaaatacaaaaaattagccgggcgtggttgcaggcccctgtagtcccagctactcaggaggctgaggcaggacaatggcctgaacccgggaggcggagcttgcaatgagccaagatcgcgccactgcgctccagcctgggtgacagagtaagactccgtctcaaaaaaaaataataataataaaataataataataataaaataacaaataaaataagtaaaaattaccaagtaattcttatgttttgaaatgctaactttaaccccagctgccaaactgtttacaaactcctaagtgacctcctacccttagccagtttagagataactctgttccaagacattaaaagagtgataatcaactactcacaaacattggcatatcttccgtctcactgatggctgctttcatcatagctaccacgtgttcatttgtgattacttcctggagaaagatgaaatttcactttatgcaacaagggtttgtcacctagacaatactcatctctccatgtaactgtcagacctatgtacaggacaaatgagaaccatatactcgaatagcatcagactggggtaaagcaaggcaactgaaagcaaagaaggcagaagtaagttttggccagaaccacacagtttcaaacaatgtagcagcaaatgaaccaatctcattagctgctactaggaacaggaatggctcacataaaaggagatcctgaggtaagtaactatatgcttaagagaaagagtaacaagagcaaaggctctgcaaatagctgtgttgctacatatcaagaaaagtatttacatatgtacaaagtgcaataaactattaaccaggcatctttttagacatatcgacccacaagagtaaacccactatgaacattatcaacattgaatctactaaacaatacagtaaatatgaaaatcagtggaaggaaacaggaacagtttatctttccaattaaattcttctttaacatgtgttcatatttcaaacttgtactgagtgcaaggagaaagctatcttaaatatgtaaaaatgtaaaatgttctgtcacgggtaacccacaaaatcggtaattcacgtatcaagagtcaagaatttgctgaacatttttatatgctttccatgaaaaagttcccttccatttacataactgccccagtcttactcacatgaaggatgtttcggacattgactgctgttagattgtgctgcttggcaccatcctccaaggtacggtcaagcatgtcatccagtttcaggtcatatgccaaggtcccttcttgaccccttccatctcgtttcctcttggtaccctttttcttttttctccttttctcactttcttcattgtcttgttcttctgcaaataaaccaagaacatcatcagaattccaaaatagctgctccaggaacttagcccagaaagccaacagtaaagtggataaatctcaaaagcattatgctgtgaaagaaaccagatgtaaaaggacacatattatatgacggtataacaagtatagaacatttgcatagaagatgcaaaactatggaaatagaaatcagtgcttgccaatgtttgagaaagggggatagcaaaggggaattaggcaacttttggggtgacagaaatgttccacgttggttgtggtagcagttaacacaactgtatatatttttctttcttttgtttttttgagacggagttttcgctctttgttgcccaggctggagtgcaatggtgcaatctcggctcagcgcaacctccgcctcctgggttcaagtgattctcctgcctcagcctcccgagtagctgggattacaggcatgtgccaccatgcccggctaattttgtatttttagtagagatagggtttctccatgttggtcaggctggtattgaactcccgacctcaggtgatccacctgcctcagcctcccaaagtgctgggattacaggcatgtgccaccacgcccggctaattttgtatttttagtagagatggggtttctccatgttgctcacgatggtcttgaactcctgacctcaggtgatccactcgcctcagcctcccaaagctctgggattacaggtgtgagccaccgtacctggcccaactgtacatatttttcaaaactcatcagatacattttattttatatctcaataaacctaatgaaacttaccacattaacaaaatgaaagagaaaaaaacatgatcttaatagagataggaaaaagcatttgatgaaattcaatatatgaaaaaactcagaaaacttaggaaaattatttccttaacctaaaaaatatttctatgaaaagcctataactatcctcatatataatgaaggaatactgaacattttcctgttttgtccagaaataagacacagatgtcgactaccactactacttacaacctacatagcaatgaaggtctagaatatgcaataagaaaaattacgtgtccattttaaaagcatttgccaaagtgaggctggacgcagtggctcacacctataattccagccccttgggagcccaaggcaggtggatcacctgaggtcacgagttcaagaccagcctggccaacatggtgaaacctcgtctctactgaaaatacaaattagccgggcatggtggtgtgtccctgtaatcccaattactcatgaggctgagacaggagaatcacttgaacccaggagacggaggttgcagtgagccgagatcacaccactgcactcaagcctgggcgacggagcaagattcacacacacacacaaaaaaaccatttgctaaatcaaataaagaagtctttagtcatgtgtctgtgttatgtttcacaataaaaaatttagtatttcaaaagaattttaaggatgcccaaacttataagctagcatttccacccaacgaaaaagaagtacacatgttcagcaaaaaatctatagaatgttcacagcagcaccactcacagtagcccacaactgaaaagtatccaaatgctcatcaagaattgaatggggccaggtgcagtggtttgcacctgtgacccagcactttgggaagccaaggcgggcagatcatttgaggtcaggagttcaagaccagcctgaccaacatggtgaaaccctgtctctactaaaaaaaaaaaaataatacaaaaattagccggccatggtggcacgtgcctgtagtcccagctacttgggaagctgaggcaggagaattgcttgaacccaggaggaagcggttgcagtgagccgagattgcaccattgcactccagcctgggtgacgagagcaaaactccacatcaaaaaaaaaaaaaaaaaaaaaaaaaaaaggctaggcacggtggctcatgcctgtaatcccagcactttgggaggctgaggcaggcggatcatgaggtcaggacttcgagaccagccagaccaacatgatgaaaccccatctctactaaaaatacaaaaattagcagaggagtggtggagcgcacctgtaatcccagctactcaggaggctgaggcaggagaatcacctgaacctgggaggcggaggttgcagtgagccaagatcacaccattgcactccagcctgggcgacagagtgagactctggttcaaaacaaagactctgtcgcaaaaaaaaaaaaaaaaaagaagaagaagaattgaatgggtaacaatgggcacaaggaagcaaaaagaaaaaacaaagagttgaatggataaagaaaacgtaaagcaaaccaggtgaggaggctcatgcctgtaatcccagcactttgagagatcaaggagggactgctcgagcccagaaatacaaaaccagcctgggcaacatagtgaaaaccgtctctaaaaaaataataataataaaataaaaatgaaaattagccaggcattgtggcgtgcacctagagtccgagttgctggggaggctgaagtgggaagatcacttgaacctaggagttcaaattgcagtgagctatgatcatggcactgaacttccagcctgggtgacagagcagtacctatctctaaaaaaaaaattaaagaaaagaaaacatacataaactattcaaacaacagaatgatatacagcaataaaaatgaacaatctacaagtacatccaagaatatggatgaatttcataaaacaatgttgaggccgggcacggtggctcacgcctgtaatcctagcaccttgggaggccgaggcgggcagatcacctgaggtcaggagatcgagaccagcctggccaacatggtgaaagcccgtctctactaaaaataaaaaaactagccctgcatggtggccgtgccagtaatcccagctacccaggaggctgaggcaggagaatcgctggaacccggaaggcagacactgcagtgagccgagattgcgctactgcactccagtctgggtgacagagcaagactctgtctcaaaacaaaaaaaaaaaaaattgagagaataaacgcagtcacaatgccaggcacggtggctcacacctgtcatcccaacactttgggaggctgaggcaagaggatcaattgagcacagcagtttgagaccagcctgggcaatatagtggggctccgtctctacaaaaaaaattttttaattagctggctgggccgggtgcggtggctcatgcctgtaatcccagcactttggaaagccaaggcaggcagatcacctgaggtcaggagttcaagaccagcctggccaacacggtgaaaccccgtctctacaaaaaatacaaaaattagctgggcatgatggcaggtgcctgtaatcccagctactagggatgctgaggcgggagaatcgcttgaacctgggaggcggaggttgcagtgacctgagatcaagccattgcattccagcagcctgggcaacaaagcaagactgtgtctcaaaaaaaaagaaaaaaaattagctggctgtgacggcacgcgcttatagtcccagctacttagggctgagacaaaaagatcactttaacccaggaggtcaaggccacagtaagccgtgatggcaccactacactccagtctgagtgacagagtgagaccctgtctttaaaaaaaaaaaggcagttataaaatgtacacacgattccattcaaataaaagacaaaaagacagaacaactggctaggcgcagtggctcacacctgtaatcccagcactttgtgaagccaaggtgggtggatcatctgaagtcaggagttcgagaccagcctggccaacatagcaaaaccctgtctctactaaaaatacaaaaattaagccgggtgtggtggcaggcacctgtaatcccagctactccggaggctgaggcagaagaatcacttgaacccaggaggcagcggttgccgtgagccgagatcacgcccctgtacttcagcctgggcgacaagaacaaaactccgtctcaaaaaaaaaaaaaaaaaaattgaaccaatatatgatgctagacatcaggatagtggttaacctatgggtagagggtaattgaaagggaagacaagatggacttctgggtattgataacattctctatcttgatctgggtcctgcttacaagggtgtattaaatttgtaaaaatatagtgaattcaggatatcttaggacatgtgcagttttctacatattatacttcaataaagaggtttcatttaattaaaaagaaaaagaaagcctacccattggaatgaagagtccaccatcttctatctcttcctcaggttggtgaaacagagtcctgagtggcttttcttgaggagaggcacaaacatctggctgggttgatttcctgggctggcttactggttttgcagattggctgcctgatggcagggaaggtatctccccttcagaattcatttgaggtttccctggaagaatcacaaatattgctccacactttgaccattctcagtcatactctgttgtagaatttagcatcttattatagtgtttttaggtagacaacttcatgaattaagcatatactatataggaattttcctctcttaaatcaaagctcagatccaatttactcatctgtaaactcagggagttaaactaggtaattgctgaggtctttttatttctaatatgctttcagttttgcattttttcctatgaaaaatcagacttgtaaaggaaattcctgatgacattttatatagatgaccattaacaccatatttcatcaactataaatataatcataaaatgccctgactttgtaaatcaatttggcagagcagaagagtaactgtcaccataaaattgtaaatatatggttctacagttcattagacaactttctcacctcaacacttcataaacactccctttgtgaggggagtaggtgaggctagcattaaaaagacagagaaaaaaggggtgatggtgcatgcttgtagtcctagttacttgggggggctgagctgggaggatggcttgaggccaggattttgaggttacagggagatacgattccaccactgcactccagactggacaacgcagcaagaccccgtcacacacacacacacacaaaaaaaaaagccaggtgcttatagtcatgaggtggctcatgactatcatcccagcactttgggaggctgaggcaggaggatcacttgaacccaggagtttgagaccagtctgagcaacatatcgaggctttgtctctactaaaaataaaaataaaaaattaggctaggccaggtggctcacacctgtaatcccattactttgggaggccagggcaggaagatcgctttagccaggatccaggagttcgggaccagcctgagcaacatttggagataccttgtctctacaaaaatatagagctctaaaattagctgggtgtgttggtacacacctgtggtcccagctacttaggagggtgtggtgggagaatcacttggaccctggagttcaaggctgcagtgagctgtgatcatgccattgcactccagcctgggtgtcagagcaagacactgtcacacacacacacacacacacgcaaagaaatattcatgtagtattaaaagtaggctgggcgcagtggctcacatctgtaatctcagcactatggaaggctgaggcaggcagatcacttgaggtcaggagttggagaccagcctggccaacatgatgaaacctcggctgtaaaaaaagaatacaaaaataagccaggcatggtggcaggcacctgtaatcccagttacttgggaggctgaggcaggagaatcgcttgaacctggcaggcagaggttgcagtgagccaagatagtagtgccacttcactccagccagggcaacagagcgaaactccatctcaaacaaaacaaacaaacaaaccaaaaaagaatgctgggcacagtggctcacgcctgtaatctcagcactttgggaggctgagatgggtggatcacttgaggtcaggagtttgagaccagcttggccaacacggcaaaaccccgtctctactaaaaatacaaaaaattagccaggcatggtggcgggcacctgtaatctcagctacttaggatgctgaggtaggagaactgcttgaacccaggaggcggaggttgcagtgtgccgagatcgcgccactgaactccagcctgggcgacagagagagactctgtctcaaaaaaaaaaaaaaaaaaaaatggtaaacatcagaaatcaggctatcaaggaaatagcttgcatatatacagaaaatccctggactatacacaaaaaattgtttaacagttacctgggaagaggacttggggagcaagagtacaaagtgaaaggatgcctaaattttcactgtgtactttttatatttctgaattttttccctagtttgtgtattacttagttgaacattttctttcaaaacacatggccagtctttatacttgggtctcactctgtcgcctagcctggagtgcagtagcattgttatagcttacttccatcacaccatccagctaaatcttctgctttaatggtgtttattctaatagaattttacttgttcttctgaatttgacttacataccctaatttccacttatgcttctcctttctttgcctcctaaaagtgagtagcatgattttagcttataattagttgatttgtactgttctcagctaattttgatgttatgatcagccaggcatggtggttcacacctgtagtcctagcactttgggaggccaaggtgggcggactgcctgagctcaggagtttgagaccatgctgggtaacatggtaaaacctcgtctctactaaaatacaaaaaattagccagccgtggtggcaggtgcctgtaatcccagctattcaacaggcacgagaatcacctgaaccggggaggcagaggttgcagtgagccaaggttgcagtgagccaaggttgcaccactgcattccagcctgggcgacagagcgaggcactgtctccaaaaaataaacaatataaattaaaaaataataattttgatgttatcaacatacagttctcaggctggcagtacataagttacagatatgctctgaataaggtttgctttctctatttctcttattctgctcagcttctctttctgaggtcttttagcatccagcatatctataaaggaaggtggggtcctaaagggctctaggaaggggaaataaattgaaaagcattgtggagtcagaggggaaaaaaaggttgtagaaaaaaggaacatttcctctagagtatgaaaaatgattttgtggtgcagctgataatgtgcttgcagggacagtttttttgttttttttttttccagacagagtctcgctctgtgggccaggctggagtacggtggcatgatctcagctcactgcaacctccgtatcctaggctcaagcaattctcctgcctcagccttccgagtagctgggattacaggcgtgtgtcaccacgcccagctaattttttatttttagtagagatggggttttaccatgttggccaggctggtctctaactcctgacctcaggtaatctgtccctctaggcctcccaaagtgctggaattacaggcatgagccacgcacccagccctgcagggacagttttaaaaagcagttccaattttttttttttcttgagacggagttccattcttgttgcctaagctggagtgcaatggcacgatctcagctcaccgcaacctccgcctcccgggttcaagagattctcctggctcagcctcccgagtggctgggattataggcatgcaccaccacgcccagctaattttgtatttttagtagagatggggtttctccatgttggtcaggctggtctcgaactcctgacctcaggtgatccgcccacctctgcctcccaaagtgctgggattacaggcacgagccaccgcacttggccaagtagttccaatttttttgttgttgctgagacagggtctcgctctgtcccctaggctgaagtgcagtggtacgatctcagctcactgcggcctcaacctcctgggctcaagtgatccttccacctcagcatcccaagtagctgagactacaggttcctgccaccatgcccagctaattttattttatttttgtagagatggggtctcactatgttgccaagtctggtcttgaactcctggccttaagcaatcctctcacctcagcctcccaatgtacagggataggtgtgaaccaccatgcctgaccccaaatattttttaagtagtaaaaatgtcagtggaagaggctctgcctaccaaagtgaatctctgtgttttgaagggcaatacttgcttagatttaaaagttctggtatgcttgtttaaaaagtaatttgtgggctgggcatggtggctcatggctgtaatcccagcactttgggaggctgaggtggacaggtcacttgagctcaggagtttgataccagcctggttaatgtggtgaaacgctatctcgacaaaaaatacaaaaattagccaggcatggtggtgcacacctgtagtcccagctacttgggaggctaaggtgggagaatcacttgagcctaggaggtcaaggcagcagtgagccgtaattgcactgctgtactccagcctaggtaacacggtgggaccctgtctaaaaaaaagttatgtgtggcttcatgcctgtaattccagcgttttgggaggccaaggcagaaagattacttgaagccaagagttagaggttgtagtgagccattattgtgctactgcactctagcgtgggctacagagtaagactctgtctcgttaaaaataaataaataaataaataaataaataaataaataaataaataaaaagttatttctagttgagcccagtggctcatacctgtaagcccagcactttagaaggctgaagcagcaggatcatttaaggccaggaattgtaggttgcagtgaattatgagacctcacctgttaaacaaacaaacaaacaaaaaacatttctatgctgggcaacttatagagaccttgtgtctgcaaaaagtcaaaaaaaaaaaaagctgggtgtggtggtgcaggtctgtagtcgcagctttttttagctggatgatgtggctcctgcctatagtgccagttacttggtaggatcagttcagcccaggagttagaagctgcagtgagctatgatcgtaccactggactatagcctggatgacagggtgagacctcatctctttaaaaaaaataaataaagaaaaggtttaaacactaatacctgcagtcaagaaacatgatttaggctggacaatgcaaacccaggaggcggagcttgcagtgagccgaaatcacaccactgcactccagcctgtaatcccaacactttggaaggccgaggtgggtggatcacttgagatcaggagttcaagaccagcctggccaacatggcgaaaccctatctctactaaaaatacaaaacttagccaggcgcagtggcacatgcctgtaatcccagctactcgggaggctgaggcaagagaatcacctgagcccgggaggtggaggttgcagtgagctaagatcacgccactacactccactccaacctgggcaacaaagcaagactccgtctcaaaaaaaaaaaaaaaaaaaaaaagaaagaaaaaaaaagaaaaaagaaacatgatttaacaatgtattgcccggcaaggtgcgcctagcgcagtggctcacaccgtaatcccagcactttgggaggccgaggcaggtggatcacaaggtcaggagttcaagaccagcctgaccaacatggggaaaccccacctctactgaaaatacaaaaattagccaggtgtggtggcaggcgcctgtaatcccagctactcgggaggctgaggcaggagaattgcttgaacctaggaagtggaggttgtggtgagccaagatcatgccactgcactccagcctgggtgacagagcgagactctgtctcaaaaacaaacaaacaaacaaacaataacaacaacaaaaaggtatcaattgtaacaaaatgtcaatacttgaaaataatccaactatctttctatgtattttcattttttctacagtgtatatgatgctgctgctttcataatcagaaaactaaaatgttacttaaaagaaagtaaaacaacaaaaacacatactaaacagcagggctacgggtgatttttattttctcctttaaagttttcaatattttccaaagtagatatatgtgaattgtcaatctttctttcttcctctctgttttgtgttacattatctgattggcaaaaaaaaaaaaaaaaaaagttacttgaagaaaaattctggagagacactcatagtgtacttttattgctattacttgtatatacaactaattaaagtgcaaagtagtataatcaattttcagttctccagattaatgaaggggagtgatatcacagataatactaaacaataaatgtttatttaaatccggatatctgtgaactgatttttaaaatctcttaattacacttatcaataactgagtgactatgaacccatagttatttatccattccttctctagcattttaatcttataatttcctccagttccttctgacaacttatcttgaaaaaatatgcaataatctcgctgccttctctagctatttctcacccattctcccactgcaaaaaaaggaaggaaggccaggcatggtggctcacacctgtgatcccagcattttgggaggccgaggcgggcagatcacaaggtcaggagatcaagaccatcctggctacggggaaaccccatctctactaaaaatacaaaaaattagccaggcatgatggcaggtgcctgtagtcccagctactcgggaggctgaggcagaagaatggcgtgaacccgggaggtggagcttgcagtgagccgagatcacaccactgcactccagcctggtcaacaaagcgagactctgtctccaaaaaaaaaaaaaaaaaaaaaaaaaaagggaaggaaggggaggggaggtgagggaaggggataagagggaagaggagagtggggaggagaggggaggagaggaggaggggaggaagggaggaggggaggagggggatgggggagaggaaagaaagaaaaatctctggggtttcattcctcctcctttttcttttttttacagacaaggtcttgctctgtcacccaggttgcaatgcagtggtgcgatcagagctcactgcaaccttgaactcctgggctcaagctatccccctagctactcctgagtagctaggactacagggatgcactaccacacttggctaatttttaaaattttctgtagagatggaacctagctatcttgcccaggctgttcttgaactcctggccacaagatcctcacaccttggccttccaaagtgttgggattacaggtgtgagccactgttcccagccccattccttcctctttaactgcttcatataatgtcctttccccaacaaactcctgaatctactctccaagatcatcaatcttcaaatgtaacctttttctcaggtattatccttatccctcctttgctactaaattttaaatttacattttaaagtaccttgttcttaaagctctccttcctcttttcacttttactattacttctccagttgttccttctctgttatcttcttcctcaaggcaaggttgtcttcaatccactgctcttccccctccatgtctgtttccatggagaagaaccatgactaacactgaacatttctagtccttgcctcttactaaacttcaatctcagatttctatttttgcttgctggccctattgtcacctcacattccatttgaggtaggagatcagcaggacttgttttccaagcactgttcgaaagaccccgctgaacaaaacaggagctgatcaaagaaactggccaaaaccagctaaaagcaagatggtgatgaaagccacctcctgttgccctccttttatctgcatgctaaaagaacctcctaccagcaccatgacagtttacaaatgccatggcaacccccagatgttaccttatatggtttaaaaggggagggactctcagttccgggaagtcctcgccccttttccagaaaatccattaaaaatccgccccttcgcctctgcccagctgcccctactgggaagtgaggagcccctctgcccagccagccgccccgtccgggaggtgaggggcgcctctgcccagccgcccctactgggaagtgaggagcccctctgcccggccaccaccccgtctgggaggtgtacccaacagctcattgagaacgggccatgatgacaatggcggttttgtgtaatacaaaggggggaaaggtggggaaaagattgagaaattggatggttgccgtgtctgtgtagaaataggtagacatgggagacttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagtcatcaccactccctaatctcaaggacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaaaaaaaaatctgccccttattttagcatataatcaaagtatacccatatatatatggctatacaggtctcatgcttttgagggtcactgttggccaccccctaggtgctctgggattttcgtcatttggtatggggaccctcatgggctgatgcctggatactctgggtattttggcatttggcaccgtttcattttttttccatgttgtctttgtatacatacagctagccagcaatccgcaggtctgctgctgcggctgcttctcttacagagcagccatttcccttcctctgttgctctaataaacttactttcaattcactgttggcccattcatgattccttccagtgcgaagccaagaatgctcctgggctgagccccaatttggggttcacctgcgtcattccttggtgaccatgaagagaccaataataagccaaaaggaactgagggagacctttagccagaccctaaattaagactgattgggttgagcaccgtggctcacgcctgtaatcctagcactttgggaggccaaggcaggtggattgcctgagctcaggagttcgatactagcctgggcaacagagcaaaaccccggctctactaaaaatacaaaaaattagccagccatggtggtgcacgcctgtagtcccaggtacttgggaggctgaggcatgagaattgcttgaacccaaagactgactggcaccatttggcctccacgaaaagatgagtgtcccctttgttccccctcaatgtgtgttttgttttcgttttttttttttttttttgagacgacatcttgctctgtcacccagggtggagtgcagtggcacaatctcggctcactgcaacctcgcctcccgggttcaagcgattctcctgctttcagcctcccgagtagctgggatgacaggtgcctgccaccacacccagctaatttttgtatttttagtagagacagggtttcaccacattggccaggttggtcttgaactcctgacctcgtgatccccccgcctcggcctcccagactgctgggattataggcgtgagccaccacgcctggccgatgtggtgttctttaactgatttactttctctttcactctcctctccctttaccttttcaaatcaatcaggaaatggggaatagtgtctctgggttgttagtcagttcgttgtcccccatcatctgggtgccccagacagaagcacacctggacatccacgtcctttgtaatttactttgtcaccttctctctcagaccttttctctttagcttctaatgaccagtcattttacttttctgctcttagtgcctaaatgcacacttatgtttatccagttgtcatgtttgtagtccctgttttggcaatttgggcagttgtttctattccatgtaaggcaggcttttgttattttgagaggtattcctttgtgctgactctgggatgtcagagtcacattattctatggccccaactgtgttaggtctcatgcctttgggcctcactgttggccacccccaggttttcagcatttggtatggggaccctcactggccaatgtctagatactccaggtttttcagcatttggtgccgtttcatttttttccttactctgtcattccatccacttcagcaacttcttctagtccctcctaaaatcataaattttcttttctgcaacaggtctcttcctgtctttctttctgctcaaaatgagggtcccaaatgagctgccttgttcaagcccatttttctggaggccctgaacccctgacctaatgacgactccctgcaatggcagaaaagcagccgcctgaacactttttttggtgtctccactgatgggtgagttctccactgtctcagggactccaaggacacgccctgaacaacaacccctctcttccccaattcacatttgctgctacgggagcctgtttttcctagcttcctttccctttctgccttttcagtcttcttttattatacttctactggttcatgtctctctaggattgtgggtccctgggacagtcccaaggtcttgggtccaagatatctgatattgaagttgtcatggtaaggtgacccttcatccatcaatgagtgttctggcttgctgtatctctctctctctctctcccccaccagagaaacaaagggaaaggtacccctcatccccctactctccctcctttccctctttttctttcctgcccttttaaatcatctcctcctcctctgaagctgaagggggaaaaaaggataaaagagggttttaaaattaaaactgttatgaaaactaccttacccaaattctagtctacagtttccttggattacctattagaaaaaaaaagtttagccatgtgaacaggtttcaaaattgtcagaaatatttaaatccagctatctttaataaagtccaaaggcttttcaagttcacatgaatcctttggtaaataaaacttgttttcaaattattaataaagactgggtgctgtcgctcacacctcccaaccttttgggaggctaaggtgggaggactgcttgagcccaggagttcaggaccagcctgggcaacatagtgagactccatctctaaaacaaaacaaaaaaaattagccaggtgtgacagcacacacttatagtcccagctactcaggaggctgaggtggaagatcacttgaccccaagaggcggaagctgcagtgagctgtgatcatgccactgcactccagcctgggcaacagaaaccttgtctcaaaaaattaattaattaaattaaataattgatggaaatagaaatgtcttcagaattgtataaataagacgaatttaagattgttggctcaatgaaaatagctgaatcttctcagttactggcaaaatgcccatgtgtttaagattcttacttaggggttcacctaatgttcagagtttaaaaatggttaaccaggaaataactttgaataatgaccaattttgtctaatatagttccagctaggcacaggggctctcacctgtaatcccagcactttgggtggccaaggcaggtggatcacttgaggtcaggagtttgagaccagcctggccaacatggcaaaaccccatggctactaaaaatacaaaaattagccaggcgtggtggtgcatgcatcccagctacttgggaggctgaggcccaagaagctcttgaatccgggaggcagaggttacagtaagctaagattatgccattgcactccaacctgggtgacagagtgagactctgtctcaaaaaaaaaaaaagaaaaaaaattataaataataataataaattaggtaaatataatgagataaatgcttataagtgaactttttgtataatttaaaatcttaaaatcgttttggatgcttattggatgcctgggtcatttccaattaagaaaggaatattatatagggaaacattttacaataaaataaaaaattttaaaaactgtggaatggttctcatctataaaatgctaatatctgatagttcaggatttcttccttcttaggtttatataaaacttaccaaagaagatgtgtttttattgagaaaaagaataattgtgtctaattcaaaagttatctaaaggttgattcaaattatggacttgaaaaggttatttatataaccaggtagaaaggaaccagtaagtaggggagagataggtaaagaaagttatggatgttcagaggtatttttggtaagaaaggttataaataaaagagaataattctacataagaaagaatcctgcagatctcagtgggaaaaaaaaaaggatcttatatggtattgttctagagtagtagaatgactagttatttaggaaaagtagtataggccaggcacagtggcttatgcctgtaatcccagcactttgggaggccaaggtgggtggatcacttgaggttaggagtttgagaccagcctggccaagatggtgaaaccttgtctctactaaaaaatacaaaaattagctgggtgtggtggcacacgcctgttaattccagctacttttgaggctgaggcaggagaattgcttgaacccgggaggcggaggttgcagtgagccaagattacaccactgcacaccagtctgggcaacagaatgagactctgtctcaaaaaaaaaaaaaaaaaggtagtattggacaagtcagaaagttcattcaaccatatcatacatggtctgtgcaggtcataagatttataaaggagaatttataaaaagaattgtttatgtgattaagttagctataattaaaagtggaatctttctaaagaatggtctcctatgttaaagtaagggtttcaaggtattgatttgctcttaatgaaattacaagaaaatttgcttttcaattctataacttgtttcttttgaaaatttctcagattcatatctcataagttcaattgttctatctcactgctttcagctttttctccccttgagaaagcctgagacattagtctctccttcaaccttttcatcagttgctgtaactttttctcttccagttctgtttttacagtcagatgctgaaatattttagcttagaggtctataaaagcaatgttttcctccagtataacttgattctatactcttggtttttcttgacatgtctaaattttcagagtaaccagaaaacttttcatgttcacctgctatattcaaaaccttgaacatactttgtccgattaaattcaagtattatttttctcttcatcaaatttaacttcaagattagttaagtgggcttcccataaggagagacaattacactgcagagagattaccactttgggtaaataagtaactattacttacagtaacctgtggttctgtgtcaatacagtattttgggctttttaacatcttttacaaatgcccccagaatcgaatcctagcttgattgtctggcttgttgctgggctttatcaaagctataaaaactaatcactgcaaggttgtgatatatttttacagcctcctgacaggttgtggactccagcattaccactgccagccctttaaaaagttccttatcgggtgctattaactaatcaatgtgcttttgagttacagggctttgactcctgggtacagacagctcatctagagaaggcaccaactcttgccaggatctaacaccaaactcaagttaaccaaagccttgtctttagacctgggcaaaaggggcaaagtaaactgctttaggacgggcgcagttgatcacgcctgtaatcccagcactctgggaggctgaggtgggtggatcacctgaggtcgggagttcaagatcagcctgaccaacatggagaaaccccgtccctatcaaaaatacacaaaaattagctgggcgtggtagtacatgcctgtaatcccagctactcgggaggctgaggcaggggaatcgcttgaacccgggaggcggaggttgcggtgagccaagatcatgccatggcactccggcctgggcaacaagagtgaaactcagtctcaaaaaaaaagtaaactgctttaatgagacacagggacaagcttgtattcatttaataattttgcctctatatgaattaatataacttattctatgccttgatactaaataatttaaatgtttaggtacctgtaagattcctttcctgtcattctcaaaactagggcagggcttatgacttttttgtttgaaacattgctaattctttatgtgttgttttatctacagaatttaaaactattcaattcctccaggcccaaggactactgaagaggtgggcatgagagattataggggctgggttttgagggatataattaattcagaccttccaaatcaaggacaggcacacagatacctaaatagctgaacaaaatgtttgtgttttgtaaacctaattgctgcaagccaagattacaatagctcaatgcacagaatttatagataagtcagttttataaccttattttttggcttctggttttggctcttatattgcttaaaaggggttttaagagataataatgagtgcctgcctacctccacttccatctggcctacaatgtttaattggctataagtcacttgaatctaagtcccttggccatcagcgtcccaccaagggacatgagggacctggggcaggtagcacaccacctcagcattggtatggaacaaaataaaagcttggccagcaatattgcctctggcagctggatgcagtggctcacacctgtaatcccagcactttgggaagccaaggcagacagatcacctgaggttaggagttggagactaacctgtccaacatggtgaaaccccatctctactaaaaatacaaaaagtagctgggcgtggtggcgaacgcctgtaatctcaactacctgggagcctgaggcaggagaatcacttgaacctggaaggcggctgttgcagtgagctgagatcgtgccactgcactacagcctgagtgacagagcaagactccgtctcaaaaaaaaaaagaaacttgaaaaactaattcaggccatgacaagaaacaaggggttggacaagcctcactataccttccccccgctcccctttggaacttaagagaccaggttcaaaaggcactctaagaatatgaaaataaagtattgccctttcccacaaaggaaaagattgttccctgtttaaccaggacacctagtcctattaaaaacttggggcaggggtggtggctcacgcctgtaatcccagcactttgggaggccaaggcgagtggattacgagatcaggagatggagaccttactggctaacatggtgaaacctcgtctctactaaaaatacaaaaaattagccgggcatggtggcaggcacctgtagtcccagctactcaggaggctgaggcaggagaatggtgtgaacccgggaggtggaggttgcagtgagccgagatcgtgccactgcactccagcctgggcgacagagcgagactccatctcaaaaaaaaaaaaaaaaaaaaaaaacttggaaagggccgggccagtggctcatacccataatcccagcactttgggaggccgaggtgggtggatcacgaggtcagggaatcaagaccatcctggccaacatggtgaaaccctgtgtctagtaaaatacaaaaaatttagctgggcatagtggcacatgcctgtagtcccagctactcagaaggctgaggcaggggaatcacttgaacccgggaggcggaggttgcagtgagccaagatagcaccactgcactccagcctaggcaacagagcaagacttcatctcaaaaaaaaaaaacttggaaagaaggattccttgaagatcaattataatataaccaatatggaagggcacccactccccattaggtattgttaagcactcccactgctgttaaacttcggggaatcactagctaggtacacctgtcccggattaaacaaacctgtttttggtgaatccctacaggcacaagaggaggacaccatgacctacacctgcaaacctctggaagacttaaagttgctatttcacaagacagataagtagcaaccacctcctcctgagaaacaccttacttgtccttattgagtatagggaccaccctaaagcccagtgtgatactcagttgtccctgttcttcttgctccctgctcctaatcaatctaactcgctgtggaatgggaacaaaactccatagtaaacatttctagaattatagcatcaggaaatagcctgcatgattgcagaatctgtcatcagcaccctcaggatagagagcatcaccttctggtgcaccctgcaaacctcacagccatctccccaaacctcctaattggccatagtgttcctttggtacctaggcccctacttataaaacagctctctcccacacttaacagattgacctgactcctctccaaccaccctcctaccccctactattacctggacctaggatgttgggtatctacagctccagtgtactaatgatactatcttttgcacaaattgttgtgacaatgacacagagacagaaattccccacgatgctctgacccaaccctagtagccaaattcccaaggccatgggagggcaaacgggatcccactggtaaacaaggagactatacatggtgcctcctccaggaccaatacatgcaagggagaaacgactgcttaatttgggaagatggaggtaccaccctctggtggaaaacgagggctactcaatcacccccattggaacctggaaaaggtatctctatagacccagtttggcaataaaaaatggacggcataacttgcaaggattcaatttgtgacccatctgggctcacctttaggggaagaaatcctaccccatacccactcccaaccctgtagggaaccatttattcttctaggaatagctttccattttgcttatcaaaaacttgaaacaccagtgaatgtattttggccaccattatcccttcagggggtatccattcataaccccataaaatctagaaaaacaagaagtaaaagagcaataggattaatttttacaggaattggggcagcaataggggtggtggccccttggcaggggctttgcataccacaagtcaatgctaagaaacataactcaggccctagaatctctggccaccaacactagtcagacattaagaaaaattcaggaatctctggactctttggcaattgtagccctgacaacagactagtcttggattgtttactgactgaaaaaggtagagtctgcactgttatcaataagaccgactgcacatatattaacaactctggacaggctgaggttaacattcaaaagttctaagagcaagccacctggttacatatatataaccagggaactgaccccaactatatctggttgaccataaaaaacaccctcctggccaggcagagtggctcacgcctgtaataccagtactttgggaggctaaagtgggaggatcacttgagctcaggagtcaagaccagcccgggcaacatagtgagactgtgtctctataaaaacatttaaaaatcagctgggtgttgctggcaaacacatgtggtcccagctactcaggaggctaaggcaggaggatcacttgagcctgggaggttaaagctgcagtgggccatgatcacaccactgcactccagcctgggtgacagagcgagatcctgtctcaaaaaacccaaaaaataacaacaacaaaaaaaaccctcccaagtctcacctggtttctactctttttaggacctctagcagctatcttgtaactatgaatctttggccctgcctcttttagcctccttgtagtgtgtgtcttctagattgcaacaatttccatgtgaagataatgctagcaagtggcttccaacacatccttgttctgaccccttagatgaggcatcaagagatttttactcctccagtgctaggcagggccaatgcccataaaatcaacaggaagcagtcacagaagatggacttccacccttctaaaaccctgtaagattgaaggggagtatataatctctgtggggggagtgaggtaggagagaagcaggatttgttttccaagcactggccagagagcctgctgaacaaaacaagaacaaaaccctgatcaaaacaggatgcagcaaagaaagcagccaaaaccagttacaaccaagatggcaacaaaagtgacattcggttgctctcactgcttattatacactaattataatgaatttgcatgctaaaagaaactccagtgggtcacagggagccaggcctggtggccagagtgtatcatgaggctggacctggtggtgcagaaggtggtagtccacccccaggtactgctcaatgtggtggatcatttcaacagaatcagcaaggttggaaaccagaaatgcattcttcatgtgcttttgcggtcatggcaaatgaaagtacttgatgtatccagcagttttacagtcccttttaatgaagatgacaaagataattgttttttagcccacgattatttgaaaaacacatacagaatgtttaagagggtgaatgccagggaaagaatagttgagtggtaccacataggccctaaactacacaagaatgacactgccttcaatgaaatcatgaaaagatactgccgtaactcagtattggtcactagtgacatgaagccaaaggacttagggctgcctacagaagcatatatttcagtagaagtctatgaagatggaacttcagccttgaaaacatttgagcatgtgaccagtgaaactgcagcagaggaagctaaggaaattggagttaaacacttgttacaagacatcaaagacactacagtgggcactctttcccagtgtatcacaaaccaggtcctggatttgaagggactgaactccaagcttctgggtaccagaagctacctggaaaaagttgccacaggcaaactgtccaccaaccaccaattcatctatcagctgcaggtcttcaagctgctgccagtcattagcctataggagtttgtcaaggccttttacctgaagaccaataaccaaatggtagcagtgtacttggcctcgctgatccattctgtgatcaccctacacaacctcatcaacaagattgccaactgggatgcagagaagaaagacaggaaaaagaaaccggccaggcgcggtggctcacgcctgtaatctcagcactttgggaggccgaggcgggcggatcacaaggtcaggagatcgagaccagcctgtctaacacagtgaaaccccgtctctactaaaaatacaaaaaaattagccgggtgtggtggcgggcacctgtattcctagctactcgggaggctgaggcaggagaatggcgtgaacccgggaggcggagcttgcagggagccgagatcgcgccactgcactccagcctgggtgacagagcaagactctgtcaccaaaaaaaaaaaaaaagataggaaaaagaagagagcaaaaaaggatacaaaagacgacaaagagaaagataaaggaaaaaagtgatataaagagaaaatgtaaaacatatagattttttaatttgtaaactaaaatcttataaactaaaccagcgtgctactggggggttcttttccactttaactgcttgttaaaaagctgtcctgggccaggcacggtagctcacgcctgtaatcccagtactttgggaggccgaggtgggtggatgacttgaggtcaggagttcgagacagcctggccaacatggtgaaaccccatctctactaaaaatacaaaaattagcttggcatggtggcacacggctgtagtcccagctactcaggaggctgaggcagaagaatcgcttcaaccgagcaggggccattgaggttgtgccattgcactacggcctgggaaacaagagtgaaactctgtctcaaaaacaaaaaaacaaaaaaaacacaggagttgaattttccccatcttgaaagactctttcagtctgtttctggtaatttacaaaattgctaaatggaatacacaaattccgcatgttctctgactccgtgagttgaacaccgtgagttcgaacccttctgaactcagaataccacaagttttggacccatagctctagcactctcaggcttgggatccaggctccataaattgtttaccttgaaagacacaattaaatggattggttttaaaaaataaaaacaggctgggcatggtggctcatgcctgtaatcccagcactttgggaggctgaggcgggcagatgatcacctgaggtcaggagttcaagaccagcctggccaacatggcaaaaacgcatctcaattaaaaatacaaaaaaagccaggtgcagtgactcaagcctgtaattccagcactttaagaggctgaggagggcagatcatgaggtcaggagtttgagaccagcctgaccaacatggtgaaaccccgtctctactaaaaatacaaaaattagccaggcatggtagcgggtacctataaccccagctactcaggaagctggggcaggagaatcgcttgaacccaggaggtggtggttgcagtgaactgagatggcgccactgcactccagcctgggcaacagagcgagactccatctcaaaacaacaaaaaacaaaaaaaattagctgagtgtggtggtgcatgcctgtagtcccaggtactcgaaaggctggggtaggagaatcccttgaacccaggaggcgggggttgcggtgagccaagatcgtgccactacactccagcctggggaacagagtgagactctgtctcaaaataaataaacaataaataaatatatacatacatacatacaaagaagaaaagtcccaccactgccatgacagtttacaaatgccatggcaacccctagaagttaccttatatggtttaaaatgggaggatctcttggttctgggaactccctgccccttttctagaaaattgatgaataacctgcccttatttagtatataatcaaggaatagctatctattcacaagggctgctgctattgctgtgtctatggggcagccatttcctgtactctgctgctctaataaacttgctttcctttttctctattggcttgcaaatgaatcttgcacaaagccaagaacccccctgggctgagccccaattttggggttcacctgcataactcatacccaaatctgaactcatattcaaactctcaaataccttccctatgaaggcatgcatcaccatcccctaccccagatatcttacatgtcagtctctgagcagtgttaatcatttctttgtaatgtgtctatggtgtacccattcttctctacccttactgccagcatcctattctaaatcttaaggtcttaaggggaaagcttcaaggctctccataatctggatctactctttctacctgaagccttagtactttcccacacaaacacagcatttctacatgtttgcagaatatgttattctacttccacttcttccctcacaatctatcaaatcctgtgaatccttcaagctccaattccaaaaagtatatatttatggttgttttcccaattaagattctaaacttcctgaggttagaactatgtcttctgcttcttttaaatgtcacacagatagagattatgttttaaaccaaaactcagaacaaaggatttctttgtcattttcagacaaaaaaaaatctgagagataaaagttaaacatcaaaatgtgttttgtaggttactgcaatggtttactaaaactacggaattgtaggtcgggcgcggtggctcacgcctgtaatcccagcactttgggaggccgaggcaggcggatcacctgaagtcaggagttcgagaccaggctggccaacctgatgagatcccatctctactaagatacaaaaaattagctaggcctggtgatgcacacctgtaatcccagctacttgggaggctgaggcaggagaatcgcttgaacccgggaagcagaggttgcagtgagccaaaatcatgccactgccctccagcctaaacaacagagactccatctcaaaaaaaaaaaaaaaaaaaaaaaaaaaaggggctgggcactgtggctcacgcctgtaatcccagcactttgggaggctgaggcgggtggtcatttgaggtcagaaattcaaaaccagcagggctgggcacggtggctcacacctgtaatcccagcacttgggaggccgaggcaggcagatcacgacgttaggagatcgagaccatcctgactaacatggtgaaaccctgcctctactaaaaatacaaaaaattagccaagcgtggtggcgggcgcctgtagtcccagctactcgggaggctgaggcaggagaatggcgtgaacccaggaggtgaagcttgcaatgagccgagattgtgccactgcactccaacctggctgacagagaaagactctgtctcaaaaaaaaaaaaaaaaaaaaggtagttcaaaaccagcctgaccaacatggtgaaaccccgtctctactaaaaatacaaaaattagccgggtgtggtggtgggtgcctgtaatcccagctactcgggaggctacggcaggagaattgcttgaacccatgaggcggaggttgcagtgagtcaagatcgcaccactgccctccagcctgggcaacagaacgagactccgtctcaaaaaaaaaaaaaaaaaaaaaagaaagaaaacttgattctgtcctatgctttgaatgtacatctctcccggcttcctgaattagtagttgaactgattcttatctccttactattttctttaaactatctcaaaggaaatgccttttttccagtaaaaacacctaaattccagtatcaccttaatttgtcctgatctagtatattctgctcttaaaaaaaaaaaaaaagaataaaagagaaaaaaaggaaaggcatggggagaataaagaaaaaccttcatttctcctttccttatgtctaaataatgagaactcaaaaagactgaggcttaagcacttgcctcattaagtggaaaactatcaaaataagaatttcaaagtaataaaaagtatttgtccacatcaactatgtgcaggacaatgtcctgccttgttttattttttatttatgtgatcaaaagtcaaatctatgtaattagcaaaatggcacaagctatttacccttttttattctaaaaaattgtgtagaagattagcagtgaaacaatatataatacacatacaaaaaaaaccgctattcctgtctacatttccagataaaacacaggtgtcccaaaagcaatacaacaatgcaagctactgtgaatgaggctgaaaatttagagccacatgctatgacaagggatgattccacaggagagcacttttccccaaaagagctttcatctttgacaatgtgcttcaggcagctcatgccagagagggcgtgaccaacacagtataccatcaagattattgctaaactccctcatcttgggcactccatcagttttcaaatacagcagagtcagaaacatgaaattcttcaatataaacacacacaagacacaataaaaaaccacatactgagaatgtaccagtaggacaaaataagaacaagtggacttaaaatgcggcaaaaaagaaaacatcttaacagtcaaaatgaatgaataggccgggtgcagtggttcacgcctgtaatcctagcactttgggaggccgaggtcggtggatcacgaggtcaggagttcgagaccagcgtggccagcatggtgaaaccctgtctcaactaaaatacaaaaaaaaaaaaaattagctgagcgtggcagcgtgtgcctgtagtcctagctacttgggaggctgaggcagaattgcttgaacctgggaggcggaggttgcagtgagatgagatcgtgccactgcactccagcctggcaacagagcgagactccacctcaaaaaaaaaaaaaaaaaaagggccgggcgcggtggcacacgcctgtaatcccagcactttgggaggacgaggcaggtggatcacgaggtcatgaaattgacactatcctggctaacacggtaaaaccccgtctctactaaaaatacaaaaaattagctgggcatggtggcagacacctgtagtcccagctactcgggaggctgaggcaggagaatggcatgaacccaggaggcagagcttgcagtgagccaagactgcgccactgcactccagcctgggcgacagagccagactacgtctcaaaaaaaaaaaatgactatcacctacctacaggaaaagctcaaatgccttagtatgaaaaacaaaaaccttcacaatctaggccgggcgcagtggctcacgcctgtaatcccagcactttgggaggctgaggcaggtgggttacctgaggtcaggagttcaggaccaagctggctaacctggtgaaaccccatctccactaaaaatacaaaaattagctgagcacggtggcgggcgcctgtaataccagctactcaggaggctgaggcaggagaatcacttgaacaggggaggtggaggttgcagtgagctgagatcacgccactgtactccagcctgggcgacaaagcgagactccgtatcaaaaaaaaaatgaataagagaagttggtatcttttctaaagcataaatgtgttctacttagacgtttaaatgactatcacctacctacaggaaaagctcaaatgccttggtatgaaaaacaaaacctttcacaaccttagtacaatctactactctaaagtcatcttggcagggcgtggtggctcacgcctgtaatcccagcactttgggaggccaaggtacgtggatcacctgaggtcaggagtttgagaccagcctggccaacatggggaaacctcctctctaataaaaataaaaaaattagctggacgtggtggcaggcacctgtaatcccagctactcgcgaggctgaagcaggggaatcacttgaacatgggaggtggaggttgcagtgagccaagatcacaccactgcactccagcctgggcaacagagcgagactgtcacaaaaaaaaaaaaaaaaaaaaaagaagtcatctcccaccacctgttccaagcaaccatgtcaccatccttttctgccagtctatctctgtgcactgttcttggcctatgtgcccataccactttctgttaaaccgcaattcatctttcaaattggaagggtcattcatctcagtagagcctttcccagtgtcccaggcagtagtctccccctttaagctgctgcccaatcacaaaagaccatacacatctccagacacaccaaataaaggatgagagaatggaatgaaagggatacaatggctgggtgcagtggctcacgcttgtaatccagcactttgggaggccaaggcgggcggatcacgaggtcaggagactgagaccatcctggctaacacagtgaaaccccgcctctactaaaaatacaaaaaaaattggccgggcatggtggtgggtgcctgtagtcccagctactcgggaggctgaggcaggagaatggcgtgaacctgggaggcggagcttgcagtgagccgagaccacgccactgcaccctggcctgggtgacagagcgagactccgtctcaaaaaagaaagaagaaaggggtacagaagtggatatagcgaatgggaggggaaaagaaagtctatatccattcataaagttcactgctggccaggcacggtggctcacacctgtaatcccagcactttgggaggccaaggcaaacgtatcacctgaggtcaggagttcgagaccagcttgaccaacatggtgaaaccccgtctctggtaaaaatacaaaattagcctggcgtggtggcgcatgcctgtaatcctagatacttgagagactgaggcaggagaatcgcttgaacccaggaggtggaggctgcagtgagtcaagatcccaccattgcactctagtctggtgacatggcaagactccgtctcaagaaaaaaaaaaagttcactgttgacccttagcaacacagcagttccaattccgtaccaaatcaatatcccctttcagaaatactactctgtaaaggtatccagaaatagcaatggcaaagtggtattgacaagaatgtaacctagagaccttgtataccttacctccttcttccttgacttcttcactaggctctcctgaaaaaggctcctttagggtaagatgatcacatctgtcttcttgggtaactggcccaggcctgagtgtcatttttttccctctctttgagccagtagcgtggagttttcctttaccaatgtgtatattaagggggtgaaaagactccaaggaaggtagggtgattccctgagagatggccacatcaacaccttctagaattggtacatttgtgttctgggtgagcattccagagctcagagatgtatcctccataccaagctgatttcctgcatcctgcaaagactgtacttcgaagccagctactctgccatgacttggatcccaggatagtgacaccgaactcaagtccttaacctggtcagattctggtttaacggctgattctaggtctacgttgttttcctcttgattgcctttatgctgtagggactctgtcactgtagttcttctcttcttacagggcaacattttaaaagtcccacttttgttccattctgaaagaataaaaagttcttactgccttcatattaattaaaagtaataacatttactcaattatcttttcatttattcatgttcgatcatgaacacaatacttcacaccaaatgcacaatttccctttaggtggaagttgagagacagtggttaagtgactgagttcaaatctcaactctactgattactactgatggactactgttacctaggccaagtgatttaacctcgcaagtcttcagtaccctcaacagtaaaaaataattgctcttacttcatagaattgttacaattaaagagtaagtgattaataaacactgtgggtttatttttgtgtttttttgtttttgtttttgtttttgagacagagtctcactctgtctcccaggctggagtacagtggcgcaatctcggttcactgcaacctccgcctctcgcgttttacgccattctcctgcctcagcctcctgaatagctgggactacaggcgtgcaccacctacgcctggctaattttttttgtatttttagtagagatggggtttcaccgtgttagccaggatggtctcgaactcctgaccttgagatccacccgcctcggcctcccaaagtgctgggattacaggcgtgagccaccgcgtccagcaaacattgttattattaccatcagggtggtagactagcatgatgctgagagtaaactgtggaatcagactgtctggatgtttcccaagtcaccttctctccagctttatgaccttgtggaagttactcaacctgaatctcagtgtcttcagctataaaatggaatataatagcatctacttcattagatggtaaatgatcaatacatgtttgctattgctgttttcataaacaggtatttccattaatagaaacaaatcaaaagcaaagtgtgattgtttaaaaggttaggctatgttggctgggcacgagatggctcacgtccgtaatcccaacactttgggaggccaaggtgggcagattacctgaggtcaggagttcgagaccagcctgatcaacatggagaaaccctgtctctactaaaaatacaaaattagccgggcgtggtggcacacgcctgtgatcccagctactccagaggctgaggcaggacaatcacttgaacccggagacagaggttgcagtgagccgagatcactccccattgcactccagcctgggcaacaagagcgaaactccatctcaaaaaaaaaaaaaaaggttaggctacattaacaacaaactttgtgtcgaaacaaggaagataagagtcctactatcctctgcgctatgttacttcttggctttttgcttcaattctagttatcacattttaagggcattactgacctaaaccagagggtatcctctatgttcttttagtatctgtttgtaaacctcttttacggtacttatcagttttgtaatggtctctcatctttctctttctcatctccttcctccaaaactatcagcttttcgagaaatgggattatttcaactcatatccctaatatccagcagtatctgggtttttttttttgaaacaaggtcttgctctgtcacccaggctgcactgcagtggcacgaacatagttcgctgcagcctcgacctcctgggctcaagcaatgctcccacctcagcctcccaagtcattgggattacggtcccatccaagccactgcaccagttcagtatttgggtattgtagatactcaatgtatcactgagtattgatactcaatgtgtcactgaatattgtagatactcaatgaatgctccctgaataataaatgaaacagaggttaaacaacttattctgtgcagcatttgggccaaatgttaagcattatataaaaactgatagtggcttggtgcagtggctcacgcctgtaatcccaacactctgggaggccaaggcgggcggataacaaggtcaggagttcgagaccagcctggtcaatatggtgaaacgctgtctctactaaaaaatacaaaaattagccgggcatggtggtgggcacctgtagtcccagcttcttgggaggctgaggcaggagaatcgcttgaacccgggaggtggaggttgcagtgggccaagatcatgccactgcactccaccctgggcaacagagggagactctgtcaaaaaaaaaaaaaaaaaaaaaaaaaaaaggcatcttattacccaggaaaactttactgtcataaatagatccaataatagaataagccgccttgtgttagatcactggcaatgttcaagcgaagcctgaatgtccacttatcagagtactagatgaaagcctgaactagagaactgaaaaataaaagttatttgtaactctaagcgtctaaggttagatttctctttcttcttttctttctttctctctctctctctttctttccagagacaaggtctcgctctgttgcccagaccggagtgcagtggcaagatcctagttcactgcagcctcagactcctgggctccagtgaccctctggcctcggcctcccgagtagctaggactacaaggcacttgccaccaccctcaacgactttttttctttttttttttttgtagagacggggtctcgatttgttacccaggctggtctcaaactcctggcctcaagcgatcctcccgccccagcctcccaaagtgctaggattagaggcgtgagccaccgcgcccgacctacagttagttttaaacctcccttctgtttctccaagacattaggggagattctccatcccctcaatcaactgatgtaattaaaactcagtaactaaagctcaataaaacatgaagatttcgttgattcctgtgagagatggtggtgaccttataagaaatagaatgggagtagccagggcagctcttttatttcacagataattactgagatcaaaaaaaggggaaaaaaagaaaaagaaagaaagaaaaagaaggaaagaaagacagctacttcagctccaggcacctcaaacacagcagtagctcgacagaatccacttttttgggaacccaagtcggaccagcagggtgaatgaatgccaatgtggaggcagccccggcacggccctctcctaggaaaacattttcaaaaggggtcctaaccgcgcttccacctcggtgcccagggctggctccagtccccattcccaactagacactggacttcacgcccttaacttccgccacgcacccagcgcccaccctcagacccgaccttctcaacctggacatcgttcgtccaggtgtcccagctcccacctgcctcttcccaccccaccacacacaaacctgtaccctcaccagccggcctgattccacggaaa

SEQ ID NO: 927 - DNA, 92397 bp, Homo sapiens
ttaatgtgtaaacgagtttaatataataagtaaaatttcatcctttccatctcatttcacctcaactccacaatcatgtcccataatgcattcacaaatcaaatacaaatgattttaggactatccatagtgcagcaagcaagcaggtggcatatcaataagtgatacatattactgagtccacgaaatacttgagaatattctccagctctcacctggagttctgggacagaaagcacagattcctcagaagctgatgacatttcatcttcctcatcttgggtgaggtcatcaaagtcctcttcttcctcttcttctggcccattcttctctcctccagtttctggcccaactggagtccccactgactgaccatcaacactggatgaatcttctggcttccctggggggctactaagcctcacttcaggatccattgaggacaaagcattctttgatgatcctttgttcacatctgtccctgaggttccttcatcagggggctcttgagaagatgaaggggttttagttggctgactcctctcctcttccttctgtaagactgtctgtttcgttacttctccagcactgctcaactcctcgcttggggcaccagtgtccaattccacagcatgttccactttgatgtcatcacaaatatcacgctcaggggatccactgatttcctctctagcttcttcaggttccatcttgacaatttcctctaaatccccaggggtagggttgtttagagactcctggatgccctgagggagcggctccagagcttgcctcccctcctctgttttcacaacggtccagcgacaggcactattctctgacaatccttcttggcactctgcatctgctagtggaggccctgggctatgttccactttcgggaaaacagtagcagagagaggagatagttcctggggctctaatttgggttctaggccctgaaaggcattttccccatcagccacagcacaagcaatgtccacattcacgtgggccttatcttcaggggtggatggtataggaagattcacagaattgccagaaacaattaagggtgagacagaggaggccacaagggactggttcaatggacaggggaaggaagtagggttaaccaagagggtagtgatgggaatagtctggggactctgggccacagccgcattgacaggctggatcatgttacagccaccgccaaggctcacaatcttcacagtggtagcaggaacagtgaagataacagatgcagggtggtggataacaggggcaggtttcatacagggagaggccttgactcctcttctctttgagggtctccgtctcacatatggctttcgaaacttagaaggggcaagggagggcagcattaccttgggcacaggggcagaagagagcaaagtctgggactcagacagagggaagcttgtcctggcctcagggggcacagcaggcagtgctgcaggagactcaaaactctcacctccactgacccccagtggagggacacctggaactgtctgtaaaacagtggctggctgtattgggtgaggaatccggagcaccattttgctcggaggggcttctgaatgagttgatcgggctggtgttttcccagggttgaagctgggctggagagaggggctgggttggataaggaggggcttcaggactgatgaacgcttctgtctccaagccttcctggggaaacgggtggcaactggcttcagtttcaggactacacccttaggcaatagcagtgggtaccgagattcactccccaactccaaattgtctttttctaggcttcgatctgagttgatctcagtggttccagtcatatttcctacctctctagcaccatcagccatgtgccgcagttcttcctggatggatggcagactggcctattggaaacaagaacactctgatccagcatatgtcagaatttgggaaaaagaggcttggcacagtggctcacgcctgtaatcccagcactttgggaggctgaagtgggcagatcacttgaggtcaggagttcaggatgagcctgaccaacacggtgaaaccccgtctctactaaaaatacaaaaattagttgggtgtggtggcatgtgcctgtaatcccagctactcaggaggcggaggcaggagaatcacttgaacctgggaggcagaggttgcgagaagccgagatcgcaccttagcctgggtggacagagcaagactctgtctcaaaaacaaaacaaaacaacaacaaaaaaagaatttgggaaaaacaatagggctttctaggttttagagaccttagacagtctcaaggcatctttccaagaagggtctctctgcatatcaaatctacaaagaccacattctaattatacactttagaaacttctgtgaatttcctttagcaaattattattttacctattattttgaaaatgctgtagaatcacccagagaagggcagaaaagtaagggaagaaaggtgaatcaggaagatttctaaagtcctagttctacaactaaagcattagacgattaaggaagcccttgatattctctcagaactttcagtgaccttctgcctcctacagacttcgaggaagagggctgtacctttaaccagaatgggagccggtgttcttctctctctataggtggcttccactgatgtggctggatctcttcacagcattttcctaggactggcagctgtttggtcttcttataaaacttaacatgaaaaaaatgcgcatgaattacattccttctggaaacactgtcccctgtcaggctggtgaatggggtggtggtggatcaagagaaacacacacacacacacacacacacacacaagaccacatacacaaacatccatgaacgcacatatataaatagcatatgctgaatacttgtacatttcaaattaaactaatctctatttaaatatttcacaattattcaatattttctaactgatgatctccattctggttgccaggaaggggagagtttaggtcacagagagaaaaggaagcagatgctcagagcaatcttatgtaagatttgttcttgatcaacagctgcaaagacaacatcgtaatctataccttggacacatgaaagcttccttttaagcaaatggtggtgtgaaaggcattagaagagaaggggggaaaaaaagagcctgagaaagttcaattttaagagtaaatgaaggttgggcgtggtggttcatgcctataatcccagcactttcggaggtgggcagattacctaaggtcaggagttcaagaccagactggccaacatggcaaaacccctattcctacaaaaatacaaaaattagccaggcatggtggcacgcacctgtaatcccagctactcagcgggctgaggcaggagaattgcttgaacctgggaggtggaggttgaggtgagctgagatcagagacagtgccactgcactccagcctgggtgacacagtgagactccgtctcaaaaaaaaaaaaaaagaataggccaggcgcagtggctcaccttgtaatcccagcactttgggaggttgaggtgggcagatcacgaggtcaggagattgagaccatcctggctaacatggtgaaaccccgtctctactaaaaaatacaaaaaattagccaggcgtggtggctggtgcctgtagtcccagctactcaggaggctcaggcaggagaatggcatgaacctgggaggcggagcttgcagtgagccgagatcacaccactgcactccagcctggatgacacagcaagactccatctcaaaaaaaaaaaaaaaaattgagacaggtctcacttttttgcccaggctggtcttgaactcctgggctcaagtaattctcccaccttggcctcccaaagtgctgggattataggcgtgagccacggccccatttaactcttgaatattcatgtaacacctgtttctcccaacctctgatagcatgtaagatttttcctttggctccaatgttttgaaaattcatgataatatggcttagaatttgtctagtttcatccgtggtgctaaggcacttgataaaccgtattctgctgcagaaaaatctttttccttcacgtttgagttgtgtgtcattttctgtgcacatctttgtactttttgtttgtttctctgcttcttgatctttgagacagagactcctctgtcgcccaggctggagtgcaggggagtgatccacgcttactgaacctctgtctccctagttcaagtgagttttgtgcctcagcctcccgagtggctgggattacaggtgagtggcaccatacctggtcaatttttgtatttttagtagagacggggtttcaccatattgcccaggctggtcttgaactcctggcctcaggtcatctgcctgcctcagcctcccaaagacctgggattacaggcctgagccaccgtgtacggcctcaatttttaaaaatttagaaaaaaattaaaataaaaaatgctactagaatgtgtttcactaaaggaaggaagtaaaacaaaaacacagatgtagaattcaggaaataagaagatccaacacagtaagaggcaaaaagaattcccaggatgatggggaggaaaaagcccaaaacatcagtgcagcaagcccagagagcaacacgcttagagtggaatagtgtcagagggctcaaggagcaattccttcaagatgaaagtgacggaatatctagaaggccagacacgctgaaaggagattaagaaaatttaagtaacctttactgttgacctgggaataattacataataaaatcaagtccagccccatccccctaaaaatgcgattatttactccaagaaaaacaaaatgttcagcaggaaaggcaaggtatcacaataacatagctgtgaagagtatttatacagtccttaaaatcttatagtgtaaaccctgaatacaacctaaccaaaattgtgacataattactagcgaggagattggagagcagaaaatgtgcatgtttgtggtgggagtaagggagtgaggagacaggtaaatcctcagcttccttggcttatggttaatggttaataaataaggcctaaatccaatataccaggaagtagcaattagaggctgagacaggagaatgcctaaggccaaaaattcgagaccagcctgggcaatatagggacactccatttcttaaaaaaaaaaaaaaaaaaaaaaaaaaaaaaaaaaattaataggcaagcatggtggctcatgcatataatccccagctccttgggaggctgaggtgggaggaatgcttgagcccagtagctggagcttacagtgagctatgactgtaccactgtactccagcctgggtagcagagtaagaccctttctcaagaaaaaaacaaaaacaaaacaaaacaaaaggctgggcatagtggctcacgcctgtaatcccaacactttgggaggccaagctgaggcaggcggactgacacatgtcaaaacttcaagaccagtctgggcaacaaagtgacacagcatctccacacaaaataaaataatgagctagccttggtggaacacgcctgtagtccaggatacttggaaggctaaagtggaaggatcacttgaacccaggagtttgaggctacagtgacctatgactgagccaatgcactccaaacaggatgatagagcaagaacccgtctctaaaaacacaacataaatatctaaataaaaaagaagaaaccaggtgcggtggctcatgcctgtaatcccagcaccttgggaggccaaggcgggtggatcacttgaggtcagaggttcaagaccagcctggccaacatggtgaaacctcatctctactgaaaatacaaaaattagccaggtgtggtggtgcatgcctgtaatccaagctacttgggacgctgaggcaggagacaccgaggcaggagaatcgcttgaacctgggaggtaaagactgcagtgagccaagattgcgccactctactcaagcctgagtgacagagcaagagtctgtctaacaacaacaacaacaaaaagcaaataagtggaatactgccagcggaatattgcccaaaaggcaataggggaattaatctagtgtaaagtgggagaaattagctttagataaaagaaggttcctcttttctttgagaataacaagataaaagaatgggtacatattggtgaggtgcccggatggcgcatgcaggaaacactcactttaatgatgttgtcaggagctctgttcatgttgaggttcttgattctcactgtcagttggtgggcagttttgcaggttagaaggtacttgctgattagaggattaggaaactcagttccttcaaaatgcttcagtcctaaagctaacaaactgagaaaggagaataacactaaatctcacttcacagtccttccttctaaagggtctccccagactaacacattttacaatctactctttcatttttttcttgagacaaggtctcacgctgtcacccaggctggagtgcagtggcaccatcgcagctcactgcaacctctacttcctaggctgaagcaattctccagtctcagcctcccaaagtgctgggattacaggcatgagccatggtgtgtggcccaatctaccttttcattttttttcagacagggtcttgctctgttgcccgggttggagagcgggtggcatgattacagcgcactgcagccttgaatgcctgggctcaagcgattcccgtacttcatcctcccaagtatctgtgaccacagacgttcaccaccatgccgggctaatttttttcttccattatttgtagagaccagttctcactatgttgcctgggctaatcttaaactcctggcctcaagcgatcctcctgcctcagcctctcaaagtgctggtattacagttgtaagcccaccatgcctggtcaatctactttttgtaaatctaattcttgtacaagttggtgactactcaacagaaaatttcagatacttagtgagtactgattaagtattatgaataagaataaggccaggcgcaatggctcacgcctgtaatcccagcattttgggatgccgaagcaggcagatcacctgagtcaggagttcgagaccagcctggccaacatggtgaaacctcgtctctactaaaaatacaaaaaatagccaggtgtagtggtaggtgcctgtaatgccagctacttggtcaggagaatcacttgaaaccgggggcgaaggttgcagtgagccgagatcgcaccattgcactccagcctgggtgacaaaagtgaaactctgtttaaaaaaaaaaaatcaaatacttcacaattatgtgggaacataagaaactaggcataaatcattaataaacgtgagatcatgatgagctgtatcatgacgagctgtatactaacaatacaaaggaagttcaaagagaatagaaaggaaggagaataattctaataaaactaatacaaaatgaataggtaccctgtcagacaacttaaaccggcaccaatactaccctctaacaacatatatgatcgtggttacatatacacatatgtgctgataacagtgtggcaatacacacaaagggccataaaaatgttcataatctggtgggtgtggtggctcatgcctgtaatcccagcactttgggaggccaaggtgggaggatgccttgagtccaggagtttgagagatgcctggataacacagagagaccctcatctctacaaaaaaaaaaaaaaaaatttagccatgtatggtggcacacgcctgtggtctcagctgctccgtggaggctgaggtgcaaggatcgcttgatgtcaggagttcaaggctgcagtgagctgtgactgcctgggtgacacagtaagattctgcctctaaataaataaataaataacataaaataaaataaaagcgaacctcctgccttggcctttcaaagtgctgggattacaggtgtgagccaccatgtccggtctaaaatgctttaaaaatgtgtgtgacatctcccaaaaagcagtatttggcactgctagaacaagcacgtcctagagggctctgctcatctatattgcttttccttttgtcttttgtgtccgtgtcttattatacaagtcttacttcccctaaactcctcaaaggaactacatcttctccttgggatgttctgctgttttgatcccccagagtaaacacttacttgtcctcagccttggtgaagacgatcttatcctggggattctttgccttcagggaacacactggaagtaactctggatacatgaaaaccttgcttgtggccagaatccaagccacttgctttggcaaacagggaaattcattcgctataagaaaataaatctcggataaatcaacttctaggacaaaagagggcttcataaaagcctgtgaatgcatttttgcatttaggtaggagctatccttacctaacttgattccctcccatctgcccaccatccccccaaaagtttccagtctttcttaagctaacattatatctaaagggagtcccattcaatggcaataaaagttgactcattctttcttatgtggaacactttattcactaagtaaaacaaacacttaaaaagcacctagtaaaataaggtgctaacaatagcgtatgctcaaaaatgttttacctccttccccccttaaatacttgaaggataagagaccttcaacaatgctttctttcttccagaataagattccaacttctttaatctccctcacaaatctggtattccaaattttacttttatttgattcttacttaagttctcccagattcctcctgaggctgggaacaaaagaaccataaaaggaaggagacaattcagtctcattcatttctctctccctctctcagcctctcactttcaggcacctctgcatttctagagacaaaactactatatccatatttctccttccataagtgttatttttatatccccagaagaaagcaacaggtcaacagatgtgtaagatattattataatttggtgttaaatcaagttttcattaccatttcatatcatttaatatagctgttaaagcagtttgggatccgtgtctatgatataatacacttaaatacaactattttcaacttaacgataagactcagggatttaaaatagaatccaaagacaaacccaaatccagaacaaaccacaactaatttgctaaatcaagaaacaaatcagaagcaaatatttggcttaagtaaatagcaagtattttctaaaaaatactaaactaatgcaaggtagaatctaaacttgcaaatttctttaaaatactgaacatggcaaatgtataatctctaacttatgcctaacttgcaagtcaatatttcattcagaatggagatatcacttatgctgcagtcagtatggtaaataaagttagttgatttttttttttttttttttgagactgagtctcgctctgtcgcccaggctggagtgcaatgatgctatcttggctcactgcaaactctgcctcctgggttcaagcgattctcctgcctcagcctcccgagtagctgggactacaggcgcgtgcccccatgcctggctaatttctgtatttttagtagagacggggtttcactgtgttcgccaggatggtctccatctcctgacattgtgttccccgtgcctcggcctcccaaagtactgggattacaggcgtgagccaccgcgcctggccttagttgatcttaatgaagacagtaaaaagctaaacatgaccaaactttaccacctgactttcatctttaccaggccccagtttatctcgatctgactcctaatacttacccctcatattgctgtagtccaattcttagcactgagcctcagatctctacctcccatattcctatactgtccactgcctccacactttacccaggcccagagattatcatgtaattctagaacttggataatgagtacaaagggaggataaaagagagaaggaagaaattacaaatgtcctgtgtcctccattcctaggcaagtatccttagttatctatgggataagattcccaccacctctcaccgcaagtaaaaacttaaagctgacacatctgtctcctaccagtcttcttgacagttttatgagggctgcagtcaatgctgacatgtgtgctgaagtcttcaatcagctgcatagctcccatcaagttacagggttggaacagggtctgaaacttggggttgtactgatggtgaagggcgatggagctttgagcaaaggttcccagctctttctgggaaaacaggacacaagaaagatttaagacaattccagacaattaataccagtagccttcagaatctaaatgagaagctgaccttcctactacaggataaaaacaggtaaaaatcatcataaagtctttcacaataaactactctgttaagattatgcctgagttcccagatattcagggattgtattcttgttttacttttagacttagtgagaaacactaaggaatatatggtctagctcctgaactagaagtaagattatgaagaatgaggactcattttttttttttttttcgagacggagtttcgctctgtcgcccaggctggagcgtagtggtgcgatcttgactcactgaagtctccacttcctgggctcaagcgattcttctccatctacctcccgagtagctgggattaattacaggcgcccgctaccacgcccggctattttttgtattttaagtagagactggatttcaccatgttggtcaagctgttctcgaactcctgacctcaagtgatccagccacctcagcctaccaaagtgctgagattacaggcacaagtcaccgcacccagccaagaattaggactattacttttattttatttatttatttattttgagactgggtctcactctgctgcccaggcttgagtgcagtggcgcgatctcagctcactgtaaccctcacctcctaggctcaagctatccttccacctctgcctcccaagtagctgagactacaggtacgcaccaccacatctggttaatttttgtattttgtagagacgggctttcggcatgttgccccagctagtctggaactactggggtcatataatctgcctgctttggcttctcaaagtgctgggattacaggcatagccaccgtgcccagtctcaacatctataaaacgaacagtggtaccaaaaacctaagaagttaggttggatctaaagatgaggaggattcaataaaaatatcagaaagacagtattaagaaaattgaatacactccttgtcctttcatgggaatcagtggcttacgttctctcagcaaacacaggaagccttaacagaaagcaggcaaaacaatcaaaaatacccgagagaagaataaatatagattatgatcagtgaataactgagaaataacctgccaagctaatttcatactctagtctttagagttatggatatttggaaacttacaagaaatatcctggtggtagtggcctccggattgaggttggggttgcaggtggcaagaaggtggatttgggtcaagagctgaacgtgctggggatggaaagaaaatgatgaagtgacatgttaccacattgtcatttcaggaatccagagagatcttttttttttttcttcttggagaaaggatctctctctgtcactcaggctgatgtgcagtgatgcaatcatggctccacgccctctcaacttcctgtgctcaagcaatcctcccacctcagcctcctgagtagctgggaccacagatgcatggcaccatgcctggctaatttatttttattttttgcagagacagggtctcactatgttgctcaggttgctctcgaactccctggctcaagcaatcctcccacctcagcctcccaaagtgctgggattacaggtgtgagccaccgtaacccagcccccagagagacaataaccaagatgtttgcaactttatcacatatattttgctttctgaaaggagtatgaaaataacataggatcttggcataaatctctcagacatgttcccttgaacaaaatgacagaaccagaggaagcttaacctcaatccagagggactgaggttagaaaaaggaaaaacaaacctacttctcacagtgaaggttgttaaatttcagaatagattactaaggactctttgaaatctatatttctgaataccattagtgtccttgtgtgctctcttccttgagccataaggcatgaacatgatgacttctcgagctcctaatgatgtgaagatactatggttttaggaggtggtaaggtaactatctctgacttttacaaagctgttaatttctggcctcagagttaggccttggtataatccagtattaacagcagggcgcagtggctcacgcctgtaatcccagcactttaggaggccgaggcgggcggatcacaaggtcaggagttcgagaccagcctggccaatatggtgaaaccctgtctctactaaaaatacaaaaattagctgggtgtggtggtggatgcctgtaatcccagctacttgggaggctgaggcaggagaaatgcttgagcccagaaagcagaggttgaagtgagccgatatcgggccactgcactccaggctgggagacagagccagactctgtctcaaaaaaaaaaatccaatgttaacatgaccaagaaaagtcctacctgctgcatctgctgctggagtctcttcctctgtgctgggtccagaatcagagtctgatgaactttctcactctggggtttaaccttctctacttcctgcagctgtttggctgaagatttcttcatcttcagctgttcaaatagctccttcactgtccgatgttgttcatttaacaggttggccagtggttcctcaaacctattcccaacagggagatgactgaatttgagtgtttccgtaggtccacaacacatccaattcgttccaatgatgagcaaagagcctgaacaattttcattccctactaatcccccatctcactttagccaacagtcaaactctcagccttttacaaatcttttgccaaagtagttagcatgcatcaaatatgatgattctatattacactctatcccattcctctaaaattcctcttctaaataatatacaaataaagaaaaaattaaaatgctaggaacagagaaatatctggataagaaagcagccaaggagctggtgggaactcatcattctcatttcttctctcatttacttgttactcccatcccaggttcagcttgtcccatttccctatccactcaggctgcactgccttgcatttttttttcaaaatttaaatattttttgagacacagtctcgctctgtcgcccaggctggagtgcagtggcacgatctcagctcactgcaacctccgcctccagggttcaagcaattctcctgcctcaccctcccaagtagctgggactataggcacgtgccaccacgcccagctaattttttgtatttttagtagagatgggatttcactgtgttagccaggacggtctccatctcctgacctcatgatccacccatctcggcttcccaaagtgctgggattacaggcgtaagccaccatgcctagccctcaaaattttaattttaagtttcagaatacatgtgcaggacatggaggtttgttacacaggtaaacgtgcaccttggtggtttgctgcacctatcaacccatcaccttggtattaagtgcagctgcattagcagtttatcctgatcctctcccttcccccgctcccccaacaggccccagtgtgtgttgttccccaccctgtgcccatgtgttctcattgttcagctcctacttataagtgagaacatgcagtgttgtttttctgttcttacgttagcttgctgatggcttcacctccatccatgtccctgaaacggacatgatatcatacctttttatggctgtatagtattccctggtgggatactacattttcttatttatctactgctgtaatatcggggattccttgaaatatgataacctgcttgttggccggacgcggtggctcacgcctgtaatcccagcactttgggaggcagaggtgggcggatcacgaggtcaggagatcaagaccatggtgaaaccccgtctctactgaaaatacaaaaaattagctgggcgcagtcgtgggggcctgtagtcccagctactcaggaggctgaggcaggagaatggcgtgaacccagaaggtggagcttgcagtgagccgagatcccgccactgcactccagcctgggcgacagagcaagactctgtctcaaaaaaaaaaaaaaaaaaaaagaaaaaagaaagaaagataacctgcttgttgtagctacataaacagatttttttttcttttgagacggagtctcgctctgacgccaagctggaatgcagtggcatgatctcggctcactgcaacctccgcctcccaggttcaagtgattctcctgcctcagcctcctgagtagctgggactacagacacacgccatcacacccagctaatttttgtatttttagtagagacggggtttcatcatgttggccaggatggtctcgatctcttgacctcatgatccacctgcctcggcctcccaaagtgctggaatcaggcgtaagccaccaggcctggccaacagatcttaccctgactgcatagggtatcagcacatgcttaatcacttagctatcttattctccttttacttcagaactgacatgctgggtttttgaatttttgcttcagccctggaaaaagtctcccaggagggtaggggtgggaagttagggttgggaaccttagaagaggaatttatttatttatttatttatttattgaaatggagtcttgctctgtcgcccaggctggactgcagtggcatgatctcggctcactgcaacctctgtctcctgggttcaagtgattctcctgcctcagcctccagagtagctggtattacaggcacgcatcaccacggccagctaatttttgtatttttttgtagagacagggtttcgccacgttagccaggctagtctcgaaccactgacctaaagtgatccacctgccttggcctcccaaattgctgggattacaggcgtgagccactgcacccagccaggaagaggaatttaaagggctaaaataaaataccttcatggagagcagtagggtaatatttgaaccaaccactcagttctgttcaggtaaactatcattactttagttattttagtatatccttttcctgcttcatgctagaagatttttgacttgttaagaaagcaagccttgccagtcagaatgacaattattaaaaggtcaagaaacagtcgggcgtggtggctcaagccagtaatgccagcaatttgggaggccaaggcaggtggatcactttaggtcagtggttcgagactagcctggctaacatggcgaaaccctgtctctatgaaaaaatacgaaaattagctggccgtggtgatgcgtgcctgtaatcccagctacttgggaggctgaggcaggagaatcacttgaacccgggaggcagaggttgcagtgagccgagatcgcgccactgcactccagcctgggcgatagagcaagactccatttcaaaaaaataaaataaaataaataaataaataaaataaattcctcttctaaggttcctaaccctaacttcccacccctaccctcctgagagactgtttccagggctgaagcaaaaactgaaaaacccagcatgacagttctgaagtaaaaggagaaaaagatacttaagtgattaagcacgtgctgataccctatgcaatcaggataagacctgctgatgtagttacaacaagcaggttatcatatttcaagtaatctccaatattacagcaatagataaataagtgttttcaatagttaatttttaaaagttatcatttatctattggggataaaaatcattctttcttttatagtatttactgtgggtttgggcagcacagggtaaaaacctaaagcctgtgggactgtcttatgcaatcttctgagaactgaaaacctgatcacctgcactactaccactgaaggaacagaagaccagaagcataaaaaagtaggtaatgaaaacatagcctgcacgtagttgtattttttattattattattattattactattatttttttttgagatggagtttcgttcctattgcccaggctggagtgcaatggagtggtctcggctcactgcaacctctgcctcccaggttcaagcaattctccttcctcagcctcccaagtagcggggattacaggcacctgccaacacgtccgactaattttttttgcatttttagtagagacaaggtttcgccatgttggccaagctggtctcgaactcctgacctcaggtgatatgcctgcttcggcatcccaaagtgctgggattacaggtgccagccaccacgcctgatctataattattattattattattattattattttttgagatggagtctttttctctctctcaggatggagtgcagtggcatgatcttggctcattgcaacttctgcgtcctgggttcaagcgattctcctgcctcagcctcctgagtagctgggattacaggcgagtgctaccatgcctggctaatttttttatttttagtagagacggggtttcaccatgttggtcaggctggtctcaaactcctgaccttgtgatccgcctgccttggcctcccaaaatgctgggattactggcgtgagccaccgcacccggcctattattattttttgagagacagtttcactctgttgcccaggctggagtacagtggcacaatctcagctcagtgcaacctccgcctccagggttcaagtgtttctcctgcctcagcctcccaagtagctgggattacaggcgtgtgccaccacacccagctaatttttgtatttttagtagagatggggtttcaccatgttgaccaggctggtctgaactcctgacctaaagtgatctgcctgccttagcctcccaaagtgctgagattacaggtgtgagtcaccacacgtggccttgcacctagttttaataagtattacttggataactgacaagggaagcacagataactcactttcccagggtttttgttttgttcttttttttcctctctcttctttattgtgttttaagaagtttttactatctatggacttacagaatccaggatgctttatttagtcaaagattataacaggtttgcatttgcaactgaaagagaagcagcagctgcccaagtacagtcatgtgccacataatgtttcagtcaataatgaaccacatattcagagatggctccataagattactgtaccttttctatgtttacatacatatgtacttaccattgtgttacaactgcctacaatattcagcagaataacatgctatacaggtttgtggcctgggagcaatatgttataccgtatagcctaggtatgcagtaggctaaaccatctaggtttatccaagtgctttctacacaatgatgaaatcgtttaatgataacatttcacagaatgtatcaccatgagatgatatatgactgtattctactgaataccagaaggtaactgaattctaacaagagttttaaattatttctatactttacaaattttatttattttattttattttatttttttgagacagagtctctctctgtcaagcaggctgtcatctcagctcactgcaacctccgctttccgggttcaagtgagtatcctgcctcagcctcctgagtagctgggattacacacacccgccaccatgcctggctaatttttgtatttttagtagagatggggtttcaccatgttggccaggctggtctcgactcctaacctgaggtgatccccctgcctccgcctcccaaagtgcagggattacaggcatgagccactgcgcccagcctacacttcccaaattttaagaagttacaaagagtcaatcagcagaaccaaaacacgtttatagatcaaatcccattatatgttcccaggatgaatggttccattctgctataacagaattttgttgtatgagctgtaacttaaaataatgggtcaaatactgacttagcaatcttgaggtttttgatgtagttgtattgtgatatttgttgtaatggagaattactggtatttctagtttttagacattggttggcatatcttatcttttttcactaaattgaaaaatctctaaaggtctagctttcagatggatcccaagctctctgcttagtaatgctgttaggttcaaacccaggacgaattacagggactattctctttgctttgttccacttatggcacaaactgcatcctgacatctagccatccatctaatgactacatgctgctactcgcaatggataacaatacaataaagtgcagatgcaaatccaccacaaaatgaggaaaaaattaaagcctctactttctggatgctgtaacacaagtgccaactttaggcaaaaaggtcagcacgtatgtttcagactccttactgcaggtgcttcagggtttgctccactaatgcctaggtgactaacaaattttcagtcacatttagcagatattaatggcacataaaaagaacaaaagggacagacaggatattacaatatggggtagtttgtgtggctggccacattgagtcctacatacctctccagcaccactcacccggagaagtggatatggatgccagctactgttttttctcccttcccaaacggatatagcttggcctacagctgcactgccccataacaaggagacttcacttgacacctaactcctgacagggctctgcatccttacatcagtaacagaagctggtttgggatgaaaaattatcaattgcaacttctgaaaaccttttcagaaataaacttttcctctattccaaatctcaaggtcttcaactagcctaccgtagagcttgaggggtgttaaagttaggacgaggctcagctacacactcctcctcttctgggccatcatcttccatgttggagaatcccatctcatcttggaactgtgggcaaaggaaagggagggttttcctggggaatgggcctctgaatgttgctccagtattgggaaggaagagtgaaaactatagattacaagactataataatgctggcacccagaaagagccaatgtcagaactttctcacttcaggattcccacaaacccacacttgggatggctattatgccaagaaagaagtcattcaaccagtcaacttgtaacagtaaggacagagcgtggataactcaaaattatcaatctctctctcctttttttttttttttttttttttttttttttttttttgagacagagtcttgcagtcttgctctattgcccaggctggagtgcagtggcacaatctgggcttactgcaacctccgcctcccaggttcaagcaattttcctgcctcagcctctgcagtaaccgtgactacaggtgcccgccaccatgcctaatttttgtatttttaatagagacagggtttcatcatgttggccaggctggtctcaaactcctgacctcagatgatccacctgccgtggcctcccaaagtgctgggattacaagcgtgagccactgcacccagcctcaaaatgatcaatctcttaaaatgaaaaatcttttgaaacaaatttatgaaaaaggtaattatttgtacacaaagtagtttaaaactagttgacaatctttaaggacacaccaaatgacagtaggggaagtcatcaaaagttttccaggggccaggcatgctggctcacacctataattccagcactgggaggcccaaggcaggaaaattgcttgagcccagaagttccagaacaacctgagcaatgtggtaagaccctgtctctacaaataaaataattagctgggtgtgttggtatgtcccagctactcaggaggcttagacgaaggactgcttgagcctagaaggtcaaggctgctgtgagctgtaatttcaccactgcactctggcttgggtgatggagcaagaaccccctcaaacaaaaagaagtttcaaggaaaatgttaataagaacaacatacatgtatataatcaagagtctagtagttagcaaaattcccttgtcattatattctttcccaggtagactaaaaggagaattggttcagtcagaccccctctcctagagggagcatcacagagaccaaatgacacatcttgctggagaactgacttaaaatcccgtgttctcactcgaggatcattactcacagtttcaaacagctcttccatcagctcatttacttccttttctgcaagaaagccagacagtatattgttggtataaattagattttacaataaggaggaattccatgaagacaatgtataatgttttcaacaaggcatgacaaattcttcatatctatccttctttttttgagatgggtctcactatgtcactcaggctggagcgcagtggcacgatctcagctcactgcaacctccgcatcccctccctggtccaatcgctcctcccacctcagctccccaagtagctgggaccacagacgcatgccaccatgcctggctaatttttgtatattttgtagagatgagggttcaccaggctggtctcgaactcctgagctcaagtgatcagcccaactcggcctcccaaaatggtgggattacaggtgtgagccaccatgactggctatccttcattcatttattcaaaaacatttattgaggccgggagcggtggctcatgcctgtaatctcagcactttgggaggccaagacagatggatcacaaagtcaggagattgagaccatcctagctaacatggtgaaaccccgtctctattaaaaatataaaaaattagccagccgtggtggtgggcgcctgtagtcccagctactcgggaggctgaggcaggagaatggcgtgaacccgggaggcagggcttgcagtgagccaagactgcgccactgcactccagcctgggcaacagagcgagactctgtctcaaaaaacaacaacaacaacaacaacaacaaaacacatttattgagcactatgcttcaatccatgttttagatgcttgggatatatgagagaatgaaagagagatagagagagagagttctattctcatgaagcttaaattctaaaaggaagaagacaggagaaaatgtgagctagatgattttataattagatgacctatccaaatccacacagtactgaatggaatcaagagatgagtctcctagcctgggcaaaatgttgaaaccatatctctacaaaaaaatttagctgggcttggtgacgcacacctgcagtcccagctactcaagaggctgaggtgagagaaatctcttgagtccaggaggcagaggctgcagtgtgccaagatcatgccactgcattccagcctgggcgacagagcaagatattgtcttaaaaaaaaaagagagagagaaagacaagtttccagcagggtttcacaggacgctgtctttggatctgaactattcaagaactccatcggtgacttagaagacccagagaacatacctaacacatctgtagatgatgtaaagctgaaagggactgccaatccaacagacggaaaattcaaaattatattttctcaaatcaactggatgcaacatatacggataaatttaaagttctatgtttaagaatttttttttttaatagaggcagcatgttgctatgttgcccaggctggtctcaaactcctgggctccagcgatcctcccaccttggcctccctaagtgttgggattacaggtgtgagccacggtgcccagtcctacagttaagagttttttcgtttttttttttgagacggagtcttgctctgtcgcccaggctggagtgcagtggcgcgatctcagctcactgcaagctccatctcccaggttcacgccattctcctgcctcagcctcctgagtagctgggactacaggcgcctgccaccgtgcctggctaattttttgtattttttagtagagacggggtttcaccatggtctcgatctcctgacctcgtgatccacccgcctcagcctcccaaaatgctgggattacaggcgtgagctaccgcgcccagcaagagttttaaagatcagtttattaactgcatgaaaaggtgacgtggcttaaaaataatgtgaacaagacctgaaagttttggttgttacaagaatctgaggaaaaaaaaaagttttggttgatatcaagttcaataagacacagttgctccaaaacggggctcataaccaacaaggcaaacatatcactgaactagagcagagtctaacactatgtctggaggactgtgaacaattctataaaggcccttcttaagaggacattaaaaaaattaagatccaggccacgggcagtggcttacgcctgtaattccagcactttaggaggccgaggcaggcagatcatctgcggtcaggagttcgagaccagtctgaccaacatggtgaaaccccgtctctactaaaaatacaaaaattagccaggcatggtggcatgcacctggaatcccagctactcgggaggctgaagcaggagaatcacttgaacccaggaggtggaggttgcactgagccaatacagcaccaatgcactccagcctgggcaacagggcgaggactccatctcaaaaataaataaataaataaattagccagtcatggtagcacatgcctgtaatcccagctacttgggaggctgaggcacaagaatctcttaaacccgggaggcagaggctacgctgaccagagatagtaccactgcactccagcctgagagacagagtgagactctgtctcaaacacaaaacaaaaacaaaaacaaaatcatttaagtaatttaattattttttattttatttttttgagactgagtctcactctgttgcccaggctggagcgcggtggcgcggtctcagctcactgcaacctccaccttccggcttcaagcaattctcatgcctcagcctcataagtagctgggactacaggcatgcgccaccacgcctggctaattttttgtagttttagtagcgacggtgtttcaccatgttgcccaggctggtcttgaactcctgacctcaagtgatctgcctgcctcagtatcccaaagtgctgggattacaggtgtgcgccaccatgcccagccaacaaaaaaaattaaaatccaaatgttactgaggatgtagagcaaccagaactctgataagaatgtaaaatggaaagccactttggaaaatggtctggcaatttcttataaaactaaacataccctgtgacccagtgatttgtctcctatacagctgacccaagataaatgaaatacggcttttctaactcataggtgggaacaaatgaaagagagagagaaatgaagcatttccacaaagacttgcacaaaaaagttcagcgcagctttattcgttacccaaaattaaaaatagcccaggtgatcaacacaaaaatagataatctgtagtatatatacacaacgaaattctactcaacaatataagggaacaaactaacgacccatgcaacacaaatgaatctcaaaaatattatgctgagtgaaagaagccttacacacaaagcacatcctatatgattccatttatgtgaggttctaaaactggcaaacataacctgtgattaagaaaaaaaaagccgggcgcagtggctcacgcctgtaatcccagcactttgggagtccagggcaggtggatcacaaggtcaggagatcgagatcgccctggctaacacggtgaaaccccgtctctactaaaaatacaaaaaattagccgggcatggtagcaggcacctgtagtcccagctactcgggagtctgaggcaggagaatggcgtgaacctggtaggcggagcttgcagtgagccgcaccactgcactccagcctgggtgacagagcgagactccgtctcggaaaaaaaaaaaaaaaaaaatcagaacagtggttgcctctgaagggatggtgtggggattgacttggaaggggcatgaggaaacttcctggggtgaggattctatatcctgacagggatttgtgtcacataggtacacacatgtcaaaattcattaaatggtacacttgagatgtgtgtgatacactgtgtgtaaaattacctataaaaagaaatcataaacaaatatggagctctagttcattatatgcgtgctgaagtggttaaaagtgaagtataggctcatgcctgtaaacccaccactttgggaggcagaggtgggaggatcacgaggtcaggaattcgagaccagcctggccaagatggtgaaaccccgtctctactaaaaatacaaaaaaaaagtgacatatagccaggtgccattgtgcacacttgtaatctcagctggtcaggaggctgaggtgggaagatcgcttgaccgcaagagttcaagaccaacccatgcaacatagaccttgtctgaatttaaaaaaaaaaagaaaaaaaagtgaagtataatttactctgaaatgcatttgaaaactaagatgcatccacagacggacagggagatggacagctgcatgataaggcaaataaagtcatccctcagtatctgtggaggttggttccaggagccaatctcctggaaccatttcgtatccatggataccaaaatctgaggatgctcaagtcccttatataaaaatgatgtagtatttgcatataatctacacacatcctcctgtataccttatctctagattacttatcacctaatacaatgtaaatgcttgttataccttattattttttatttatttatttgagacaagctctcactctgtcacccaggctggagtgcagtggtagtggtatgatcacagctcactgcaaccttgaacttctgggctcaagggatcctcctgactctgtctccagagtagctgggactacaagcacacaccaatgcacccagataattttttttttttgagacagcgtctcactctgttgccctggctagagtgcagtggcgcgatctcggctcactgcagcctccgcctcccaggttcaagcgattctcctgcctcagcctccttagtagctgggactacaggcgtgagccaccacacccggctaatttttgtatttatagtagagatggggtttcaccatattggccaggctggtctcgaactcctgacctcgtgatctgcccaccctggcctcccaaagtgctgggattacaggcgtgagccaccatgcccggctgcacccagataattttaaagttttttgtagagatggaatctcagtatgtcgcccagccgatctcaaactcctgtgctcaagcgatcctcctgcctcagcctcccaaagtgctgggattacagatgttagccactacgcccagttagtattattttttgctgttgcatttttttttctcagaatattttcaaggttggttgaatctgcagctgtgaaacccgcacatatgaaaggcgcacagtttatattaacactactgaaagtttggccgggcacagtggctcacgcctgtaatcccagcactttgggaggccgaggtgggcggatcacaaggtcaggagatcgagaccatcctggccaacatggtgaaaccctgtctctactaaaaatacaaaaattagctgggcatggtggcgcgtgactataatcccagctactcgggaggctgaggcaggagattcacttgaaccagggagtcggaggttgcagtgagctgagatggcgccacggcactccagcctggagacagagcgagactccttctcaaaaaaaaaccaacaaactatagaaagtaggtggtgaggctgggcgcagtggctcgcgcttgtaatcccagcactttgggaggctgaggcgggcagatcacctgaggtcaggagttcgagatgagcctggccaacatggtgaaacctcttctctactaaaaatacaaaaagtagccgggcatggtggcaggcgcctgtaatcccagctactcaggaggctgaggcaggagaaccgcttgaacctgggaggcggaggctgcagtgagccgagatcacaccattgcactctagcctggggaacaagagtgagacttcgtctcaaaaaaaagtaggtggtgagtatatgaatgttagctgtataatttttcaatttttctatatatatttttaaatttcataataagatgtaacaggggaaaagtttaaagaaaataaatgctagaatccagagaagagtaatgtgcatggtgagaggtctggacaccaaggctttggagaagaagaaacctggcagaagaaacttgaaactttcctatgttttgcatagggaaaaaaaaaaaaaaacttaagaaacatcttttaatatgtacacttgggaataaattgcttttttttttcttaacaacaaaagacaaataggaggccgggcacagtgcggctcatgactgtaatcccaacactttgggaagccgaggcaggtggatcacctgaggtcaagagttcaagaccagcctggccaacctggtgaaaccccgtctctactaaaaatacaaaaattagctgggcgtggtggcgggcacctgtaatcccagctattctggaggctgaggcaggagaatcgcttgaacccaggaggcagagtttgcagtgagctgagattgcaccattgcactccagcctgggcgacaacagcgaaactccatctcaaaaataacataacataacataacataacataacataacataacataacataacatcacataacataacataacataaagacaaataggaggaatataaaaggattgatcttcctgctttgcattcaaatttgggttcaataaggaaagtatctgaatttgcattcagatttgggttcaataaggaaagtattaattgaggaggtgttcaagtttacaatacactatctgcagaattgttgagctccctgtcactgaaggtatacaaacaggactaaaaaggccacctcagaggaggtgtaaacaaattctcaagcgggcaaaaaacatgtgaccacatggagcttttcaaactctgtgattctatgctttttaatttttttattttagttatccatataaggataagtccttttaaagagattataatcaaatatgacaatgagacacaagaggacaagaggcagaaaaaaaaattaaaaattctactccagctttcactatcattacagaactgtatgactagaaagactgcccttcatttacccatctctattcgactggcaaatattgccaccagctttacagcaataaacaaaacaaagctcttgagaagttcacagtctaggggagaagacagatattaaataagcaattatgaggtgatcagtatataaaaggacaaaaagagtggtacgggaatgcaaagcaagaagatcaatcctaacgaaggaggatctccctgagaaattatacgtaaactgaagaaagtaacaatcaaaaagggaaggcaaatatattccaggatgatagctgaacttaagatctgcttttgtgctttaagcagatgtttctttacttgtttctttactgttgaccattctgtccttcttgaaagactctttttttgaaacagggtcttgctctgacccaggctggagtacagtgttgggatctctgctcgctacagcctccacctcctgggctcaagtgatcctcccacctcagcttcccaagtagctgggactacgggcatgcaccacgacaactaattttcattttatttttaaaatgtttttgtagagacaatgtctcactatcttgcccaggctggtcttgaactcctgggctcatgcgatccttctgcctctgcctcagcctcccaagtgccgggattatagccatgagccactgtgccccagccaaaagactcttcctttggtttctacgacactagattttctaggtttttcttgtaccttcctagattctcctttcagttttctcaaagcctaaatcctcaaaccttttcattctacattttctctaattcctggtgctttcctttcaatgcttccactatccctgtcatagtatatcaaaataaatgaaagatcttcacaaaggaaatggtattctaatcttaaaagcaaggtgaaaggcacaataaagcaataaaataaaatgtaagttctaaaggattgtatttacataattctctttacacaaagaactgcattaattaggtatatcttggatgtttataaagctctctgcataacctggtcaagagccagcatcttaccttctccatgtcgtgtatattattccagtacagggtcatgcatacatgcaataaaaatcaatggcttatgaaatatattttttatttttctttctccccataggtagaatttcttcaggatgaaatgtatgttttctatgcttgacacactagccaatgatataatttttttttgagtcaggatctccctctgccaccaaggctggagtgcagtggcactatcatagtttgctgaatccttgacctcctgggctgaagcaatcctcctgcctcagcctcctgagtagctaggactacaggtacgtgccaatacattaggctaatttcttaaatttttagtacagacaaagtttctctatgttgcctatgccggtctcgaactcctaagctcaagcaatcttcctgccccagcctcccaaagtgctgggattacaggtgtaagccaccactcctagctcaatgatataattttttatagaaataactcaagctaagttatcataattgttttccatacctccagtcttgttcactttacctaacaaattaatacattaaactggtattaaatcaaagtgatctttctaaaatccaaatcagttcctactgatttactgcttaaacctcttttttttttcaggcggagccttgctctgtcgcccaggctggagtgcattggcgtgatctcggctcactgcaacctctcccgcctgagttcaagcaatttttctgcctcagcctccggagtagctgggattacaggtgcctactaccacgcctggctaatttttgtatttttagtagagacagggtttcgccatgttggccaggctggtcttgaactcctaacctcaggtgatctgcctgcctccacctcccaaagtgctgggattacaggcgtgagccaccatgcccgcccttaaacctcattttgagagcttaaaaatcctccatgatgtaaacactacctaatcttatctaccacttctctgtcttttcactcatacaccaccaccaaagtacttagtattttccaaacatacttttttgatgttttacaattctgtggtttgcagatgctcttctatttgcaatattcctctctgtccctattcaccaaatttcttattcctccttcaaaactaagataaaaagccatttcattctgcaaattctttcctaagttctcctatcctagtccatatcatacactaggagatgacactctcttttaggtcattattataccttatgtaaaacctgttacagcatttatcactttgtattgtaactttttctgtttctatcaccctactaggctgaactcctacagcacagatgccatgtcttattcatcttgcacaatccctgccaaacagtaaggactgaatacacgactgtgggatatacaaatgaataactgatgggctttctgaatatgtacctaaatttaaagaatcagatcaataaatgggtaaaggaaacctaaatgtcttaacatggatgagctgcaaacttcacccctaaaaatctacaaagtaaacaaagacagctgcaaagcagtcaagagcaggacttagaataaacacagactcactggtgattctcactgcccggtcagtccggaaatcctctgtgtctggttcatcgaggtcttccaggaaattatattctggatcatcatcatcatctgcttcatctaggaaaaaaaagtgtttcagatgctcattaactctgttctcaaacttctaagaatctgttccaataaagcacatttattctttatttttttgagacagggtctcactctgtcgcccaggctggagtgcagtggtacagcctcagctcactgcaacctccacctcccgggctcaagtgatcctcccaccttagcctcctgagtagctgggaccacaggcatacgccaccacacccagctaattttgtgtagtatattccatgaaaataatactttctgtaaaagctacttgtacagtgaagctgacagtgaaaaaaggagtggcccaaattcccaacaattagagaatgactatataattataatttcttagtataaaatagtacaggttgagcattccaaatccaaaactccaaaatctgaaactctgtgagtgcaaacatgactctcaaagggaatagccattggagcatttcagatttcaaattttctttttccttttttttgagacagggtctcactctgtcacccaggctgaagtgcagtggcacgatcatggctcactgcagccttgactgcccaggatcaggcgattgtcacacctcagcctcccaagtagctgggattaggcacatgccaccatgcccaactaatttttgtatttttagtagagacagggttttggtatgttgcccagactggtcttgaactcctgggctcaagcgatctgaatgcctcggcctcccaaagtgctgagattacagtgtgagccattgcaccctgcccagatttcaaattttcaaatttagtatgcttatctgttaagtataataatacatatattctaatatctgaaaaaatctgaaatccaaaatacttccggtcctgagcattttggatgaaggggatactcaacacgtacacatataaaatgtgaatatgtaaccattctataaaagttcaatacatgtatgacaaaagtacaatatatacataataatcataagcatgaaaaattatatccttacaataagaatcataaataactaaaaatatacaaaaataataaacatttgttaggttagaataatagaaatatggatgttcttctcccttttaattttcttttttcttttttttttttgacatggagtctcactttgtcacccaggttggagtgcagtggcatgatcttggctcactgcaaactctgcctcccagcttcaagcaattctcctgcctcagcctaccaagtaactgagattacagatgcccaccaccacgcccggctaatttttctatttttagtagagacaaggtttcaccatgttggccaagctggtctcgaactcctgacctcaggtgatccgcctgcattggcctccgaaagtgctaggattacaggagtgaaccacagggcccagcctaattttctttaatgttaatgctaaactgtcttttcaattactaagtaaaaattatgaaggagtcattaaattatggaattattatatattaaggtaatatttttctccagataattttagatcagtgttgtctaacagaactttctgtgatgatggaaatgatctatacatgtattgtattgtatcatacagtagccattagccacatgtgacttgagaaatgcagctagtgtgactgaggaactgatttaaaaaaaaaaagaccaaaaagagaatacctaaatttcttactatcatgtatccattaaatagaagaggtgatctctatgtattataatggaaaaatatatgttatactgctaagtgaaagaagcaagttgcagatgaagaccaatatgtatagtatgattctttttgtggaaaaaaattcttgtttgagataaatacatgcttgactgaacacccacagagtatctagaaagaaacacataaaactattaacaaagatttctctgtgtaccctcccacaatattttttttttctttctttttttaaggtggagtctcgctctgtcgcccaggctggagtgcagtggctcgatctcagctcactgcaacctccacctgctgggttcaagcgattctcctgcctcagcatcccgagtagctgggactacagatgtgcaccaccatgcccagctaatttttatatttttagtagagacggcgtttcaccatgttggtcaggctggtctcaaactcctgacctcaggtgatccacctgcctcggcccctaaaaagtgctgggattacaggcgtgagccacagagtctggcgcctcttccataatgttttaacttttcataataaatgagcatcttttttttttttcgagagggagtttcgctcttgttgcccagactggataccgtgcctggccataaataaacatcttttgttataaacagacatatacagcctggggccaagcatggtggctcacgcctgtaatcccagaactttgggaggccgaggtgggaagatcacttgaggtcaggggttcgagaccagcctggccaacatggtgagaccccccccctcccgtctctaccaaaaatacaaaaattagccaagagtaatggtgcgtgcctgtaattccagctacttgggaggctgaggcaggagaatcacttgaacccaggagacagaggttgcagtgagctgggatcatgccactgcactccagcctgggcgagagtgagactccatctaacaagaaaaaaaaaaaaaaacacatatatatatcctgggcaacacagtgggaaccaatctctacaaatgactttttaaaaattagccaagtgtcgtggtgtgtgcctatagtcccagctactcagaaggctgagctggaaggactgcttgagcccaggagtttgaggctgcagtgagtcatgatcacgccactgcactccagcgagggtgacagagtgagaccctgtctcaaaaacaaatatatattttttatataaatataaatatatataaatatatatatacttatacagacacacatttaaaattcacaatcactgaaaaatctgtgctgattaaaccctaatctaacttgataattctttactcaacatttatactcagcttataatatattaatttgcattctttacacataactaattatcaaatctttttcatctatttgtgggtttaacttatcagtacagattctttatttctttaggaatagaatactgtcttcataattcataatctctatagtactttctatataagtctcttcacagcaagttctttttttttttttttttttgagatggagtctcactctgtcgcccaggctggagcacagaggggcgatctcggctcgctgcaagctctgcctcccgggttcacgccattctcctgcctcagcctcccaagtagctgggactacaggcacccgccaccacgtcaggctaattttttttttttttttttttttttagtagagacggggtttcactgtgttagccaggatggtctcgatctcccgacctcatgatctgcctgcctcagcctcccaaagcgcagggattagaagtgtgagagacactgcgcctgatcaaaaagttcttaacaaacattgctgaataacgaaagttctggaagagcccataataatgagtagtgtgcacaggtttggactccatctgtttggatgcaagaactgcaatagatagttctgcccacaccacacaaatgggtcagcgaatattattctcagagcactcatttaacaaagatgctgaaaaatcatttagggggattcttctgagttctgcttagcttttagtaccctgattgtggaatatgtcctctgagcttaatcacttttttgacttattaacaatgtcagtatttacccagctgatatacccctcctgtattgtcttttaactcaactggtagatctggaggccacacccatcctaatcattggctttgtgtgctcttttaaaaatctgtccgaataggcacatacaaaaatactgaagttgctgggcgtggtggctcacgcctgtaatcccagcactttaggaggccaaggcgggcggatcacctgaggttaggagttcaagaccagcctgaccaatatggtgaaaccccgtctctactaaaaatacaaaattagctgggtatggtggcatgtgcctgtaatcctagctactagggaggtggaggcagaagaagtgcttgaacctgagaggtggaggtggcagtgagccaagatcacaccattgtactccagcctgggtgacaagagtgagaccctgtctcaaaacaaaacaaaacaaactgaagttttattttaagaaaagaggattttcaccctccccctaaccattagtccaattccccaatcaacctttatcatgcactcttacctttcccagaccagtagtttccaatcctttagatatatcagaattagatccctagaccatactcattagattctgattcagtaggtaaggggtgaagccctgaaatctgtatctttaataaacatcaccctacatatccatacactcttcaattctgattcaagttctcggaaccaaattatgagaaacaaaatcctgaaagtcagttctgcctggcctttccttcccaatagctaccatcttaggcctttgaaccaaagtgatgaaaatgagcaccaaagctgctgctaccaataacgctaggagaacctgactttcttactgtaattattttgtattagcctgtgccaaagataaaaagcacagcttattatgaaggctaggagcagtggctcatgcctgtagtcccagaactttgggaggccgaggagggcggatcacctgaggttggaagttcgagaccagcgtgaccaacatggagaaaccccatctctactaaaaatacaaaattagccaggcgtggtggcacatgcctgtaatccagttacttgggaggctgaggcaggaaaatcgcttgaacctgggaggcagaggttgcggtgagctgagatcgtgccattgcactccagcctgggcaacaagagcaaaactccatctcaaaaacaaaacaaaacaaaacaaaacaaaaaacacagctcattatgaaaagtcatatacttttaaaaaatggtttaggccgggcgtggtggctcacacctgtaatcccagcactttgggaggccaaggtgggtggaccacttgagatcaggagtttaagaacagcctgaccaacatggtgaaaccctgactctactaaaaatacaaaattagccaggcatggtggcacatgcctgtaaacccagctacttgggaggctgagacaggagaatcgcttgaacctgagaggcggaggttgcggtgagccgagatcgcgccactgcactccagcctgggggacaagagtgaaactctctcaaaaaaaaatggtttaggccaggtgcggtggctcaagcctgtaatcccagcactttgggaggctgaggcgagtggaacagaaggtcaggagttcgagacaagcctggccaatatggtgaaaccccatctctactaaaaacacaaaaattagctgggcatggtagcgcgtacctgtagtcccagctactctggaggctgaggcagaagagtcgcttgaacccgggtggaggttgcagtgagcagggattgtgccactgcactctagcttgggcaacagagccagactctgtctcagaaaaaaaaaaaaaaaaaaaaaggtttaacttaccgtgaaacctgtctgattgagacatgttcctagaatattaaactgggttctactcctaggagtataacaaattgattctgtaactttgagcaagacaatgaatttctctgagatttcactgcctacaaagtggttagaactatctgtccttgggcaacccactcgggtcccctaccacgttgtggaaactttgttctttaactcttcacaataaatcttgctgctgctcaaaaaaaaaaaaaaaaaaaaaaagaactctctgtcctgtctattcctttttgtggagatttctgaacctggtagaaacaggaagtgtcaataaactttaaaagatatgtatctcccaaaaatcatataaaaatttcatgtatttggatatgtacatttttttctgggggaaggctgcatagttttcatcagattgtcaaaggggtgagtaatggaaaactcagaagcttagactcctatcagaatgactaatgggataatatatcagttgctaattatgaaggaactgattctatactttgcatgttaatgactcagcttcaaactccatctttttctccttacacaatttttttcattttgtggcttgttagcccctctactacagagggtgggtaaaaaaaagaaatatgataagatttaaaacaatttgcttcttgttattttctctctcttttttaaaattttattttattttaaaaatagaaatgccaggtgcggtggctcatgcctgtaatcccagcattttgggaggccaaggagggtggatcacctgaggtcaggagtttgagaccagtctgaccaatatggtgaaaccctgtctctactaaaaatacaaagattagccaggcaaggtggcaggcgcatgtaatcccaactactggggaggctgagacaggagaatcgcttgaacccagtaggcagaggttgcagtgagccgagatcacaccactgcactccagtctgggcgacagagcgagactctgtcgaagaaaaaaaaaatagaaatgaggtctcactgtgtttcccaggctggtcttgacttcctggcctcaagcaatcctcatgccttggcttcccatagtactgggattacaggcatgagccaccacgcctggactatcttttctaaatgtttgagaaaagtcttaaatttaaatttaggactaaaatttaattatttttatccccacattaatgtggaaaactaaaaagtaactacacattgaaaactctcacagatgcataccaaagtattatcagtagtccctctggggaaccaaacttgaaccttggtgtcaaaggctttggaaatgactggtaggaaaatgaagtgccaataaataaactctaagagatacataaaccccaaaaaaatcatatgaaaaatttcatgtatgtagatatgtacattttccttggggggggggaaggctttaattgttttatttctgtaatatttgatttctttataccaagcatatattactcttacagttttacagtgaaaaaagagaaaactctggaaagaatatatcctacagaatccagcatatagagtatatcatgtcacttctactcagatgccttctctcttccctgtcactgttttcaaaaatctttccaaggtccatttcaattaccagctctttcatgtagctgtctctgatcatcctaaacaaaagttaccctgtcctcttctaaaatcttacaacagcatttatgccactttgatggcatatctgagtttattcaacaacttcattcatttacaatatactggctgagcgcgatggctcactcctgtaatctcagcactttggaaagcagaggcaggaggatcgcttgagcgcaggagttcgagaccagcctgggcaacatggcaaaaccccaactctacaaaaaatacaaaaattggccgggcatgatggcacaaacctgtattcccagctatttagaaggctgaggtgggagaattgcttgcgccaaggaggtcaaggctgcagtgagctaagatctcaccactgcactccagcctgggtgacagagtgagaccctgtctcacacacacacaaaaaagtacaatgtattgtgaacctaacaatgggccaggcaccctgtcattcataaagcttttattccatgaccaaatgattatgctcctttatccctcacagattctagcacaatgccttgtataaagaaagtactcaaacatttgccaaatgatatactatataactattaatagtatcataaggtacattcaaggacctgttattttctttcattcacttatcctgacttactcctagcattacctacccagccatttactcagtctatttctttttcttttttttttttttttgagatggagtctcgctctgttgccaggctggagcgcagtggcgcaatctcggctcgctacaaccttcgcctgccaggttcaagtgattctcctgcctcagcctcctgagtagctgggactacaggcgtgcaccaccacgcccagcaaatttttttatttttagtagagacagggtttcaccctgttggccaggatggtctcaatctcttgaccttgtgatccgcccgcctcggcctcccaaagagctgggataataggtgtgagccaccacgcccagcctacttagtctgtttccatccaaacttttatctgatcaatatttcttccccatttctgataataccattacttctttagggtcaccacatacttcaaccacactgttctatgaggtgctatcaatcaccagactccatgctgaacagtctccctatcaatcccatgtagtaccaagagactgggcatgagatcaaaccaagtcgatctgacttgttcccctggattttataactggagcttgcaggggagagtcctgaagtgtagacaaagcaaaaagtaatcacggagtgtttatgaacagagctctaaccttgtagaaaaataaatgtgagaatggagctgagtgacaaaaggaagtaaaatagagaggaaagggggatcctaacagtgcctcagttccactgctgatttactacacttcccaaagtctggtttcatttcaccccagcaagatagagttaggattctttcacttgcatcatgaagacccttaactaacacagtgttcttttggtaaatcactgaaccctaatgaaatcatacataaaattttgagtgggccaggcacagtggctcatgcctgtaatcctagctctctgggaggccaaggtgggaggatcacttgaggcaggagtttaagaccagcctgagcaacatttctctacagaaatttttaaaaaattagccaggcaaggtggtgcgtgcctataatctcagctacttgggaggctgagacctgaggacgatctcttgagcccaggagtttaaggctacagtgagctatgatcaccccactgtgatccaccctgggcaacaccctgttttgggacagtgtctcaaaaacaaaagacaacaacaaaactacatgtgcatgtatgtttcaagggattcaaatcttagcattcaacaatcttaggattcaaaagattccttacccagaaaaagaaatgttaagaattggcccaggcacggtggctcatgcctataattctagcattcaggaggccaaggtaggaggattgtttgaggccaggagtttgggaacagcctgggcaacatagtgacatctcgtttctacaaaaaataaaaaattagtcgggcacagtggcatgtgcctgtagtcccagctactcagtgggataaggggtaggattgcttgagcccaggaggtcaaggctgcaatgaaccgtgactgcaacactgcactcagcctgggtgacagagtgagaccctgtctcaggaaaaaaaaaaaaagaaaaattaactactgatttaagataaattatcagttaaatacaaattaaatcaattaacccaaaccattccattctatacccttccaaatactaaaaattttacaacagataatggacagtatacataataaatcacaaaccaaaacttaccttcattccccacatcatcattcataagtccccccagccacatcttccagtcctcatcatctgccgtattggggtcatacatatctggagtgatgtctggagcttggagctctgcctctaattggcccaggggaacatctttcaggggcatcttagaacgcgttcgaaatgcaatgagactgtcatccatgggctggacaatggagaaagaaaagtcactgagtgagtgatgtttccaaacctcatcatcactccttttcttctcatcttagcttaagtaacaggatccttcctctaaacaatttggatttattattgtttgagaaactttaagaaacacgacataaaaaagaaataaaataaatgacatcagtttgaaaccaacattttaggaaaatttataacagctttattgatatacaattcacataccataaaatttacccttttaaagtgtataattgaaaggattttcatatattcacagagttatacaaccatcaccattatctaatttcagaacattccattaacccaaaaagaaatcccatacccattagtagtcgcttccctttccccctcctcccagcccctgttaagcattaatctattttctgtctctatggatttgtttctgctggacatttcacttagatggaatcataaaatgtgtggcctgtctctggccgctttcagttagcataatgcatttaaatcccaccctgttgtaatatctatcaatactttttttttttttttgagacatagtcttgctttgttgcccaggctagaatgcagtggtgccatctcggctcactgcaacctctgcctcttgggttcaagtgattctcctgcctcagcctcccagggagctgggattacaggcaccagccacgacatctgactaatttttgtatttttactagaaacggagcttcaccatgttgggcacgctggtctcgaagtcctgacctcaggtatctgcccacctcagcctcccaaagtgttcggattacagctgtgagccaccatgcctggtgtttttttttttttttttaagagatagagtctcaatctctcacccaggctacagcactggcacaatcagagctgactgcagcttcgaactcctgggctcaagcaattctcctgcctcagcctcccaagtagctgggactatcggcatgctctaccatgctcggctaatttttttttttttttttagatggagtcttgctctgtcacccattctggagtgcagtggtacgatctcggatcactgcaacctccatctcccgggttcgggtgattctcctgcctcagcctcccaaatagttgggactacaggcgtgtgccaccacacctggcaaatttttgtatttttagtagaaatggggttggccaggcttgtcttgaattcctgacctcaggtgacctacctgctcagcctcccaaagtgttgggattacacgtgtgagccactggatccatactcagctaatttttttcattttttgtagagatgggggtggggggactccctatgttgcccaggcaagtttcaaactcctggactgggctcaagtaatcctcctgccttggccttcctaactgctgggattaaaggcatggtggtatgtgcctgtggtaccagctactcaagaggctgagtcaggagaattgcttgggtttaggagttcaaggtgacagtgagacacgtaccactgcactccagtcaccatgcctggccccgaattccttttttcacccaataatatcccattgtatagatataccacttttgtttatccaattatctgttgatggaattcagattgtttccactgtggggcaattaagtataataccgctggctgaatgcattggctcacacctgcaatcccaacactgtgggaggcccaggaagaactgcttgaagctaggagtttgagaccagcctgggtaacacagtgagacctcatctctgccacaaacaaacaaattagttgcgtgtggtggcaccaattgtagtcccagctacttaggaggctgaaagagaaggatctcttgagactaggagatcaaggctgtagtgagccatgattgcaccattgtactccaacctaagcaagagagacatctcaaaaaaaaaaaaaaaacagggccaggcacagaggctcacatttgtacatctgtaaacccagcaccttgataggctgtggtgacaagatcgcttgagtctaggagttcaagaccagctgggcaacacagcaagacccccatctctacaaaaaataaaaagttagatgggagtggtggcatatgcctgtagttccagctatgcaagagccaacgtgggaggatcacttgaacacaggaggaggttgaggctgcagcaagctgagatcataccactgcactccagcctgggcaacagagcaagactcttatttaaaatatttattttaaaaaaatgaggctgggtgcagtggctcacacctgtaatcccagactttgggaggacaaggtgggcggatcacgaggtcagaagatcaagaacttcctggctaacagtgaaaccccgtctctataaaaaatacaaaaaattagctgggcatggtggcaggcgcctgtagtcccagctactcaggaggctgaggcaggacaatggcatgaacccgggaggcagagcttgcagtgagccgagatcgcactactgcactccagtctgggtgacagagccagactccgtctcaaaaaaaaaaaaaaaaaaaaaagaaaatcagaaagtgtgagacctccatctttgtactttttaaagactgttttggctattctgggcctgtgcaattccacatgaattttaggattagactgttaatttccacaaaaatggtagctgggatttggatagggactgcattgaatctgtagatcaatttgggaagctctccctagactacactgcatcaacctgctaatgggtttctgtttaccctcttgctttactctagtccatttcccacacgttaaccaaaaggaatttttaacattaatccaaaaatatcacaaaaatcttttcttatttatttatttttttttttttttgagatggagtctcactctttcctagactggagtgcaggggcatgatctcagctcactgcaacctccactccccacattcaagcgattctcctgcctcagcctcctaagtaactgggattacaggtgtgcgccaccacacccaggacattttttgtattttttgttagagatggggttttaccatgttggccaggctggtctagaactcctgacctcaggtgatccacccgcctcggcctcccaaagtgctgggattacaggcatgagccaccacactgggcatctgttctaatgtttaaaataaaatctacaccccttatcatggtttcctaagaccttcatgatctagctcttgccttgctctctgacctcatttctacctctttttcacgatcccacccttcatgtagtttctgttccttaaccatgccaaggttgtttctatcttagcgacttagaatgtgctgtttcttccatatggagcactttttctccccagatcttttacatgcctggcttcctctcattcggatctcagtttaaatgccatctcctcaaagaggccttttttctttttgttttttgtttttttgacagtcttgctctgtggcccaggctagagtgctgtagcatgatcacagctcactgcagcctcgatctcctaggctcagcctcccaagtagctgaggctacaggtgtgtaacaggatgcccagctaagttttgtgttttttttggtagggacaaggtctcactaggttacccaggcttgtcttgacctcctgggctcaagtgatccactctccttggcctcctaaagtgttgggattatggacataagccaccaaaccggaccctgttttttaaaattttttttaaaaaagttctcatactattacccatgctggagtataggggtgcagtcatggctcactgtagtctcaagctcccaggcttaatcaatcctcctgcttcagccaccaagcagctaagaatacaggcatgcgccaccacacctatataatttttctgagtttttggagagatggagtctcactatattgcctaggctggtctcaaactcctagcctcaagcaatcttctagcctaggactcccaaagtgatggaattacagccaaggaggtcttttttgatcagcctatctaaagttctctgacaggaagtttcatatttcctcattttaatttagttcatagcacttaaccacatccgaatttacttgtttatatgtttatagtctatctctcctcaacagactaagttccatgaagaacaattttttctgtcttctacactgttgtttctcaacttcaaccattcagtatgtgtttggtaaataaatgattacataaaaaactattactgctcctactactacatactccaaagcatggtgattaaatgactcagagctattccattcaatattctatttttaattatatacttatatataattataaattatatacttataaattatatacttatatatacttataaattatatacttatatatacttataaattatatacttatatatacttataaattatatacttatatatacttataaattatatacttatatatacttataaattatatacttatatatacttataaattatatacttatatatacttataaattatatacttatatatacttataaattatatacttatatataattataaattatatacttatatataattataaattatatacttatatataattataaattatatacttatatataattataaattatatacttatatataattataaattatatacatatatataattataaattatatacatatataattataaattatatacatatataattataaattatatacatatataattataaattatatatatatataattatatatatatatatatttttgaaatgtagtcttgctctgtcacccaggctggagtgcactggcgccatctcggctcactgcaacctccgcttcctgggttaaagcgattttcgtgccgcagcctcccgagtagctgggattacaggcacttgccacaatgcccagctaatttttgtatttttagtggagacggggtttcaccatgttgaccaggctggtctcaaacctgacctcgggtgatccacccgcctgggcctctcaaagtgctgggattacaggtgtgagccaccacacccagccttaattatattttttaattttaggatttctttttaaattattatatcatactttaaaattttaggacagacatttttcattgacctgcaagaatgataggggaaacttggaacattaaaatttactggctaaggccaggcatggtggctcacgcctgtaatcctagcactttgggaggccaaggcaggcggatcatgaggtcaggagatcgagaccatcctggctaacacagtgaaaccccgtctctaccaaaaaatacaaaaaattagccgggcatggtgtgcacgcctgtagtcccagctactcgggaggctgaggcagtagaatgacatgaacctgggaggcagagcttgcagtgagccgagatcacgccatcacactccagcctgggcgacagagtgagactccgtctcaaaaaaaaaaaaaaaaaatttactggctaaggccaggcgcagtggctcatgcctataatcccagcacttaggaggttgacaagggtggatcacctaaggccagttcaaaaccagcctggccaacaataaaaccctgtctctactaaaaaatacaaaaaattagctggcgtagtggtgtgtgcctctggtcccagctactcaggaggctgaggcacgagaactgcttgaacccgggaggcagatcagatgttgcagtcagctgagatcacaccaccgaactccagcctgcgtgacagactgtgactccatatccaaaaaataaaaaattactcactaaatgttagaattacaaagtcatcatttgacaacgaccatagtaaagactgtttcaagaaagaaaatcaggccaagcgtggtggttcacgcccgtaatcccagcattttgggaggccgaggcaagtggatcatgaggtcaggagatcaagaccatcctggctaacacggtgaaacccccatctctactaaaaatacaaaaaattagccgcgcatggtgcgggcgcctgtagtcccagctactcgggaggctgaggcagtagaatgatgtgaacctgggaggcggagcttgcagtgagccgagatcgcaccactgcactccagcctagaggacagagcaagactccgtctcaaaaaaaaaaaaaaaaaaaaaaaaaagaaagaataatcaatggatgctaatattagtgtgagaaaaataatttgattgattgggctgggtgcattggctcacgtctgtaatcccagcactctgggaggctaaggtgggcagatcacttgaggtcaggagttcgagaccagcctggccaatgtggtgaaaccccatctctactaaaaatacaaaaaattagctgggtgtggtgtcagtcacctgtaatcccagctactcaggaggctgaggcaggagaatcgcttgaaccccgaagtggaggttgcagtgacccaagatggcaccactgcactccagcctgggagacaggcaagactctgtctcaaaaaaaaaaaaaaaaaaaaaaaaagaaggctgggcgcggtggctgacgcatgtcatctcagcactttgggaggctgaggcgggtcaggagatcaagatcatcctggctaacacagtgaaactccatttctactaaaaaatacaaaaattagccaggcgtggtggtgggcacctgtaatcccagctactcaggaggctaacgcaggagaatcacttgaacccaggaagcagaggtgcagtgagctgaggtcgcgccactgcactccagcctgggcaagagagtgagactccatctaggaaaaaaaaacagaaagaaaggaattcggctttgaagtatatccccacatgatatatactaattaaaaatggaaaataataactttacaatgggaaaaccaagcacacaccaccttaaccaagtgatgaaagttaacattacagggatcacgtgccttctgatatgatgcaatgagaaacacacatcactcttccagtatttgtaacaaaagtgcaaaacctgaatctaagaggaaatattagaaaaataaaaattgaagaacattctacaaaataaatggtgcatactcctcaaaactgtcaaggttataaaagacaaagactgagaaactgttccagattaaaggagactaaagaacaagataattaaatagatatttaatccagggttgaatgctgaatagggaaaaaaaaatttttttcctccaacataaagggcattgttgggacaacagataaaaccagaataagcactttaatatattatgtaatattactgtatcctgatttttttttttttttgggacagagtctctctccattgcccaggctggagtgcagtggcgcaatctcagctcactgcaacctctgcctcccgggttcaagcgattctcctgcctcagcttcccaagtagctgggattacaggcatgcgccacgacacctggcaaatttttgtattttcagtcgagatgggggtttcaccatgttggccaggctggtctcgaactcctgacctcaagtgatccaccaaccttggcctctcaaagtgctaggattacaggcatgagccacagcgcacagcctgtatcctgattttgattaacactattatactgtgttaatacaagataataaactcatttttagaaaatatacacaaaagcatgcagaggtaaaatggcatcatgcctgcatcacactctaaaatgatttagaaaacactatgtgtatatacagagaaagaggaagagaaccatcaagcaattgtggtaaaaggttaatttgggggaatttgggtgaagctttttcctatgttctacattttaaaatgctctctgctacatagttcatttcttccttagaaactgccattctcagccaggcacggtggttcacaccagtagtcctaccactttgagaggctaaggtgggaggatcacttgagcccaggagttcaataccagcctgagcaaaaatatagggagacctcatctctacaaaaaactaaaatattagccaggtgtggtggcatatacctgtcccacctattcgggaggctgaggtgggaagatcacttgagtctgggaggcggaggttgcagtgggccaagatcacaccactgcactcaagcctgggtgacagggtgataccctgtctcaaaaacaaacaaacaaacaaaaaaaaccccaaactgccattgtcactttgagcagaaaatagcactagccaaatacaaagtatcaaagactaactcttacttatataaaattgtagttatcttttcctctcccttcccagcctgagcaacaactacattactccacttgactttctcagttaagtacagttttaatatttacctggaaagaatccatgcagactggactggaagccagctcctcatctaccgcatgtaacttctccatgaaagtactatctctggtctgtttcggctttggagggggcgggggccccatgggcactacctcagcactgatgtgcctgatggctggtgtggtgactttctcagcctgattaaaagaggtgactgcatcaaaaaaggaaggaggtaagaaagaaagagaaagcaaaaaaaggaaaaaaagagagggaaaaagaggcagactttccatacaccattgtcctttctcttctctagttagagttacataaaaacaaagacaccaagtgtattgatctaattagttttcatcctatttctagagaagtcaacagaatgctacttagtttaccaaaatgtgggaaattaataacaatggctttaggacaatattaaaaagcacagatatgaaagaagagaagggtaggagaaaagaaactctgctagttgcacatttttggccccttaatgagaactcagaaaagttctttggctatcactgagttctagccttctctgaactgtttactaacttaagaaactttgaaaaagggtgacagcccagaatcaccatggataaataatctacttatacagttaaaaaatctacttagacagttatgtctaacatctcttttgtatgatgccgatttacctctgataatatgccactctcctcatctgtttcagtcatctcagaagactgcctcaatctggatttctttgccccacgtggagatgaagcagtgctttcaacatcactttccaataagctctacaaaataaatccagttcgccttaatatttatgcccctacctcattccacaaagtctgaagtatctcaagagaaggaatcataaaatatcaatcactcagcctggccaacatggtgaacacccgtctctgctaaaaatacaaaaataagccaggcgcggtggcgtgcacctgtaatcccagctactcgggaggctgaggcaggagtatcacttgaatccaggagatggaggttgcagtgagccgagatcacgccactgcactccagcctgggtggcagagcgagactctgtctcaaaaataaataaataaataaataaaatccatcactcaactagttacagtaacagaaaataaaatttaaatagaaacttaaaggccaggtgcagtcagtgtcttatgcctgtaatcccagcactttggaaggccgaggcgggtggatcacttgaggtcagaagtccgagaccagcctggccaacatggcgaaaccccatctctactaaaaatacaaaaattagccaggcatggtagcgcacgcctgttaattccagctactcaggaggctgaggcaggagacttgcctgaacccgggagatggagatggcagtgagccaacatcgcacactgcactccatgggcaacagaggagactcaaaaaaaaaatcctaaaggtggggacagggatcagatcactatcctaatctgcattacaaagtgtaaggccttggtctaaaatccttttacaaaacaattcaaagaacacattaagaaacaagtcaaagaacatattaacacagcaatgaaagggaacgaagtatagctaaaaccaatagtataaatgaatctcaaaagcttaatgttgaattttaaaaagctaggaacaaaacatataaacatgggtccatttatataaagttcaaaacagtaacaattgaactacagtgtgtagagatacatattgaggtgatacaactataaagaaaagcaaagaaataattactaaaaggcagggtagtggttatttttagggggagggaggtgattgtgactggggagggtatacaggggttgtcctagtaatgatatatttcttgactttgctatgagtttcatgaggatttgcattataataaccaaagctatacatttttattctatgcacgtttctatgctgtatttcataatacaacaaattctaaaattaagggagtataaagggcagaaaaacagcttaaagcacagaaatgagctgaaaaaagaaccatgtctcaatcctctctacaagtgacattactaaggaagcaaagtataccctgctctattaagacaaatattaccaactaacattcactgacctcttcagcagtttcatcttcttcttcatcatccggctggtattcttcatctgaggaatcatcttcttcaaggtggatatccacaaactgaggaggctacattagtacaattagaaagaaatgaagtaatgggaaacacaaatcatacgtatttggaaaataaggggaagaagcagggcagaaaaaaaaaaaatcctaagagcataatgtacagctaaagcaaataacacgaggcagaggttaaagtgaattccatgagatacaaacctaagagtaatagaatggaaaaaaacaaagctggaattaaaacaaagattgatcaagaaaagttaaagaggaagtacttaagtttcaaaaccgatgaagtctttctggaaaagaataacaattatttcttccaagtttaccttaatttcattggccttcttaattggtgaaatattccatgttggaattacctaccaacaaagaatataaataattaagttatcttaactgaaataattgtttttcatgtttacttcctctgtaccatcactaacagccatatacttaacaagtaactgcagtgatctagaggtgttgattatccctgagggtatactctcaattatttgtcagagttagaaagaagaaaccaggaaagaatctattactgtcattagcatttctgccttacacctggtaagcctcacttctttctataaatgaagaaaacaatgtctaccttgttcatatcacagctgcggtttacatggaacaacagatgtgacaactatttataaactattaaactacacaaacctaagatattttggttacagtagtcttttaacagcaatatatttttgtaatcagttacatgaatccaccataagtacaactccaaaaagccagccatgaaaagcttttatggactattctgcctatggggtagccctgctctgcctatgggcttttttttttcttaaaaaaaaaaaaaaaaaaaaaagcttttaccagggcatttagggcaaagtttcatgttgtccacacttatttttccaatagtacaggaaaaaacaacacagagagatataaagcaaatatggcaaaatattactcttggaatttagattcattgtaacaatctttcaactttttgaatgtttgaaaatttttataagagctagggggaaagtttttcttgtttttgtttttgttttgagacaggatcttgccctgttgcctaggctagagcagcagcacaatcagagctcactgcagcctcaaattcctgagctcaagcgatcctcctgcctcagcctactaattagctaggactacaggcatgcctcctcaccaggcctcactaattttttaaattttttgtagagatggagtctcattaggtttcccaggctggtctcaaaatcctgggctcaaacaatcctcccaccttagcctctcaaagcactgggattataggtgtgagccaccacatctagcctaaagaacttttttaaagttcttatatactgctgataaaatgccattgaggatgtataatttcttgaccatttaattgtaacccaaccaaaagcaccttatgaacaaaagccaactggccattaggttctgtctctaaaaggagtcttagcttctcaaatcaaatcagccctgctatgttctgaccatttatctagtgctgtgtaggtgggaccaatatagggtaaagggaatgatgtgattcaggcccatttccctttcctacctactgccaaatccattagaaaggcaagccagcattcagaagtgtgttggagtcagtctagtaagaattaagaaggccaagtatagcggctcatgcctgtaatccccccatgttgggagatcaaggcagaaggatcacttgagcccaggagtttgagttcagcctgggcaacacattaagaccctatttctacaaaagaatgtttcaaaaaaaccaattagctggacatggtggcacatgcctataggcctagctgtctgcgaggctaaggcaggaagatcccttgagcacaggaaggagttcaaggctgcagtgagctatgattaggccactgtactctagcctgagcaacagagcaagtcactgaaaaaaaaaaaaaaaaaaagaaagaattaagaagcaagagacctacattttaatacttgctctcctacgtaaactataccgtcttggatggcccaacttctccacatctatattcatggccaataaacataattcagagcctaatttgatctccttggattttttttccccaaatcaaataaagaattaatgttaattatattcttttttttttttaagacagagtcttgctctatcacccaggctggagtgcagtggcatggtctccgctcactgcaacctctccctcctgagttcaagcgatcctctcgtctctgtagctgggattacaggcgcccaccacacgcccagctaactgttgtatttttagtagagacggggtttcgccatgttggccaggctggtctcaaactcctgacctcaggtgatccagctgcctcggcctcccaaagtgctgggattacaggcatgagccaccgtgcccagccatgttaattatattctatatgtcaagtagacttcatagaacttcctcactgatggctgctttcatcatagctaccacctattcatttgtgaacacatcctagagaaagatgaaatttcaatttatgcaacaagagttagtcaaccagaccaaaaaaagtgatgtgattgccaaaaacaaaggtcaatttgaccttaggctacattaggagaaatatgtaatctggaacactgtggagataatctaactactagtcaaaccatatctggttcagtagagtcttcttttggcatacttttaaaaggatatgggacgggcacagtggctcacgcctgtaatcctagcacattgggaggacaaggcgggcgatcacatgggtcaattggaaaccagcctggccaacatggtgaaaccccatctctactaaaactacaaaaattagatgcgtgtggtggtgcatgcctataatcccagctactcagcaggctgaggcatgagaatcgcttgaacctgggagccagaggttgcagtgagctgagatcgcaccactgcactccagcctaggtgacagagtgagactccatctcaaaacaaaaaggccaggcacagtggctcatgcctgtaatcccagtactttgggaggccaaggcgggcagatgatttgaggtcaggagtttgaaaccaggctggccaaacatggtgcaaccccatctctaataaaaattttaaaaaatacaaaaaaattagccgggcatggtggcacgcacctgtaatcccagctactcaggaggctgaggcaggagaatcacttgagcttgggaggcagaggttgcagtgagccagaattgtgccactgcactccagcctggacgatgaagcaagactcccaaaataaaaagggggggagaaattgggggatgtatagccaagaaaagaatgttatgaaataacatactagttttcttcaactgtaggaaaagtaatgtggaagaatacaccaattccttttcttgcttttttttctagacaaggtctcggtctcattacgttgcccaggctggtcttgaactcctggcttcaagcaatcttcctacctccacctcccaaagtgctgggattacaggcatgagccaccaagcccagcctagacctgtttcttctatcagtctccaaggaataaaaccaggacagataaaacctatgatacatattttcggtctgtaaggcaaatcttccttactatcagaaatataatgaactccctcatgactattacctgccttgtaagcacaaactagtcaagtgcttattaagaaggatatagcacagctccaagcaccaaagagcttgctgcacagaatacttcagatgtcttcaagtggttctcaacactttagtattcaaaagaattaactgttgtgtttttgccaatgcatattccaaggccctgcccatgggtcctgattctcaggtctggggtgggctcaaaagtatggagatttttttgtttgtttttgtttttttgagacagtttcactccgttgcccaggctgtagtgcagtggtgcaatctccactcactgcaacctccgcccccgggttcaagtgattcttgtgcctcagcctcccaagcagctgggattataggcgcacaccaccacacccagctaatttttgtatttttagtagagacagagtttcactatgttggccaggctggtctcgaactcctgacttcaagtgatccatctgcctcggcctcccaaagtgctgggattacaggcatgagccactacacccagccaaaagtatgcatttttaataagcatgcctgagggatcccacaccaaagtgatttttatgcaactggcccctggaacacactatgaaaaatactaaacactttgcaacatgtgttgtaacataaatagaaaaactggtctcacctattgatttcaactattccaaatggttatctatctagcaattccaaaaagcaatgcttcatatctactaaaataaactatgattatcatagcttatgatcatgtagaaacaattctactgtcttttataaatatttctttaaagaggcaaattcagaccacaatctttcctatatttttccctatgggtgaattagatcctattcaccaagctaaaaaaaaaccaacaacaaaaaaacagaatacttaccactcctttttccactacttccttcagtttagagcgtgtcattttaggctcctaaggagaaaaaaacagaaaggaaatcctcaataaaaatcacagctcagtgaggtggctcatgcctataatcctagcactttaggggccaaggtgggaggatggcttgaggcaaggagtttgagaccagcctgagcaacagagtgagacaccctccctacaaaaaaattgttttaaattagctgggcatagtcgcatgttcctgtagtcccagctactcaagaggctgaactgggaggatcgctgagtccagcttaggagtttgagtccagccttggtgacagagcaagaccctgtctctaaaaaaataataataataaaataacaaggccgggcgcggtggctcacgcctgtaatcccagcactttgggaggccgaggcgggcggatcacaaggtcaggagatcgagaccgtcctggctaacgtggtgaaaccccgtctctattaaaaatacaaaaaattagccgggcgtggttgcaggcccctgtagtcccagctactcaggaggctgaggcaggacaatggcctgaacccgggaggcggagcttgcaatgagccaagatcgcgccactgcgctccagcctgggtgacagagtaagactccgtctcaaaaaaaaataataataataaaataataataataataaaataacaaataaaataagtaaaaattaccaagtaattcttatgttttgaaatgctaactttaaccccagctgccaaactgtttacaaactcctaagtgacctcctacccttagccagtttagagataactctgttccaagacattaaaagagtgataatcaactactcacaaacattggcatatcttccgtctcactgatggctgctttcatcatagctaccacgtgttcatttgtgattacttcctggagaaagatgaaatttcactttatgcaacaagggtttgtcacctagacaatactcatctctccatgtaactgtcagacctatgtacaggacaaatgagaaccatatactcgaatagcatcagactggggtaaagcaaggcaactgaaagcaaagaaggcagaagtaagttttggccagaaccacacagtttcaaacaatgtagcagcaaatgaaccaatctcattagctgctactaggaacaggaatggctcacataaaaggagatcctgaggtaagtaactatatgcttaagagaaagagtaacaagagcaaaggctctgcaaatagctgtgttgctacatatcaagaaaagtatttacatatgtacaaagtgcaataaactattaaccaggcatctttttagacatatcgacccacaagagtaaacccactatgaacattatcaacattgaatctactaaacaatacagtaaatatgaaaatcagtggaaggaaacaggaacagtttatctttccaattaaattcttctttaacatgtgttcatatttcaaacttgtactgagtgcaaggagaaagctatcttaaatatgtaaaaatgtaaaatgttctgtcacgggtaacccacaaaatcggtaattcacgtatcaagagtcaagaatttgctgaacatttttatatgctttccatgaaaaagttcccttccatttacataactgccccagtcttactcacatgaaggatgtttcggacattgactgctgttagattgtgctgcttggcaccatcctccaaggtacggtcaagcatgtcatccagtttcaggtcatatgccaaggtcccttcttgaccccttccatctcgtttcctcttggtaccctttttcttttttctccttttctcactttcttcattgtcttgttcttctgcaaataaaccaagaacatcatcagaattccaaaatagctgctccaggaacttagcccagaaagccaacagtaaagtggataaatctcaaaagcattatgctgtgaaagaaaccagatgtaaaaggacacatattatatgacggtataacaagtatagaacatttgcatagaagatgcaaaactatggaaatagaaatcagtgcttgccaatgtttgagaaagggggatagcaaaggggaattaggcaacttttggggtgacagaaatgttccacgttggttgtggtagcagttaacacaactgtatatatttttctttcttttgtttttttgagacggagttttcgctctttgttgcccaggctggagtgcaatggtgcaatctcggctcagcgcaacctccgcctcctgggttcaagtgattctcctgcctcagcctcccgagtagctgggattacaggcatgtgccaccatgcccggctaattttgtatttttagtagagatagggtttctccatgttggtcaggctggtattgaactcccgacctcaggtgatccacctgcctcagcctcccaaagtgctgggattacaggcatgtgccaccacgcccggctaattttgtatttttagtagagatggggtttctccatgttgctcacgatggtcttgaactcctgacctcaggtgatccactcgcctcagcctcccaaagctctgggattacaggtgtgagccaccgtacctggcccaactgtacatatttttcaaaactcatcagatacattttattttatatctcaataaacctaatgaaacttaccacattaacaaaatgaaagagaaaaaaacatgatcttaatagagataggaaaaagcatttgatgaaattcaatatatgaaaaaactcagaaaacttaggaaaattatttccttaacctaaaaaatatttctatgaaaagcctataactatcctcatatataatgaaggaatactgaacattttcctgttttgtccagaaataagacacagatgtcgactaccactactacttacaacctacatagcaatgaaggtctagaatatgcaataagaaaaattacgtgtccattttaaaagcatttgccaaagtgaggctggacgcagtggctcacacctataattccagccccttgggagcccaaggcaggtggatcacctgaggtcacgagttcaagaccagcctggccaacatggtgaaacctcgtctctactgaaaatacaaattagccgggcatggtggtgtgtccctgtaatcccaattactcatgaggctgagacaggagaatcacttgaacccaggagacggaggttgcagtgagccgagatcacaccactgcactcaagcctgggcgacggagcaagattcacacacacacacaaaaaaaccatttgctaaatcaaataaagaagtctttagtcatgtgtctgtgttatgtttcacaataaaaaatttagtatttcaaaagaattttaaggatgcccaaacttataagctagcatttccacccaacgaaaaagaagtacacatgttcagcaaaaaatctatagaatgttcacagcagcaccactcacagtagcccacaactgaaaagtatccaaatgctcatcaagaattgaatggggccaggtgcagtggtttgcacctgtgacccagcactttgggaagccaaggcgggcagatcatttgaggtcaggagttcaagaccagcctgaccaacatggtgaaaccctgtctctactaaaaaaaaaaaaataatacaaaaattagccggccatggtggcacgtgcctgtagtcccagctacttgggaagctgaggcaggagaattgcttgaacccaggaggaagcggttgcagtgagccgagattgcaccattgcactccagcctgggtgacgagagcaaaactccacatcaaaaaaaaaaaaaaaaaaaaaaaaaaaaggctaggcacggtggctcatgcctgtaatcccagcactttgggaggctgaggcaggcggatcatgaggtcaggacttcgagaccagccagaccaacatgatgaaaccccatctctactaaaaatacaaaaattagcagaggagtggtggagcgcacctgtaatcccagctactcaggaggctgaggcaggagaatcacctgaacctgggaggcggaggttgcagtgagccaagatcacaccattgcactccagcctgggcgacagagtgagactctggttcaaaacaaagactctgtcgcaaaaaaaaaaaaaaaaaagaagaagaagaattgaatgggtaacaatgggcacaaggaagcaaaaagaaaaaacaaagagttgaatggataaagaaaacgtaaagcaaaccaggtgaggaggctcatgcctgtaatcccagcactttgagagatcaaggagggactgctcgagcccagaaatacaaaaccagcctgggcaacatagtgaaaaccgtctctaaaaaaataataataataaaataaaaatgaaaattagccaggcattgtggcgtgcacctagagtccgagttgctggggaggctgaagtgggaagatcacttgaacctaggagttcaaattgcagtgagctatgatcatggcactgaacttccagcctgggtgacagagcagtacctatctctaaaaaaaaaattaaagaaaagaaaacatacataaactattcaaacaacagaatgatatacagcaataaaaatgaacaatctacaagtacatccaagaatatggatgaatttcataaaacaatgttgaggccgggcacggtggctcacgcctgtaatcctagcaccttgggaggccgaggcgggcagatcacctgaggtcaggagatcgagaccagcctggccaacatggtgaaagcccgtctctactaaaaataaaaaaactagccctgcatggtggccgtgccagtaatcccagctacccaggaggctgaggcaggagaatcgctggaacccggaaggcagacactgcagtgagccgagattgcgctactgcactccagtctgggtgacagagcaagactctgtctcaaaacaaaaaaaaaaaaaattgagagaataaacgcagtcacaatgccaggcacggtggctcacacctgtcatcccaacactttgggaggctgaggcaagaggatcaattgagcacagcagtttgagaccagcctgggcaatatagtggggctccgtctctacaaaaaaaattttttaattagctggctgggccgggtgcggtggctcatgcctgtaatcccagcactttggaaagccaaggcaggcagatcacctgaggtcaggagttcaagaccagcctggccaacacggtgaaaccccgtctctacaaaaaatacaaaaattagctgggcatgatggcaggtgcctgtaatcccagctactagggatgctgaggcgggagaatcgcttgaacctgggaggcggaggttgcagtgacctgagatcaagccattgcattccagcagcctgggcaacaaagcaagactgtgtctcaaaaaaaaagaaaaaaaattagctggctgtgacggcacgcgcttatagtcccagctacttagggctgagacaaaaagatcactttaacccaggaggtcaaggccacagtaagccgtgatggcaccactacactccagtctgagtgacagagtgagaccctgtctttaaaaaaaaaaaggcagttataaaatgtacacacgattccattcaaataaaagacaaaaagacagaacaactggctaggcgcagtggctcacacctgtaatcccagcactttgtgaagccaaggtgggtggatcatctgaagtcaggagttcgagaccagcctggccaacatagcaaaaccctgtctctactaaaaatacaaaaattaagccgggtgtggtggcaggcacctgtaatcccagctactccggaggctgaggcagaagaatcacttgaacccaggaggcagcggttgccgtgagccgagatcacgcccctgtacttcagcctgggcgacaagaacaaaactccgtctcaaaaaaaaaaaaaaaaaaattgaaccaatatatgatgctagacatcaggatagtggttaacctatgggtagagggtaattgaaagggaagacaagatggacttctgggtattgataacattctctatcttgatctgggtcctgcttacaagggtgtattaaatttgtaaaaatatagtgaattcaggatatcttaggacatgtgcagttttctacatattatacttcaataaagaggtttcatttaattaaaaagaaaaagaaagcctacccattggaatgaagagtccaccatcttctatctcttcctcaggttggtgaaacagagtcctgagtggcttttcttgaggagaggcacaaacatctggctgggttgatttcctgggctggcttactggttttgcagattggctgcctgatggcagggaaggtatctccccttcagaattcatttgaggtttccctggaagaatcacaaatattgctccacactttgaccattctcagtcatactctgttgtagaatttagcatcttattatagtgtttttaggtagacaacttcatgaattaagcatatactatataggaattttcctctcttaaatcaaagctcagatccaatttactcatctgtaaactcagggagttaaactaggtaattgctgaggtctttttatttctaatatgctttcagttttgcattttttcctatgaaaaatcagacttgtaaaggaaattcctgatgacattttatatagatgaccattaacaccatatttcatcaactataaatataatcataaaatgccctgactttgtaaatcaatttggcagagcagaagagtaactgtcaccataaaattgtaaatatatggttctacagttcattagacaactttctcacctcaacacttcataaacactccctttgtgaggggagtaggtgaggctagcattaaaaagacagagaaaaaaggggtgatggtgcatgcttgtagtcctagttacttgggggggctgagctgggaggatggcttgaggccaggattttgaggttacagggagatacgattccaccactgcactccagactggacaacgcagcaagaccccgtcacacacacacacacacaaaaaaaaaagccaggtgcttatagtcatgaggtggctcatgactatcatcccagcactttgggaggctgaggcaggaggatcacttgaacccaggagtttgagaccagtctgagcaacatatcgaggctttgtctctactaaaaataaaaataaaaaattaggctaggccaggtggctcacacctgtaatcccattactttgggaggccagggcaggaagatcgctttagccaggatccaggagttcgggaccagcctgagcaacatttggagataccttgtctctacaaaaatatagagctctaaaattagctgggtgtgttggtacacacctgtggtcccagctacttaggagggtgtggtgggagaatcacttggaccctggagttcaaggctgcagtgagctgtgatcatgccattgcactccagcctgggtgtcagagcaagacactgtcacacacacacacacacacacgcaaagaaatattcatgtagtattaaaagtaggctgggcgcagtggctcacatctgtaatctcagcactatggaaggctgaggcaggcagatcacttgaggtcaggagttggagaccagcctggccaacatgatgaaacctcggctgtaaaaaaagaatacaaaaataagccaggcatggtggcaggcacctgtaatcccagttacttgggaggctgaggcaggagaatcgcttgaacctggcaggcagaggttgcagtgagccaagatagtagtgccacttcactccagccagggcaacagagcgaaactccatctcaaacaaaacaaacaaacaaaccaaaaaagaatgctgggcacagtggctcacgcctgtaatctcagcactttgggaggctgagatgggtggatcacttgaggtcaggagtttgagaccagcttggccaacacggcaaaaccccgtctctactaaaaatacaaaaaattagccaggcatggtggcgggcacctgtaatctcagctacttaggatgctgaggtaggagaactgcttgaacccaggaggcggaggttgcagtgtgccgagatcgcgccactgaactccagcctgggcgacagagagagactctgtctcaaaaaaaaaaaaaaaaaaaaatggtaaacatcagaaatcaggctatcaaggaaatagcttgcatatatacagaaaatccctggactatacacaaaaaattgtttaacagttacctgggaagaggacttggggagcaagagtacaaagtgaaaggatgcctaaattttcactgtgtactttttatatttctgaattttttccctagtttgtgtattacttagttgaacattttctttcaaaacacatggccagtctttatacttgggtctcactctgtcgcctagcctggagtgcagtagcattgttatagcttacttccatcacaccatccagctaaatcttctgctttaatggtgtttattctaatagaattttacttgttcttctgaatttgacttacataccctaatttccacttatgcttctcctttctttgcctcctaaaagtgagtagcatgattttagcttataattagttgatttgtactgttctcagctaattttgatgttatgatcagccaggcatggtggttcacacctgtagtcctagcactttgggaggccaaggtgggcggactgcctgagctcaggagtttgagaccatgctgggtaacatggtaaaacctcgtctctactaaaatacaaaaaattagccagccgtggtggcaggtgcctgtaatcccagctattcaacaggcacgagaatcacctgaaccggggaggcagaggttgcagtgagccaaggttgcagtgagccaaggttgcaccactgcattccagcctgggcgacagagcgaggcactgtctccaaaaaataaacaatataaattaaaaaataataattttgatgttatcaacatacagttctcaggctggcagtacataagttacagatatgctctgaataaggtttgctttctctatttctcttattctgctcagcttctctttctgaggtcttttagcatccagcatatctataaaggaaggtggggtcctaaagggctctaggaaggggaaataaattgaaaagcattgtggagtcagaggggaaaaaaaggttgtagaaaaaaggaacatttcctctagagtatgaaaaatgattttgtggtgcagctgataatgtgcttgcagggacagtttttttgttttttttttttccagacagagtctcgctctgtgggccaggctggagtacggtggcatgatctcagctcactgcaacctccgtatcctaggctcaagcaattctcctgcctcagccttccgagtagctgggattacaggcgtgtgtcaccacgcccagctaattttttatttttagtagagatggggttttaccatgttggccaggctggtctctaactcctgacctcaggtaatctgtccctctaggcctcccaaagtgctggaattacaggcatgagccacgcacccagccctgcagggacagttttaaaaagcagttccaattttttttttttcttgagacggagttccattcttgttgcctaagctggagtgcaatggcacgatctcagctcaccgcaacctccgcctcccgggttcaagagattctcctggctcagcctcccgagtggctgggattataggcatgcaccaccacgcccagctaattttgtatttttagtagagatggggtttctccatgttggtcaggctggtctcgaactcctgacctcaggtgatccgcccacctctgcctcccaaagtgctgggattacaggcacgagccaccgcacttggccaagtagttccaatttttttgttgttgctgagacagggtctcgctctgtcccctaggctgaagtgcagtggtacgatctcagctcactgcggcctcaacctcctgggctcaagtgatccttccacctcagcatcccaagtagctgagactacaggttcctgccaccatgcccagctaattttattttatttttgtagagatggggtctcactatgttgccaagtctggtcttgaactcctggccttaagcaatcctctcacctcagcctcccaatgtacagggataggtgtgaaccaccatgcctgaccccaaatattttttaagtagtaaaaatgtcagtggaagaggctctgcctaccaaagtgaatctctgtgttttgaagggcaatacttgcttagatttaaaagttctggtatgcttgtttaaaaagtaatttgtgggctgggcatggtggctcatggctgtaatcccagcactttgggaggctgaggtggacaggtcacttgagctcaggagtttgataccagcctggttaatgtggtgaaacgctatctcgacaaaaaatacaaaaattagccaggcatggtggtgcacacctgtagtcccagctacttgggaggctaaggtgggagaatcacttgagcctaggaggtcaaggcagcagtgagccgtaattgcactgctgtactccagcctaggtaacacggtgggaccctgtctaaaaaaaagttatgtgtggcttcatgcctgtaattccagcgttttgggaggccaaggcagaaagattacttgaagccaagagttagaggttgtagtgagccattattgtgctactgcactctagcgtgggctacagagtaagactctgtctcgttaaaaataaataaataaataaataaataaataaataaataaataaataaaaagttatttctagttgagcccagtggctcatacctgtaagcccagcactttagaaggctgaagcagcaggatcatttaaggccaggaattgtaggttgcagtgaattatgagacctcacctgttaaacaaacaaacaaacaaaaaacatttctatgctgggcaacttatagagaccttgtgtctgcaaaaagtcaaaaaaaaaaaaagctgggtgtggtggtgcaggtctgtagtcgcagctttttttagctggatgatgtggctcctgcctatagtgccagttacttggtaggatcagttcagcccaggagttagaagctgcagtgagctatgatcgtaccactggactatagcctggatgacagggtgagacctcatctctttaaaaaaaataaataaagaaaaggtttaaacactaatacctgcagtcaagaaacatgatttaggctggacaatgcaaacccaggaggcggagcttgcagtgagccgaaatcacaccactgcactccagcctgtaatcccaacactttggaaggccgaggtgggtggatcacttgagatcaggagttcaagaccagcctggccaacatggcgaaaccctatctctactaaaaatacaaaacttagccaggcgcagtggcacatgcctgtaatcccagctactcgggaggctgaggcaagagaatcacctgagcccgggaggtggaggttgcagtgagctaagatcacgccactacactccactccaacctgggcaacaaagcaagactccgtctcaaaaaaaaaaaaaaaaaaaaaaagaaagaaaaaaaaagaaaaaagaaacatgatttaacaatgtattgcccggcaaggtgcgcctagcgcagtggctcacaccgtaatcccagcactttgggaggccgaggcaggtggatcacaaggtcaggagttcaagaccagcctgaccaacatggggaaaccccacctctactgaaaatacaaaaattagccaggtgtggtggcaggcgcctgtaatcccagctactcgggaggctgaggcaggagaattgcttgaacctaggaagtggaggttgtggtgagccaagatcatgccactgcactccagcctgggtgacagagcgagactctgtctcaaaaacaaacaaacaaacaaacaataacaacaacaaaaaggtatcaattgtaacaaaatgtcaatacttgaaaataatccaactatctttctatgtattttcattttttctacagtgtatatgatgctgctgctttcataatcagaaaactaaaatgttacttaaaagaaagtaaaacaacaaaaacacatactaaacagcagggctacgggtgatttttattttctcctttaaagttttcaatattttccaaagtagatatatgtgaattgtcaatctttctttcttcctctctgttttgtgttacattatctgattggcaaaaaaaaaaaaaaaaaaagttacttgaagaaaaattctggagagacactcatagtgtacttttattgctattacttgtatatacaactaattaaagtgcaaagtagtataatcaattttcagttctccagattaatgaaggggagtgatatcacagataatactaaacaataaatgtttatttaaatccggatatctgtgaactgatttttaaaatctcttaattacacttatcaataactgagtgactatgaacccatagttatttatccattccttctctagcattttaatcttataatttcctccagttccttctgacaacttatcttgaaaaaatatgcaataatctcgctgccttctctagctatttctcacccattctcccactgcaaaaaaaggaaggaaggccaggcatggtggctcacacctgtgatcccagcattttgggaggccgaggcgggcagatcacaaggtcaggagatcaagaccatcctggctacggggaaaccccatctctactaaaaatacaaaaaattagccaggcatgatggcaggtgcctgtagtcccagctactcgggaggctgaggcagaagaatggcgtgaacccgggaggtggagcttgcagtgagccgagatcacaccactgcactccagcctggtcaacaaagcgagactctgtctccaaaaaaaaaaaaaaaaaaaaaaaaaaagggaaggaaggggaggggaggtgagggaaggggataagagggaagaggagagtggggaggagaggggaggagaggaggaggggaggaagggaggaggggaggagggggatgggggagaggaaagaaagaaaaatctctggggtttcattcctcctcctttttcttttttttacagacaaggtcttgctctgtcacccaggttgcaatgcagtggtgcgatcagagctcactgcaaccttgaactcctgggctcaagctatccccctagctactcctgagtagctaggactacagggatgcactaccacacttggctaatttttaaaattttctgtagagatggaacctagctatcttgcccaggctgttcttgaactcctggccacaagatcctcacaccttggccttccaaagtgttgggattacaggtgtgagccactgttcccagccccattccttcctctttaactgcttcatataatgtcctttccccaacaaactcctgaatctactctccaagatcatcaatcttcaaatgtaacctttttctcaggtattatccttatccctcctttgctactaaattttaaatttacattttaaagtaccttgttcttaaagctctccttcctcttttcacttttactattacttctccagttgttccttctctgttatcttcttcctcaaggcaaggttgtcttcaatccactgctcttccccctccatgtctgtttccatggagaagaaccatgactaacactgaacatttctagtccttgcctcttactaaacttcaatctcagatttctatttttgcttgctggccctattgtcacctcacattccatttgaggtaggagatcagcaggacttgttttccaagcactgttcgaaagaccccgctgaacaaaacaggagctgatcaaagaaactggccaaaaccagctaaaagcaagatggtgatgaaagccacctcctgttgccctccttttatctgcatgctaaaagaacctcctaccagcaccatgacagtttacaaatgccatggcaacccccagatgttaccttatatggtttaaaaggggagggactctcagttccgggaagtcctcgccccttttccagaaaatccattaaaaatccgccccttcgcctctgcccagctgcccctactgggaagtgaggagcccctctgcccagccagccgccccgtccgggaggtgaggggcgcctctgcccagccgcccctactgggaagtgaggagcccctctgcccggccaccaccccgtctgggaggtgtacccaacagctcattgagaacgggccatgatgacaatggcggttttgtgtaatacaaaggggggaaaggtggggaaaagattgagaaattggatggttgccgtgtctgtgtagaaataggtagacatgggagacttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagtcatcaccactccctaatctcaaggacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaaaaaaaaatctgccccttattttagcatataatcaaagtatacccatatatatatggctatacaggtctcatgcttttgagggtcactgttggccaccccctaggtgctctgggattttcgtcatttggtatggggaccctcatgggctgatgcctggatactctgggtattttggcatttggcaccgtttcattttttttccatgttgtctttgtatacatacagctagccagcaatccgcaggtctgctgctgcggctgcttctcttacagagcagccatttcccttcctctgttgctctaataaacttactttcaattcactgttggcccattcatgattccttccagtgcgaagccaagaatgctcctgggctgagccccaatttggggttcacctgcgtcattccttggtgaccatgaagagaccaataataagccaaaaggaactgagggagacctttagccagaccctaaattaagactgattgggttgagcaccgtggctcacgcctgtaatcctagcactttgggaggccaaggcaggtggattgcctgagctcaggagttcgatactagcctgggcaacagagcaaaaccccggctctactaaaaatacaaaaaattagccagccatggtggtgcacgcctgtagtcccaggtacttgggaggctgaggcatgagaattgcttgaacccaaagactgactggcaccatttggcctccacgaaaagatgagtgtcccctttgttccccctcaatgtgtgttttgttttcgttttttttttttttttttgagacgacatcttgctctgtcacccagggtggagtgcagtggcacaatctcggctcactgcaacctcgcctcccgggttcaagcgattctcctgctttcagcctcccgagtagctgggatgacaggtgcctgccaccacacccagctaatttttgtatttttagtagagacagggtttcaccacattggccaggttggtcttgaactcctgacctcgtgatccccccgcctcggcctcccagactgctgggattataggcgtgagccaccacgcctggccgatgtggtgttctttaactgatttactttctctttcactctcctctccctttaccttttcaaatcaatcaggaaatggggaatagtgtctctgggttgttagtcagttcgttgtcccccatcatctgggtgccccagacagaagcacacctggacatccacgtcctttgtaatttactttgtcaccttctctctcagaccttttctctttagcttctaatgaccagtcattttacttttctgctcttagtgcctaaatgcacacttatgtttatccagttgtcatgtttgtagtccctgttttggcaatttgggcagttgtttctattccatgtaaggcaggcttttgttattttgagaggtattcctttgtgctgactctgggatgtcagagtcacattattctatggccccaactgtgttaggtctcatgcctttgggcctcactgttggccacccccaggttttcagcatttggtatggggaccctcactggccaatgtctagatactccaggtttttcagcatttggtgccgtttcatttttttccttactctgtcattccatccacttcagcaacttcttctagtccctcctaaaatcataaattttcttttctgcaacaggtctcttcctgtctttctttctgctcaaaatgagggtcccaaatgagctgccttgttcaagcccatttttctggaggccctgaacccctgacctaatgacgactccctgcaatggcagaaaagcagccgcctgaacactttttttggtgtctccactgatgggtgagttctccactgtctcagggactccaaggacacgccctgaacaacaacccctctcttccccaattcacatttgctgctacgggagcctgtttttcctagcttcctttccctttctgccttttcagtcttcttttattatacttctactggttcatgtctctctaggattgtgggtccctgggacagtcccaaggtcttgggtccaagatatctgatattgaagttgtcatggtaaggtgacccttcatccatcaatgagtgttctggcttgctgtatctctctctctctctctcccccaccagagaaacaaagggaaaggtacccctcatccccctactctccctcctttccctctttttctttcctgcccttttaaatcatctcctcctcctctgaagctgaagggggaaaaaaggataaaagagggttttaaaattaaaactgttatgaaaactaccttacccaaattctagtctacagtttccttggattacctattagaaaaaaaaagtttagccatgtgaacaggtttcaaaattgtcagaaatatttaaatccagctatctttaataaagtccaaaggcttttcaagttcacatgaatcctttggtaaataaaacttgttttcaaattattaataaagactgggtgctgtcgctcacacctcccaaccttttgggaggctaaggtgggaggactgcttgagcccaggagttcaggaccagcctgggcaacatagtgagactccatctctaaaacaaaacaaaaaaaattagccaggtgtgacagcacacacttatagtcccagctactcaggaggctgaggtggaagatcacttgaccccaagaggcggaagctgcagtgagctgtgatcatgccactgcactccagcctgggcaacagaaaccttgtctcaaaaaattaattaattaaattaaataattgatggaaatagaaatgtcttcagaattgtataaataagacgaatttaagattgttggctcaatgaaaatagctgaatcttctcagttactggcaaaatgcccatgtgtttaagattcttacttaggggttcacctaatgttcagagtttaaaaatggttaaccaggaaataactttgaataatgaccaattttgtctaatatagttccagctaggcacaggggctctcacctgtaatcccagcactttgggtggccaaggcaggtggatcacttgaggtcaggagtttgagaccagcctggccaacatggcaaaaccccatggctactaaaaatacaaaaattagccaggcgtggtggtgcatgcatcccagctacttgggaggctgaggcccaagaagctcttgaatccgggaggcagaggttacagtaagctaagattatgccattgcactccaacctgggtgacagagtgagactctgtctcaaaaaaaaaaaaagaaaaaaaattataaataataataataaattaggtaaatataatgagataaatgcttataagtgaactttttgtataatttaaaatcttaaaatcgttttggatgcttattggatgcctgggtcatttccaattaagaaaggaatattatatagggaaacattttacaataaaataaaaaattttaaaaactgtggaatggttctcatctataaaatgctaatatctgatagttcaggatttcttccttcttaggtttatataaaacttaccaaagaagatgtgtttttattgagaaaaagaataattgtgtctaattcaaaagttatctaaaggttgattcaaattatggacttgaaaaggttatttatataaccaggtagaaaggaaccagtaagtaggggagagataggtaaagaaagttatggatgttcagaggtatttttggtaagaaaggttataaataaaagagaataattctacataagaaagaatcctgcagatctcagtgggaaaaaaaaaaggatcttatatggtattgttctagagtagtagaatgactagttatttaggaaaagtagtataggccaggcacagtggcttatgcctgtaatcccagcactttgggaggccaaggtgggtggatcacttgaggttaggagtttgagaccagcctggccaagatggtgaaaccttgtctctactaaaaaatacaaaaattagctgggtgtggtggcacacgcctgttaattccagctacttttgaggctgaggcaggagaattgcttgaacccgggaggcggaggttgcagtgagccaagattacaccactgcacaccagtctgggcaacagaatgagactctgtctcaaaaaaaaaaaaaaaaaggtagtattggacaagtcagaaagttcattcaaccatatcatacatggtctgtgcaggtcataagatttataaaggagaatttataaaaagaattgtttatgtgattaagttagctataattaaaagtggaatctttctaaagaatggtctcctatgttaaagtaagggtttcaaggtattgatttgctcttaatgaaattacaagaaaatttgcttttcaattctataacttgtttcttttgaaaatttctcagattcatatctcataagttcaattgttctatctcactgctttcagctttttctccccttgagaaagcctgagacattagtctctccttcaaccttttcatcagttgctgtaactttttctcttccagttctgtttttacagtcagatgctgaaatattttagcttagaggtctataaaagcaatgttttcctccagtataacttgattctatactcttggtttttcttgacatgtctaaattttcagagtaaccagaaaacttttcatgttcacctgctatattcaaaaccttgaacatactttgtccgattaaattcaagtattatttttctcttcatcaaatttaacttcaagattagttaagtgggcttcccataaggagagacaattacactgcagagagattaccactttgggtaaataagtaactattacttacagtaacctgtggttctgtgtcaatacagtattttgggctttttaacatcttttacaaatgcccccagaatcgaatcctagcttgattgtctggcttgttgctgggctttatcaaagctataaaaactaatcactgcaaggttgtgatatatttttacagcctcctgacaggttgtggactccagcattaccactgccagccctttaaaaagttccttatcgggtgctattaactaatcaatgtgcttttgagttacagggctttgactcctgggtacagacagctcatctagagaaggcaccaactcttgccaggatctaacaccaaactcaagttaaccaaagccttgtctttagacctgggcaaaaggggcaaagtaaactgctttaggacgggcgcagttgatcacgcctgtaatcccagcactctgggaggctgaggtgggtggatcacctgaggtcgggagttcaagatcagcctgaccaacatggagaaaccccgtccctatcaaaaatacacaaaaattagctgggcgtggtagtacatgcctgtaatcccagctactcgggaggctgaggcaggggaatcgcttgaacccgggaggcggaggttgcggtgagccaagatcatgccatggcactccggcctgggcaacaagagtgaaactcagtctcaaaaaaaaagtaaactgctttaatgagacacagggacaagcttgtattcatttaataattttgcctctatatgaattaatataacttattctatgccttgatactaaataatttaaatgtttaggtacctgtaagattcctttcctgtcattctcaaaactagggcagggcttatgacttttttgtttgaaacattgctaattctttatgtgttgttttatctacagaatttaaaactattcaattcctccaggcccaaggactactgaagaggtgggcatgagagattataggggctgggttttgagggatataattaattcagaccttccaaatcaaggacaggcacacagatacctaaatagctgaacaaaatgtttgtgttttgtaaacctaattgctgcaagccaagattacaatagctcaatgcacagaatttatagataagtcagttttataaccttattttttggcttctggttttggctcttatattgcttaaaaggggttttaagagataataatgagtgcctgcctacctccacttccatctggcctacaatgtttaattggctataagtcacttgaatctaagtcccttggccatcagcgtcccaccaagggacatgagggacctggggcaggtagcacaccacctcagcattggtatggaacaaaataaaagcttggccagcaatattgcctctggcagctggatgcagtggctcacacctgtaatcccagcactttgggaagccaaggcagacagatcacctgaggttaggagttggagactaacctgtccaacatggtgaaaccccatctctactaaaaatacaaaaagtagctgggcgtggtggcgaacgcctgtaatctcaactacctgggagcctgaggcaggagaatcacttgaacctggaaggcggctgttgcagtgagctgagatcgtgccactgcactacagcctgagtgacagagcaagactccgtctcaaaaaaaaaaagaaacttgaaaaactaattcaggccatgacaagaaacaaggggttggacaagcctcactataccttccccccgctcccctttggaacttaagagaccaggttcaaaaggcactctaagaatatgaaaataaagtattgccctttcccacaaaggaaaagattgttccctgtttaaccaggacacctagtcctattaaaaacttggggcaggggtggtggctcacgcctgtaatcccagcactttgggaggccaaggcgagtggattacgagatcaggagatggagaccttactggctaacatggtgaaacctcgtctctactaaaaatacaaaaaattagccgggcatggtggcaggcacctgtagtcccagctactcaggaggctgaggcaggagaatggtgtgaacccgggaggtggaggttgcagtgagccgagatcgtgccactgcactccagcctgggcgacagagcgagactccatctcaaaaaaaaaaaaaaaaaaaaaaaacttggaaagggccgggccagtggctcatacccataatcccagcactttgggaggccgaggtgggtggatcacgaggtcagggaatcaagaccatcctggccaacatggtgaaaccctgtgtctagtaaaatacaaaaaatttagctgggcatagtggcacatgcctgtagtcccagctactcagaaggctgaggcaggggaatcacttgaacccgggaggcggaggttgcagtgagccaagatagcaccactgcactccagcctaggcaacagagcaagacttcatctcaaaaaaaaaaaacttggaaagaaggattccttgaagatcaattataatataaccaatatggaagggcacccactccccattaggtattgttaagcactcccactgctgttaaacttcggggaatcactagctaggtacacctgtcccggattaaacaaacctgtttttggtgaatccctacaggcacaagaggaggacaccatgacctacacctgcaaacctctggaagacttaaagttgctatttcacaagacagataagtagcaaccacctcctcctgagaaacaccttacttgtccttattgagtatagggaccaccctaaagcccagtgtgatactcagttgtccctgttcttcttgctccctgctcctaatcaatctaactcgctgtggaatgggaacaaaactccatagtaaacatttctagaattatagcatcaggaaatagcctgcatgattgcagaatctgtcatcagcaccctcaggatagagagcatcaccttctggtgcaccctgcaaacctcacagccatctccccaaacctcctaattggccatagtgttcctttggtacctaggcccctacttataaaacagctctctcccacacttaacagattgacctgactcctctccaaccaccctcctaccccctactattacctggacctaggatgttgggtatctacagctccagtgtactaatgatactatcttttgcacaaattgttgtgacaatgacacagagacagaaattccccacgatgctctgacccaaccctagtagccaaattcccaaggccatgggagggcaaacgggatcccactggtaaacaaggagactatacatggtgcctcctccaggaccaatacatgcaagggagaaacgactgcttaatttgggaagatggaggtaccaccctctggtggaaaacgagggctactcaatcacccccattggaacctggaaaaggtatctctatagacccagtttggcaataaaaaatggacggcataacttgcaaggattcaatttgtgacccatctgggctcacctttaggggaagaaatcctaccccatacccactcccaaccctgtagggaaccatttattcttctaggaatagctttccattttgcttatcaaaaacttgaaacaccagtgaatgtattttggccaccattatcccttcagggggtatccattcataaccccataaaatctagaaaaacaagaagtaaaagagcaataggattaatttttacaggaattggggcagcaataggggtggtggccccttggcaggggctttgcataccacaagtcaatgctaagaaacataactcaggccctagaatctctggccaccaacactagtcagacattaagaaaaattcaggaatctctggactctttggcaattgtagccctgacaacagactagtcttggattgtttactgactgaaaaaggtagagtctgcactgttatcaataagaccgactgcacatatattaacaactctggacaggctgaggttaacattcaaaagttctaagagcaagccacctggttacatatatataaccagggaactgaccccaactatatctggttgaccataaaaaacaccctcctggccaggcagagtggctcacgcctgtaataccagtactttgggaggctaaagtgggaggatcacttgagctcaggagtcaagaccagcccgggcaacatagtgagactgtgtctctataaaaacatttaaaaatcagctgggtgttgctggcaaacacatgtggtcccagctactcaggaggctaaggcaggaggatcacttgagcctgggaggttaaagctgcagtgggccatgatcacaccactgcactccagcctgggtgacagagcgagatcctgtctcaaaaaacccaaaaaataacaacaacaaaaaaaaccctcccaagtctcacctggtttctactctttttaggacctctagcagctatcttgtaactatgaatctttggccctgcctcttttagcctccttgtagtgtgtgtcttctagattgcaacaatttccatgtgaagataatgctagcaagtggcttccaacacatccttgttctgaccccttagatgaggcatcaagagatttttactcctccagtgctaggcagggccaatgcccataaaatcaacaggaagcagtcacagaagatggacttccacccttctaaaaccctgtaagattgaaggggagtatataatctctgtggggggagtgaggtaggagagaagcaggatttgttttccaagcactggccagagagcctgctgaacaaaacaagaacaaaaccctgatcaaaacaggatgcagcaaagaaagcagccaaaaccagttacaaccaagatggcaacaaaagtgacattcggttgctctcactgcttattatacactaattataatgaatttgcatgctaaaagaaactccagtgggtcacagggagccaggcctggtggccagagtgtatcatgaggctggacctggtggtgcagaaggtggtagtccacccccaggtactgctcaatgtggtggatcatttcaacagaatcagcaaggttggaaaccagaaatgcattcttcatgtgcttttgcggtcatggcaaatgaaagtacttgatgtatccagcagttttacagtcccttttaatgaagatgacaaagataattgttttttagcccacgattatttgaaaaacacatacagaatgtttaagagggtgaatgccagggaaagaatagttgagtggtaccacataggccctaaactacacaagaatgacactgccttcaatgaaatcatgaaaagatactgccgtaactcagtattggtcactagtgacatgaagccaaaggacttagggctgcctacagaagcatatatttcagtagaagtctatgaagatggaacttcagccttgaaaacatttgagcatgtgaccagtgaaactgcagcagaggaagctaaggaaattggagttaaacacttgttacaagacatcaaagacactacagtgggcactctttcccagtgtatcacaaaccaggtcctggatttgaagggactgaactccaagcttctgggtaccagaagctacctggaaaaagttgccacaggcaaactgtccaccaaccaccaattcatctatcagctgcaggtcttcaagctgctgccagtcattagcctataggagtttgtcaaggccttttacctgaagaccaataaccaaatggtagcagtgtacttggcctcgctgatccattctgtgatcaccctacacaacctcatcaacaagattgccaactgggatgcagagaagaaagacaggaaaaagaaaccggccaggcgcggtggctcacgcctgtaatctcagcactttgggaggccgaggcgggcggatcacaaggtcaggagatcgagaccagcctgtctaacacagtgaaaccccgtctctactaaaaatacaaaaaaattagccgggtgtggtggcgggcacctgtattcctagctactcgggaggctgaggcaggagaatggcgtgaacccgggaggcggagcttgcagggagccgagatcgcgccactgcactccagcctgggtgacagagcaagactctgtcaccaaaaaaaaaaaaaaagataggaaaaagaagagagcaaaaaaggatacaaaagacgacaaagagaaagataaaggaaaaaagtgatataaagagaaaatgtaaaacatatagattttttaatttgtaaactaaaatcttataaactaaaccagcgtgctactggggggttcttttccactttaactgcttgttaaaaagctgtcctgggccaggcacggtagctcacgcctgtaatcccagtactttgggaggccgaggtgggtggatgacttgaggtcaggagttcgagacagcctggccaacatggtgaaaccccatctctactaaaaatacaaaaattagcttggcatggtggcacacggctgtagtcccagctactcaggaggctgaggcagaagaatcgcttcaaccgagcaggggccattgaggttgtgccattgcactacggcctgggaaacaagagtgaaactctgtctcaaaaacaaaaaaacaaaaaaaacacaggagttgaattttccccatcttgaaagactctttcagtctgtttctggtaatttacaaaattgctaaatggaatacacaaattccgcatgttctctgactccgtgagttgaacaccgtgagttcgaacccttctgaactcagaataccacaagttttggacccatagctctagcactctcaggcttgggatccaggctccataaattgtttaccttgaaagacacaattaaatggattggttttaaaaaataaaaacaggctgggcatggtggctcatgcctgtaatcccagcactttgggaggctgaggcgggcagatgatcacctgaggtcaggagttcaagaccagcctggccaacatggcaaaaacgcatctcaattaaaaatacaaaaaaagccaggtgcagtgactcaagcctgtaattccagcactttaagaggctgaggagggcagatcatgaggtcaggagtttgagaccagcctgaccaacatggtgaaaccccgtctctactaaaaatacaaaaattagccaggcatggtagcgggtacctataaccccagctactcaggaagctggggcaggagaatcgcttgaacccaggaggtggtggttgcagtgaactgagatggcgccactgcactccagcctgggcaacagagcgagactccatctcaaaacaacaaaaaacaaaaaaaattagctgagtgtggtggtgcatgcctgtagtcccaggtactcgaaaggctggggtaggagaatcccttgaacccaggaggcgggggttgcggtgagccaagatcgtgccactacactccagcctggggaacagagtgagactctgtctcaaaataaataaacaataaataaatatatacatacatacatacaaagaagaaaagtcccaccactgccatgacagtttacaaatgccatggcaacccctagaagttaccttatatggtttaaaatgggaggatctcttggttctgggaactccctgccccttttctagaaaattgatgaataacctgcccttatttagtatataatcaaggaatagctatctattcacaagggctgctgctattgctgtgtctatggggcagccatttcctgtactctgctgctctaataaacttgctttcctttttctctattggcttgcaaatgaatcttgcacaaagccaagaacccccctgggctgagccccaattttggggttcacctgcataactcatacccaaatctgaactcatattcaaactctcaaataccttccctatgaaggcatgcatcaccatcccctaccccagatatcttacatgtcagtctctgagcagtgttaatcatttctttgtaatgtgtctatggtgtacccattcttctctacccttactgccagcatcctattctaaatcttaaggtcttaaggggaaagcttcaaggctctccataatctggatctactctttctacctgaagccttagtactttcccacacaaacacagcatttctacatgtttgcagaatatgttattctacttccacttcttccctcacaatctatcaaatcctgtgaatccttcaagctccaattccaaaaagtatatatttatggttgttttcccaattaagattctaaacttcctgaggttagaactatgtcttctgcttcttttaaatgtcacacagatagagattatgttttaaaccaaaactcagaacaaaggatttctttgtcattttcagacaaaaaaaaatctgagagataaaagttaaacatcaaaatgtgttttgtaggttactgcaatggtttactaaaactacggaattgtaggtcgggcgcggtggctcacgcctgtaatcccagcactttgggaggccgaggcaggcggatcacctgaagtcaggagttcgagaccaggctggccaacctgatgagatcccatctctactaagatacaaaaaattagctaggcctggtgatgcacacctgtaatcccagctacttgggaggctgaggcaggagaatcgcttgaacccgggaagcagaggttgcagtgagccaaaatcatgccactgccctccagcctaaacaacagagactccatctcaaaaaaaaaaaaaaaaaaaaaaaaaaaaggggctgggcactgtggctcacgcctgtaatcccagcactttgggaggctgaggcgggtggtcatttgaggtcagaaattcaaaaccagcagggctgggcacggtggctcacacctgtaatcccagcacttgggaggccgaggcaggcagatcacgacgttaggagatcgagaccatcctgactaacatggtgaaaccctgcctctactaaaaatacaaaaaattagccaagcgtggtggcgggcgcctgtagtcccagctactcgggaggctgaggcaggagaatggcgtgaacccaggaggtgaagcttgcaatgagccgagattgtgccactgcactccaacctggctgacagagaaagactctgtctcaaaaaaaaaaaaaaaaaaaaggtagttcaaaaccagcctgaccaacatggtgaaaccccgtctctactaaaaatacaaaaattagccgggtgtggtggtgggtgcctgtaatcccagctactcgggaggctacggcaggagaattgcttgaacccatgaggcggaggttgcagtgagtcaagatcgcaccactgccctccagcctgggcaacagaacgagactccgtctcaaaaaaaaaaaaaaaaaaaaaagaaagaaaacttgattctgtcctatgctttgaatgtacatctctcccggcttcctgaattagtagttgaactgattcttatctccttactattttctttaaactatctcaaaggaaatgccttttttccagtaaaaacacctaaattccagtatcaccttaatttgtcctgatctagtatattctgctcttaaaaaaaaaaaaaaagaataaaagagaaaaaaaggaaaggcatggggagaataaagaaaaaccttcatttctcctttccttatgtctaaataatgagaactcaaaaagactgaggcttaagcacttgcctcattaagtggaaaactatcaaaataagaatttcaaagtaataaaaagtatttgtccacatcaactatgtgcaggacaatgtcctgccttgttttattttttatttatgtgatcaaaagtcaaatctatgtaattagcaaaatggcacaagctatttacccttttttattctaaaaaattgtgtagaagattagcagtgaaacaatatataatacacatacaaaaaaaaccgctattcctgtctacatttccagataaaacacaggtgtcccaaaagcaatacaacaatgcaagctactgtgaatgaggctgaaaatttagagccacatgctatgacaagggatgattccacaggagagcacttttccccaaaagagctttcatctttgacaatgtgcttcaggcagctcatgccagagagggcgtgaccaacacagtataccatcaagattattgctaaactccctcatcttgggcactccatcagttttcaaatacagcagagtcagaaacatgaaattcttcaatataaacacacacaagacacaataaaaaaccacatactgagaatgtaccagtaggacaaaataagaacaagtggacttaaaatgcggcaaaaaagaaaacatcttaacagtcaaaatgaatgaataggccgggtgcagtggttcacgcctgtaatcctagcactttgggaggccgaggtcggtggatcacgaggtcaggagttcgagaccagcgtggccagcatggtgaaaccctgtctcaactaaaatacaaaaaaaaaaaaaattagctgagcgtggcagcgtgtgcctgtagtcctagctacttgggaggctgaggcagaattgcttgaacctgggaggcggaggttgcagtgagatgagatcgtgccactgcactccagcctggcaacagagcgagactccacctcaaaaaaaaaaaaaaaaaaagggccgggcgcggtggcacacgcctgtaatcccagcactttgggaggacgaggcaggtggatcacgaggtcatgaaattgacactatcctggctaacacggtaaaaccccgtctctactaaaaatacaaaaaattagctgggcatggtggcagacacctgtagtcccagctactcgggaggctgaggcaggagaatggcatgaacccaggaggcagagcttgcagtgagccaagactgcgccactgcactccagcctgggcgacagagccagactacgtctcaaaaaaaaaaaatgactatcacctacctacaggaaaagctcaaatgccttagtatgaaaaacaaaaaccttcacaatctaggccgggcgcagtggctcacgcctgtaatcccagcactttgggaggctgaggcaggtgggttacctgaggtcaggagttcaggaccaagctggctaacctggtgaaaccccatctccactaaaaatacaaaaattagctgagcacggtggcgggcgcctgtaataccagctactcaggaggctgaggcaggagaatcacttgaacaggggaggtggaggttgcagtgagctgagatcacgccactgtactccagcctgggcgacaaagcgagactccgtatcaaaaaaaaaatgaataagagaagttggtatcttttctaaagcataaatgtgttctacttagacgtttaaatgactatcacctacctacaggaaaagctcaaatgccttggtatgaaaaacaaaacctttcacaaccttagtacaatctactactctaaagtcatcttggcagggcgtggtggctcacgcctgtaatcccagcactttgggaggccaaggtacgtggatcacctgaggtcaggagtttgagaccagcctggccaacatggggaaacctcctctctaataaaaataaaaaaattagctggacgtggtggcaggcacctgtaatcccagctactcgcgaggctgaagcaggggaatcacttgaacatgggaggtggaggttgcagtgagccaagatcacaccactgcactccagcctgggcaacagagcgagactgtcacaaaaaaaaaaaaaaaaaaaaaagaagtcatctcccaccacctgttccaagcaaccatgtcaccatccttttctgccagtctatctctgtgcactgttcttggcctatgtgcccataccactttctgttaaaccgcaattcatctttcaaattggaagggtcattcatctcagtagagcctttcccagtgtcccaggcagtagtctccccctttaagctgctgcccaatcacaaaagaccatacacatctccagacacaccaaataaaggatgagagaatggaatgaaagggatacaatggctgggtgcagtggctcacgcttgtaatccagcactttgggaggccaaggcgggcggatcacgaggtcaggagactgagaccatcctggctaacacagtgaaaccccgcctctactaaaaatacaaaaaaaattggccgggcatggtggtgggtgcctgtagtcccagctactcgggaggctgaggcaggagaatggcgtgaacctgggaggcggagcttgcagtgagccgagaccacgccactgcaccctggcctgggtgacagagcgagactccgtctcaaaaaagaaagaagaaaggggtacagaagtggatatagcgaatgggaggggaaaagaaagtctatatccattcataaagttcactgctggccaggcacggtggctcacacctgtaatcccagcactttgggaggccaaggcaaacgtatcacctgaggtcaggagttcgagaccagcttgaccaacatggtgaaaccccgtctctggtaaaaatacaaaattagcctggcgtggtggcgcatgcctgtaatcctagatacttgagagactgaggcaggagaatcgcttgaacccaggaggtggaggctgcagtgagtcaagatcccaccattgcactctagtctggtgacatggcaagactccgtctcaagaaaaaaaaaaagttcactgttgacccttagcaacacagcagttccaattccgtaccaaatcaatatcccctttcagaaatactactctgtaaaggtatccagaaatagcaatggcaaagtggtattgacaagaatgtaacctagagaccttgtataccttacctccttcttccttgacttcttcactaggctctcctgaaaaaggctcctttagggtaagatgatcacatctgtcttcttgggtaactggcccaggcctgagtgtcatttttttccctctctttgagccagtagcgtggagttttcctttaccaatgtgtatattaagggggtgaaaagactccaaggaaggtagggtgattccctgagagatggccacatcaacaccttctagaattggtacatttgtgttctgggtgagcattccagagctcagagatgtatcctccataccaagctgatttcctgcatcctgcaaagactgtacttcgaagccagctactctgccatgacttggatcccaggatagtgacaccgaactcaagtccttaacctggtcagattctggtttaacggctgattctaggtctacgttgttttcctcttgattgcctttatgctgtagggactctgtcactgtagttcttctcttcttacagggcaacattttaaaagtcccacttttgttccattctgaaagaataaaaagttcttactgccttcatattaattaaaagtaataacatttactcaattatcttttcatttattcatgttcgatcatgaacacaatacttcacaccaaatgcacaatttccctttaggtggaagttgagagacagtggttaagtgactgagttcaaatctcaactctactgattactactgatggactactgttacctaggccaagtgatttaacctcgcaagtcttcagtaccctcaacagtaaaaaataattgctcttacttcatagaattgttacaattaaagagtaagtgattaataaacactgtgggtttatttttgtgtttttttgtttttgtttttgtttttgagacagagtctcactctgtctcccaggctggagtacagtggcgcaatctcggttcactgcaacctccgcctctcgcgttttacgccattctcctgcctcagcctcctgaatagctgggactacaggcgtgcaccacctacgcctggctaattttttttgtatttttagtagagatggggtttcaccgtgttagccaggatggtctcgaactcctgaccttgagatccacccgcctcggcctcccaaagtgctgggattacaggcgtgagccaccgcgtccagcaaacattgttattattaccatcagggtggtagactagcatgatgctgagagtaaactgtggaatcagactgtctggatgtttcccaagtcaccttctctccagctttatgaccttgtggaagttactcaacctgaatctcagtgtcttcagctataaaatggaatataatagcatctacttcattagatggtaaatgatcaatacatgtttgctattgctgttttcataaacaggtatttccattaatagaaacaaatcaaaagcaaagtgtgattgtttaaaaggttaggctatgttggctgggcacgagatggctcacgtccgtaatcccaacactttgggaggccaaggtgggcagattacctgaggtcaggagttcgagaccagcctgatcaacatggagaaaccctgtctctactaaaaatacaaaattagccgggcgtggtggcacacgcctgtgatcccagctactccagaggctgaggcaggacaatcacttgaacccggagacagaggttgcagtgagccgagatcactccccattgcactccagcctgggcaacaagagcgaaactccatctcaaaaaaaaaaaaaaaggttaggctacattaacaacaaactttgtgtcgaaacaaggaagataagagtcctactatcctctgcgctatgttacttcttggctttttgcttcaattctagttatcacattttaagggcattactgacctaaaccagagggtatcctctatgttcttttagtatctgtttgtaaacctcttttacggtacttatcagttttgtaatggtctctcatctttctctttctcatctccttcctccaaaactatcagcttttcgagaaatgggattatttcaactcatatccctaatatccagcagtatctgggtttttttttttgaaacaaggtcttgctctgtcacccaggctgcactgcagtggcacgaacatagttcgctgcagcctcgacctcctgggctcaagcaatgctcccacctcagcctcccaagtcattgggattacggtcccatccaagccactgcaccagttcagtatttgggtattgtagatactcaatgtatcactgagtattgatactcaatgtgtcactgaatattgtagatactcaatgaatgctccctgaataataaatgaaacagaggttaaacaacttattctgtgcagcatttgggccaaatgttaagcattatataaaaactgatagtggcttggtgcagtggctcacgcctgtaatcccaacactctgggaggccaaggcgggcggataacaaggtcaggagttcgagaccagcctggtcaatatggtgaaacgctgtctctactaaaaaatacaaaaattagccgggcatggtggtgggcacctgtagtcccagcttcttgggaggctgaggcaggagaatcgcttgaacccgggaggtggaggttgcagtgggccaagatcatgccactgcactccaccctgggcaacagagggagactctgtcaaaaaaaaaaaaaaaaaaaaaaaaaaaaggcatcttattacccaggaaaactttactgtcataaatagatccaataatagaataagccgccttgtgttagatcactggcaatgttcaagcgaagcctgaatgtccacttatcagagtactagatgaaagcctgaactagagaactgaaaaataaaagttatttgtaactctaagcgtctaaggttagatttctctttcttcttttctttctttctctctctctctctttctttccagagacaaggtctcgctctgttgcccagaccggagtgcagtggcaagatcctagttcactgcagcctcagactcctgggctccagtgaccctctggcctcggcctcccgagtagctaggactacaaggcacttgccaccaccctcaacgactttttttctttttttttttttgtagagacggggtctcgatttgttacccaggctggtctcaaactcctggcctcaagcgatcctcccgccccagcctcccaaagtgctaggattagaggcgtgagccaccgcgcccgacctacagttagttttaaacctcccttctgtttctccaagacattaggggagattctccatcccctcaatcaactgatgtaattaaaactcagtaactaaagctcaataaaacatgaagatttcgttgattcctgtgagagatggtggtgaccttataagaaatagaatgggagtagccagggcagctcttttatttcacagataattactgagatcaaaaaaaggggaaaaaaagaaaaagaaagaaagaaaaagaaggaaagaaagacagctacttcagctccaggcacctcaaacacagcagtagctcgacagaatccacttttttgggaacccaagtcggaccagcagggtgaatgaatgccaatgtggaggcagccccggcacggccctctcctaggaaaacattttcaaaaggggtcctaaccgcgcttccacctcggtgcccagggctggctccagtccccattcccaactagacactggacttcacgcccttaacttccgccacgcacccagcgcccaccctcagacccgaccttctcaacctggacatcgttcgtccaggtgtcccagctcccacctgcctcttcccaccccaccacacacaaacctgtaccctcaccagccggcctgattccacggaaa

SEQ ID NO: 928 - DNA, 54505 bp, Homo sapiens
  misc_feature (33928)..(34927): n is a, c, g, or t
acttaattgctgcctagagctcatagaaggatctcacagcactgctccagggcactgaagcttacagtgaaagcacattttcagcaagtactgaagattgtctccacgttggctggtttgaaactgtggtgagtgaattcagaaaataaatagtgttgattctttagagctttgaggctttgaagaaaataataacccttagtaattaacatgcctgtttgtttttagatcttttgaatgtaatccaggaaaggaatggaaaggaaagaagtgctcagaaagctcccagaagcattttggcactcaccaaagcagccggaagatgaataacacagtggggatagatggctaagtgggtcctatttatgtgttattcatcgacactagaaaacgtgctttaattcaaagcattgttttctcttcaagtgtctccagtcagcatcacgtagctttactaaatgcttttggtaatgctagagttatttcagcgtaccaagtgtctttgagtagtcccttaaggaaataaagctaagaaaagaagagggcagacagagggcattcgaccacaaagagtgagaatttcattggcttgtagaagaatccttcttggaaatggaatagtttatagcagagattcccaggcacacatgttcttaagaacaaaggggcctttggaatgctgtatcagtgaggatgcttttagttgcaagtaactgcagatccaactccagactggttaagccaagaggagatttattatcttgcgtaacaaatgcttaagtagccgtgcttcacccaaggcacactgggcttctggttccacttctctgtggcttctggatttgtcctcttctctttgtgggcttcatcctgcagcagctctgagcatcacatccactcacaacagagtcttgtggtctgtttggccccgccttgcctggacatgtgtatgttcattagggagtactgattcttctcaatgaggaggtgctggaaccagctgccagtgaggacagcagaggttgaaaagactgagaggtactagaaaagtaagaaaggaatgtataattgtgaataggttaaccccagctcttgaggaggacgtgcctaccttcagtcacctttttccgacatctgggataaaacaaaccagcaaatcaagtgagagcaataccgcactccacagtttactgctggcataaccccttaaaagaagaaacaaaatcttaagtgatcgtaaatgaaagaggtactctaagcagagacacatgttttccaagttaaggcaagagcaatagcattattgccttatatttgtttttgtttggttggttggttttattttttccttgacacaagttctcgctctgttgcccaggctggagtgcagtggaaccatctcgggtcactgcagccttgacttcctgggctcaagcaatcctcctgcctcagcctcccgaatagctgggatcacagtggggtcttgccatgttgcccaggctgatcttgaactcctggcctcaagcaatcctccagactctccaagtgctgggattataggtgtgggccactgtgcccagcctttttatttttattttttaagatacggggtttcattctgttgcccagactggagtggagtagcacaattacagctcacagcagtctccaactcttggcctcatgggatcctcccacttcagcctcctcagtagccagtattacaggcgcatgccatcatgccctacctttatatttgttaatataagcattatgacagcaggattttttttttcttattcactactggatctgcagtgattagaccaatgaataacacactgtatattctcaataaatatctgtcaaatgaatgagtcatggtgtgggcagtttaatagtttaaaaagacccagaaagagacagagagggatctgggttacagtgccaactatatcatttactagctgtagaatcttttttgttgttgtttgtttgtttgtttgttttgagacagggtctcactcttgtcgcccaggctggagtgcagtggtgtgatctcagctcattgcaacctcgacctcccagactcaggtgattcttccacctcagcctcccaggtagctgggactacaggcatgcaccaccacgcttggctaattttctgtattattattatttttttagagatggggttttgccacattgcccaggctgatcttggactccttggctaaagtgatcaacctgcctcagcctcccaaattgttgcgatttacaggcatgagccaccaagcccagcctgtagaatcctttctgtgcctcaatttcctcttctgtaaaatggggataatagaaacctgcttcatcgggttgttgtgagaattaaatgaatcaatacatgtaaagtgcttagaacagtgccaagcccatagtaagccctcaggaattgttgactgttcattatcactgctaccacttactaagtttttgacttctataagcctgagtttcctcacttgtaaaatgggaataataaaaggtacctcattttgaggatgaaatgagacattgtttattctttcctcacaacatcaggcacgcgattaggaacaacttggccaaaggtcactataattccttatctatctcagtgctttttatttacaaacttatttttattcccataatatattgattcccacaaaaacttaatgagagaacaggtcaactatatgccccttttacaggtggagaaactaacacatggagcagctaaaagcctgttaagactcactttatagacagatagtagagccagaagtcaacacagcagccacccgatgcttctcattgcagatcttccacattctaacacaatttttaagcagagacttcatagctggagagtgactttattgagcaaacgtacaatattggctcagaaatggaggacttataaaaactgtttctaggtgggatagtgtctggaatttgtgggttcttggtctcactgacttcaagaataaagctgcggaccctcgtggtgagtgttacagttcttaaagatagtgtatccggagtatgttccttctgatgttcagacgtgttcggagtttcttccttctggtgggttcgtggtctcactggcttcaggagtgaagctgcagacctttgcggtgagtgttacagctcctaaggcggcgcgtctggagttgctcgttcctcctgtccggagttgttcgttcctcccggtgggttcgtggtctcggtggcctcaagagtgaagctgcagaccttcacggtgagtgtcacatctcataaagacagtgtggacccaaagagtgagcagcagcaagatttattgcaaagagcgaaagaacaaagcttccacgttgtggaaggggacccaagcaggttgccactgctagctcgggcagcctgcttttattcccttatctgaccccacccacatcctgctgattggcccattttacagagagccgattagtccgttttgacagggtgctgattggtgtgtttacaatccctgaggtagacacagagtgctgatgggtgtatttacaatcctctagctagaggtaaaagttctctaagtccccactagattagctagacacagagcactgattggtgcatttacaaaccttgagatagacacagggtgctgattggtgcgtttacaaaccttgagctagacacagagtgctgattggtgcctttacaatcctttagctagacataaaagttctccaagtccccaccccacccaggagcccagctggcttcccctagtggatgctgcgccggggcaatgggtggagctgcctgccagtcccacacagtgcacccgcactcctcagtccttgggcggttgatgggaccaggcgcggtggagcacggggcggcgcctgtcggggaggctcgggccatgcaggaacccactgcaggggggcttgggcatggcgggctgcaggtcccgagccctgccccgcaggaaggcgtctgaggcccagcaagaatttgagcgtggcgcgggccggccagcagtgctgggggacctggcgcaccctccgcagctgctggcccgggtgctaagctcctcactgcctggggccagcggcaccggccggctgcttcaagtgcgggcccactgagcccgcgcccatccagaactcgcactggccagtgagtgctgcacgcagccctggttcccgcctgtgcctctccctctacccctctctgcaagcagagggagccggctccagcctcggccagcccagagagggtctcccacagtgcagcagcaggctgaagggctcctcaagcatggccagagtggatgccgaggccgaggaggtgctgagagtgagtgaggcctgctagcacgttgtcacctctcaggatgatgtaggggaaggagggaggaagtgaccaggacaggaaataacatttcacaagaagtgctcttaagggaggaaggttagaatgatccatgtggtattggattagagttagagacatcagaatgaactcacgaatttagcttaatatagctacagatggttacaaatagatatttgcagatatgtatcgattcatggattagtatgtatagatacatacattttattgctctgtcagctaaaagggcctagaaaccacaacaccccaatagtaatgagcacccctagcacccagatcttggtttctaataccattctctagtaaaagaaaccaggaatcactggagaaatggctgattctagggctgcactaataacatacaaaaggaaactatagtgccagaaagtaaggaagtgctggggtaaaaagataggggtatgtcaaagggatgcaagagccaactgaaaaggttaccaatggccaaagcttgaacaacttgagcaataaagtaaataatgtagtattggctgataacccaaagtataaaataaatgttaatccacctaacagaaatacatgattgtatgaataaataaatgggggagaagagataaatctcccttgcagaagaattccaaataatttatgtagatactcccccatcaaggaggtggaagatattcttaccccttaagtgggggctgcatataatgacttctttccaaagagtccaggatggaaagaagggagaaaagagtaactttacagtggagaagtctgataaaccctacctcaatcagaagatcaagttaatatcaatagtgataagtcaacttgatagttaggtacccttcaggtgatgccatgagaatggtactttatctcagtggtcttccttccaaaaacccataacccctatctagccatgagaaaaatgccagacaaactcaaagtgaagaatattctataaaatgcctgacacctgaccagtatttctcaaaactattaaggtcatcaaaaataaggaaattctgagaaactgtcacagccaggaggagcttaagtagacatgacaactaaatgtaacattgtatcctggatgaaatcctggggcagaagagagatgtttggttaaaactaaagaaatttgaattaactaaggactgtaattaagaagacatcaatattttttagttttgataaatatgccatatgaatgtgagatgttaataagagaaaccaagaatggaatattcaggaactttctgtactatattttcttttctgtaaatctaaaactattctaaaatttaaagtttgtcaaaaattaattgggctgctagggcagcaacaacaacaataaaaaagacatggaaaacaaaaagcaaatgagaaaatagaaaacaaacagcaaaatgatgaatgtatgctcaaccatataaatatgttcattgtaagtggtctaaacactgcaattaaaagccagatattgtcagagaattttaaaaatacaatatccaggctggatgtggtggctcatgcctgtaatcccagcactttgggaggccaaggcgggcagatcacttgaggtcaggagtttgagaccagcctggccaacatggtaaaaccccgtctctactaaaaatacaaaaattagctgggtgtggtaggacatgtgcctgtaatcttagctaccccaggaggctgaagaaggagaatctcttgaacctgggaggtggaggctgcagtgagccaagatctcaccattgcactctagcctgggtgacagagcaagactccatctcaaaaaaaaaaaaaaaaaaaacaaacaaaaaaaacaatattcagtgtatgctgtctatacaagaaaccactttaaatataaagatacagatagattaaaataaaagatggagatacatataccaatcaagcaataatcaagagaaagctggagtagatacaaagtagagttcataacaaggaatatgatcatagataaagaggacatttcataataaaggcgttatttcattaagaagacaacagttctaatgtgtatgtacttaataatggagctttgaaatatacacaacaaaaactgatagaactgaaaggagaatagagtaagagttttcgttggagatttcaatactcttctctcagtaatgatagaacaagtagaaaagagaaaataagaatacaaagtaagtgaagataaagacttgaacaaattcccacccagaacatcagaataaattgcacgtcttttacatagcacattgatggctgtcactttttaatccagtctaaaaatctatactttctaatttcagtgtttaatctcttacatttgattgatgtaatttctggtggtgtgagtttatgaatcatgttgctttgttttccatgtgttctttctttctttgttccttcttgactgccttctcttagattattttcacattctttttatcttctttattgcttcttacctatgtctctttgggtttttttttttaaataatgatggctctagtgatttcaatatgcaaccttaatttatcattgtctacactgaataaatattatagtacttcatggacagaataatgacttaaaacactataattccatttacagcctttatccctttgtgctattttgttatgtgtttcacttctacgtatgttacaaaccccacaacacttgctattatttttatctaaacactcaaacatcttttcaaaattaaaaaaataaaaactagtcttttatatttacccacatatttaccttttttagtgcttttcattccttcctgtagattccttctgaaatctggcttccatctgggataacttccctttagctgaaaaaaactctagagattttagtgatataaacatataaacaaaatggcccatttcttgtagtttgggtctgttggtaacacattctctgagctttttttttttttttccattaaaagtgtctttatttccccctcattctgaagtttattttcacaggatgtagaattctaggttgataattgttatgtatttttaaaacacttggccaggcacggtggctcacgcttgtaatcctagcactttgggaagcccaggcggatggattgcctgagctcaggagattgagaccagcctgagcaacatggtgaaactcgtctctactaaaatacaaaaaaaaaaaaaaaaattagccggcatggcagtgtgtgcctgtagtcccagctactcaggaggctgaggtgggagaattgcttgaacccaggaggcagaagttgcagtggctgagattgtgccactgtactccagcctggtgacagagtgagactccgtctcaaaaaataaaaacaaacaaacaaaaaaaccatttcaatgatatggttttactctattctgaattctattatttctgataaaaagtcagttgtcatccatgtctctcctcccacattccaaaccccctctttctcccaaatataaagtgtatttttttctttgacttttttttttttttttttttggagacagggccacagttctgtcccaggttagaatgcagtgagttttgtttttgccacaactcactgcagcctcgacctcccaggctcaagtaatcctcttgcctcagcctcctgagtagctaagaccacacaccaccatgcctggctaattttttattttttgtagagacgaggtatcattatattgcccaggatggtctcaaactcctggacacaagcaatctgctcaacttaccctcccaaaatgctaggattatatacctttcaacatttattttatccaattttctttgtccttgctttctgagactccaattctatgtatattagactatttgatattgtccccccaaattaatatttttatttttaatctttttcttctctgtgcttctgttaagataatttctattcacttgtctttaaattttccaatgctttatccccctgtgtccagtattcttaggaatttagttcacatatcctccttttcattgttcactggctttaaaaagtagacagacagacagatatttttcccttggcttgagtaacagtcttttacaactgtctacattttaattggaaatagaaccttgagtgggtcttaagcagtcttatatcatacaaagaacatgctaaaaatgtagtatttctgggaaatactatcagacatcagacaatatctaggatattaaaaaaaaattccttaggtggttctaatgcaggagtccccacacacccttaaagaaacactaatttgttgttagaagctgaagtcaaaataaaagttagcagtcaaatgcaaatgagtttcaattgaggcctcaggaagaccatcaacaaagctatcagattgctttactaaattcaactttcgaaaactcatagccattatgaaaaccagtgtggaggttcctcaaaaaattaaaaatgtaactaccatatgatccagattagtaccttcacctatgagcagacttctgggtatatgtccagaggaactgaaatcagcatcttacagagatatctaacccatcatgttcatggccgcattattcacaatagccaagatatggaatcatcccaagtgtccactgatggatgagtaaataaagaaaatgtagtataggcacacagtggaatactattcagcctttgaaaagaaggaagtcctgtcatctgtgactacacggattaacctggaagatattatgctaagtaaaataagccaggcacagaaagataaatactgcacgatctcatttatatgtggaatctacaaaagtcaaactcatagaggcagagagtagaatggtggttgctaggggctggggagtggtggggtggtagagtgggggtggggagatgttggtcaaagggtacaaagtttcaattagacagaataaataagttttggagatttattgtataccatggtgactatagttaatgataatgttttgtatacttgaaaattgctaagagaatagatcttaaatgttccaaccacaaaaaaaggataagtatgtgaggtgacagatatgttattagcttgatataatcatttcacaatgtatatgtaagaacatcaggttgcacaccataaacatatacaatatttatttgtcaattataccttaataaagctggtggagggacaacttaatttaaataaactggtaaatatggaaacagacatggcctgtaatttccaaaagccatgtagttactccatttcatttgttcttgattttatgctgggctgtagctcctcagtgaaccaactaaagtcataattagacagttttaggagacaagaacgtcttcagtgatgtgtataggcaggcttgcataactctttgaaagatctccaaagaggaatatgaatgattgagaacacatagatctgctatttaccaattaatcctaaggttccatggcctggaacaattaccaagagctaaagacattaacttggatattgtgtggctatcaagaaaggactctaatttttgaacaaatataccagaaattatgcactcaaatgagtgcagttctcttcaacaggcaaaaagaaattgagtatcaaccctgcttcattggtttcactccctagagagttgcattggggattttaaggtagaatatagctcagcgggaaagagtcatctatgagcatggtctgccatgaacatggctagggtccatggcaacagaagtggtacataattgcccttcctgggttaatggtaagagcctcgggtttgaagccttgagcataaatttggctctgccatctactaactgtgagatcttgtgaaaacacattctctgagtctcaatttattttatttaatggtaattggtcacaaaaaatttccactttctatttcataggtatacatgtgatatcccctttgaaacttaacagtgcactaatagcaagttgttcttcaaggaagtcactttggtaggctatgatcttatttacaacaattctgtcattgcacattctttgggagtgcatttataaacagtttgagcaatttgggagaagcacttttacatgtccctgtgatggctaattttatgtgtcaatttggctatggtaagggatacccagaaaatgaaaaaaaaattatttctgggtgtatctggaagggtattttcagaagatattagcatttgaattagtagactgagtaaagaagattacctctcatcagtgtgggcaggtatcagcaaatccatcaagggcccaaatagaataaaaaggcagaggggggcgaattctctctctttttcttgagctagatgtccatcttctcctgcccttggacattagagctcctggctcttgtgcctttggattctaggacttataccggagccctcttgcctccaactgggagatacaccattggctcccgtagttctcaggcctttggatttggactgaaccatgggaattggctcacaaagttatggaggccaggaagtcccatgatatgccatttgcaaactggagaaccagcatcatgggacttcttggcttccataattgtgtgaaccaattcccatagtacatctcctcttatgtatccataattattctatttgttctgtttctccagggaatcctgactaatacacggtgttttgataattcagctagatcacctacaaatcgatcaggaactttggattcaaatgatatcattgttgccaaaaatcgaattcactattagtggatgaagatttgttaccactgggttattaaaaagcgtaggccacaggcttttgaagattcttcccaaagaggaattccaaaaatgatttatgcaattgcagcctcattagtgtaagagtatggtctcccaagggagctatgttgaaggctgaaactcacttgaatatgtaatcttctgttagcttgtttaattaatcggtcattttgcgttagaatctcatggatgtatagcagagttaccatgctttgaatgagaatgatggtcacacactgatcctgcagtaatctctaagaatataaacaaggtagcccagatgaactctcaccctctgatagagagggaattggagctttctggcgcttactgataacataacaagaatatcttcagtgatgtgtataggcaggcctgtataactctttggaagacctccaaagaggaatatgaatgataagtctccaagcaaacaactatttgtaaccccagaattataaaatatagatgtaatacggttgtgaaaatcctttctgtttgggccaggcacagtggcttatgcctgtgaatcactttgggaggccaaggtgggaggattgtttgagcccaggagttcaagaccagcctgggcaacatagtgagatcctgtctttacaaaaaaattaaaaattagccagttgtggtagcacatgcctgtggtcccagctgtttggaaggctgagatggaggactgcttgagcccaggaggttgaaactgcagtgagccatatctacaccacagtactccagccacttcagctttgaggacagagcgagaccctgtctcaagaaataaaaaaaaaataggaatgaaaaaagaaaatcctgtttgttcaaaagtaactactatggttaggcaaaggcaggaaatgttagaagaaatgcagcgagaagtccttggaaggagtatattttagcattggagtctgggctacgtgaaggagatgttgacacagatccaatcctaaactgttagggagggtgcagtatctctctgagactgtgtcatgagggatctctgcccttttcctgagctttagagggtcatactctagactttttctctctatgagaagaggagtccacgggctaaagggttgtgccccccttaagcccactgtggtagaaggaattctaagatggcacccaagattcacgcactctctatcttccccctctttgagtgtgagtgtgacctatgaatcacactccatgattaggtgacattatatggcaaaagtggagggatttgcagatataattatcgtttctcatcagttaactataagtcaacaaaaaaagattgtcctggatggaccttacttagtaaggtgaaatcctttaaaagagggctgaacccttcatgaaaagagagaatctgctggtcttgaagaatcaagttgccattagttctatagccacaaggaaatgaattctgccaatgaccatttgagcttgaaagaggactctgaacctcagatgaaactgcagccctggttgacaccttgactgcagtccagtgagaccctgagcagaggaaccagttaagccacactcagactcttgacccaaggaaatcatgagataatggacatgtgttgttgtaaggcattaagttggtggtgacttgagatgcagcatggaacaggaattcacccatgcctcatcttctagtctaatggcacgcaaagtttgatctgtttactgctggtccaggatgagctaagtatagaaagtgagagtaagtggtactttttatggcaatttaacactgctgaaatatttaaattatattttacaaaaatgtggatccacagtagagtgaactttttaaaaaaagcatttttcaccagataagtactgttctagttcatgatctgccttcttagaattctgaattctctgcccacctgaccctgaaagaggaatgaattagctcttcaagggcctgctcagtcctctttctttggtctgcctgtataagggcagacagtgctgctgctgaactaacccctagccctgacagttggccaagaaacagctctttatgggggttgaagatggagcttcagatgtgtgggttggcaggttcacacatgactataagcacctggaagtgctggatagaaagatgggaagagaagagaggaataaccaggggccagaagctatgaatggctgttcatatgtaacctcaaaattccctgctaaaacatgggaaatcccaaatttttaagttcaaatacagctttcgggtcattgtgaaggtctattggccaaagtagaaggaaagaacatattttatttaatattatgctagcttggcttatgtttttaaacattctagacatatgctatgccggccttcatttgttctcctgtactggccttgtaaatatgttaagagtgggcctggagagtggtctcttctggaacacttccatctacttctcccagagattgcaaacctagaatctggagctgctgaagtggaagggttttgttcttttttgttgttgtttttagtgatgcctcatcataattaacacaaaaaggttttctgcactaatgatgcttagatttttttaacccatttttctctaactgcatgatggtaggtgctatggtttgaatgcctcccaaaatctgcatgttggaaacttaatactcaggcagcattgttgggagttggggcctaatgagaggtgattaggccataagggggaagtaaatggattaaaacccatttatgcctagtgttccattattggaacactaagcatgtaggagttatttatatctactgctcaaggtctgattggcaaaaattcaaaaaattgcaacctcaggcagaaatggtttaatactgttatcatggaaatgggtttgttataaaagggtgtgtctggcccccttttatctctctctcttttgcccttccaccttgggatggcacagcaagaagcccctctccggatgccggcccctcttggacttcccagcttccagaattgtgagccagtcaatttctgttcattataaattacccagtctcaggtattctgttatagcagcacaaaacagactaagacagtgggttatcctaaatccatactatgccagcgagaaccaaggggtgtagcatgtttcctgagcagtgtttcagatccccagcagaaggtaaatgctgtaaattactgtgcatttgccacagtgtagtagactgaatagtggccaccaaagatatccaggtcctaatccctaacacctgtgaatactaatgtaatgtgtcaaaacaggctttgtagatgtgattaagtcaaggaattttcgatggagagagtatcctagattaacttggtgggacctaaatgcaatcacaaatgaccttataagagagaggcagagggagacttgacaccatataaagaaatgggacattaaggcaagaggctgaggtattggctttgaagatggaggaaggggccacaagccaaggaatgcaaagagtacatctctagaagctcaaaagataagaaaaaggattctccccaaaagcctccagaaggagtgcaaccctaccgatgccatgatcttgggctaatgtaactgattttacattctgacccccagaactattggagaataaaagtgtgttatttgaagccactaagtttgtggtaatttgtcacagcaggtaaagtaaactaatatacacagcaaacaatgagaatatttttaaaatctgaattaaaagtctgggattttggtgtgtgtgcaaccactaccagttttctagatactcttctagagacaaggtattgtgaaacagacaatataagtgagaatggaagagagtaacacagacccaaagggcatgcttcaaaagccacaggggaggccagatcccagctgacacaccactttagaataagagtgtttcctcaaaataactgaaggaacaccgagaagggctatagatgtgttcagctttattcccacagttgacatttataatgtatcagtccctccctgttaatagcttgactgacagacaatcaaaggatgtgtgggactcataaatagtccgaagcacacccaagagggagcatttgtaatgcagccttcagagactaggtagaaaggaaaggaagggagcaaaggaaaactcagggaggaatttaagggacaagtgttcctgaccaaaatgtcagagcctggactaagctcttgatcacaaagaaatggtgagaagccccgtagctgaaattactgtgagagcccgttggagtcagaggaagtatttgtggtgggattacagggaaacttttctacttcttgtctccacataagccccaggttagtcccaaaggactgtggatgctgttgaggcttagtgaacacccagtaatgggagaagaagagactcgctttcagtaccatattcccttgggtacagagaaaaagctcaggccgttttgaaaacagctgctgcacttttcccaaatgacctttctttgttcccttcagctccaagcccttggactcattctccatttttctctttatgcaggtgtatgtttaagctcaggctggaaaaggatcactgaaagtcacttggatggtgtctcgtgtgtctgtgatgagcttgctgttgctttctttctccttgacaggtgggtttatttcttatggaatcagaccttttggctacagtgttctctaaacagctgtaataccatctcactcagttaacctaactttggatctgatgtacatcagaataaaacctatagagaatagagctgacttccccaaatccatgtgcctccactaacccccaaggagcttagtgtggctggttgtgaatgacagtgatctccgtgatgagaagtaatccctcctctagaaatactttacctgttttctttggtgcttaacaccctctgcatgagacattgctctatgggctttcatctcccctgtgacaaaggacacatctttctcatttccacattccctcctcttgcttctcccccatgccacctcccctttgtccctctaccaacacataggtacctgcgtcagttaggcacctactctacagcccatggaacaaataaagctttcaaacattagttatttaatcaatgggtcaaaaaaaaacagtatctgaatatgcgcagcatctaacctttttgatgggcttttgaatctagtgcctcattttgtctcttcaacatccctctgaactcagtataacaagtagtaatagccccattgaacatataaaaaaacctgacatctgggaaagttttaacttaggaaaaggtcacattgcagattattggcagagttcacattagaatctgtttcttactctgttgtcctcaccactatactatggtgctttcgttcattgagttgacctatggtaaagttataagccttgctgtttttgcaagtggggagactgggacttgggcatctgaattttgacctggaggttaatggtgtcaataggaatgtaactgcatgcagtctcttagatggatggatggtaagaaaacctttactttctatataactccagaagacaattctgtcattttaaactacaaatatcaactatggtttttttgggaggaatatttattatttaattttaaaaaattatttttgatacaaagtcttgtgctgttgcccaggctggagtgcagtggcgccatcttgacttatgtagtctcttcctcccaggctcaagcaatcctcctgcctcagcctcctgagtagctgggactacaggtgtgcaccaccacaccggactaatttttatattttctgtagaggcgggtttcaccatgttgcccaggctggtctcaaactcttgggctcaagcaatcctcccgcctctgcctccaagtgttgggattgcaggtgtgagccactgcacccagccaattttttttttaagtttcttgtgggtaccctgtaggtgtatatatttgtggagtacatgagatgttttgatacaggtctgcagtgtgtaataatcacatcatggagactggggtatcccttctctcaatcacctcccttttgttttactatttatttatttttaaatgaactcttatttatgtgagatgactttgttaagggtgaggacagggacagatacttgcttccttttctgccatgtcactgccagtccatattagagcccactctggaggctaatgaatttttcttctctctgtgtcccgtcagccccagtcccctctgcccattggacccactcttcccaggaccccgggttcacagctaatgcctttcagtcagaggcaggagtagattatttagtttcttcccagagaaactccccacagcccaaaccacatttatcctgcaaatattaaccacttttcatagcagtgcatccatgagttattatgctaacagctgcctctgcttcattgtgcaaaagatattttcccagcaaagggtggggacgcagggcagaggagggtgagaagggaggaaaatcccaccctgtcacgctcgtttaaagttatcatgtgccgcccgccccccattcattcaacacacatttaccttctggcagcaactgcgttatgagatataaatatgaatagaatgcaatgctctacctaagggaattcatggctaagaaaaagaaatagacacaaataggtttgttgtaaagcgaagtggaattagagcaggtccagcaaagaaaggcagcagggacaagggacaggcattccaggcagcaggacagggtgagccgaggcatggaggtgggaaacagctcactgtgtgtgtcgtatctctccaggcaaagctccctgaaagaggaaagagccagggaagtgacaagcagagcccagaggggcttgcaagccatgttaaggagcttaggggtggggtgggaactgaagggtttcaagcaggggaacaatggcagatgcgcagttgcgtggatggtagatgggaggatggatcagattagggcaaaactgaaagcagggaccagtcacaagaggaacttcattccagggagagatgttgagggtctgaactgaggcagtgcagtgggaagagaaggatgaattagaaaacagttgcagagggacttgggaggtcatgggagctagatggggatgagggctgagggagaagtagcagtctggaggggtctttgagtaaggctggaacccctctctagaactctctgcccagtgcccagagaacctcacaggagataagaagatggacacacagagttgatggctgctcaagacattgtcccctcccctacaatcccccgttcaaagctggtgaggagtatggccaagcagtctgaccccaggactgtggtcctcagcagggcgagggtggggaggatttcgaaagtgggagaccagagtgaagcaagaggctgtcagcggaaggactggaagggccaggcccacgtggtcacgtgtttgcagctttagctaattcatcctcccaacgtctctatgagggtgacacagttattgccccattttacaggggagaaaattgaggctcagcaggtaatctgtggccaagttacagaccacagtgctggcatgtggagggcatttcctccagctcagcataactggcatgggagaaagactggcttcaccacagcaagccccacagggccatcagagtggaccagggaatagtgcagccggggagacctaagcagaacttccagtgacaaggagaggattctctggaggcagctgggaggggcccatgagacgcctttgggcattcacaaaaggtgtgagggctttggggtcccagcagatttcctcagggtggggtagggtagaggtagggaaagaggctgaaaaagatcatgattttgttgcaattttattaaccatctttcttagtttttacctgcatttatatgcaggctaacagcccctgaaagagttcataaactcagcctctgaatctgtcccatcatccccacaagcatcctgggaaagagagtcttttcattttctctgtctctgtctctctctcaacagatgagaaaacagtggcttcaaaggttaaacaacttgtcttcgattgcacagctaacaagaggtaaaactggaatttgaatcgtggtactgtgacttcagaggccaggttcgtagcgctacactaacacagagaccagaagaagccttgacattatcataaaaccacagacatgatacaaggccaggaagaaggaggcttgggagcttattagctgaaatatattgatcaccttttcacagctttctcttattatcctcccaatgtctctgtgaggacagtacagttatcaccccattctagagatgaggaaactgaagctcagaggtgttaagaaacttgttctaggtcacacagctagtaatgcttgggatcaggatttgaatttagatttgtcatattccaaagtttacctatagtctcagctactagggaggctaaggcaggagaattgcttgagcccaggagtttgatttcagattgagcaacatagtaagatcccatgtcaaaaaagaaaaataaacaggtgaaattaattttaacaatatgctttacctaacccaatatatgcaaaatattacattttaacatgtaatcaatattttcaaagttaataatgaataccagaaataacacatgtgctaataacatgtacgctgcaacactaatatcttacctgatacaacagttaaaatcaagtcccaccagagcaataaagttgtgtctaccagaaaaatattttacactgcttccatttttaaatttacatttaaattaattgacattaagtaacatttaaaactcagttcctcagtcacacgggctacattttaagtgtgcaacaaccacatatggctagtggccacagtggtgctggttaatgagcacagctctaagccttccttgtgtgtttttttaaaaattcaattcagattccacttccattgtttgcttgtttaaccttaaaatctgtgtgttttaacagacctgtgtttaagccttataagtcccatcacaaagtgtcagtggtttggagagaggttctagaacgttctctttgtaacattatcacaaatctgtggttgttaggctgctcttggtttatgtttgagttaaaccctttgtgtggtgtcagaccaattcaggcttatgttttccccggagagaggaataagctgctattttggaccctgtcgtgatccctgcccagagtcaaaagtaattcccaagcagactgatttttacagggtcatgctcctctgatcttctctccaggagtgtgattttcaacgggatagagaaaggcaaactcctgaggaaaaatttctctgggaaagcccaggctgaagtcgaggagggaagaggacgaaaggctgacagggttgccgtctctgagggagatccactcacacacctcaggaggcattgtgggatggtcaaagtggggaggaagaaagggaatcttcgaaagaaacttgcggcggggcacggtggctcacgcctgtaatcccagcactttgggaggctgagatgagtggatcacaaggtcaggagttcgagaccagcctggtctggccaacatggtgaaaccctgtctctactaaaaatacaaaaattggccgggctcggtggctcacgcctgtaatgccagcgctttgggaggccgaggcaggtggatcccctgaggtcaggagttcaagaccagcctgaccaacatggagaagccccgtctctactaaaaatacaaaaaaaaaaaaaaaaaaaattagccaggcatgatggcacacacctgtaatcccggctacttgggaggctgaggcaggagaattgcttgagcccgggaggcagaggttgcggtgagccgagatttcaccattgcactccggcctgggcaacaagagcaaaactctgtctcaacaacaacaacaaaaaattatccgggcgtggtggcatgcacctgtaatcctagctacttaagatgctgaggcaggataattgcttgaacccggtaggcagaggttgcagtgagcagaaatcgcaccactgcaccccagcttgggtgacagagcaagactctgtctcggaaaaaaaaagaaaaaaagaaagaaacttaggctgaaaggtttaaatggacacagaacagcaaactcaaggacttccatagctactgggaaccagcacagggctgacacctccattgaactctctttgctattctagaatattttaataatgagacacacccaaaacatgtttagaatcatgccacctgctgcttctcatggccagcattatttgtcatcaaatctgatcccaatgtttgccatattattggatatcctgtgaaatagaatctaaaaatatacattttttccctctaaatcggtcctaaccttacagctagggttgcaactgtaatattgttgtctgtttcattttactttccaggattaggtaataatattaaattccccatctcatgttagtttctgtttgaacttggcctggtatttgaagaatatatttagaagttaaagcgtgctactttttatcccatgcaagccagttgtgggttcatagatctgtggtatctcataacattttctgtcctaaactgaacacatccagtctctccaaattgaagttcctcagctgaggttattttcatttcggagaatttcttgagagttgtttctgttatagaggataaagggatagaggagtcacagctgcctaaagtcagtgcctctttaaatacaggccttccttgcctccaggacttgatgtcttcctttagtggagggcagctcctcaattgaagagggcgggattgagggagcagttgaagcagcaggttcgcctgggctcatgcttttctcttgtgtggctgctgttacagggaccttcaggcacgttctaggaaagccaattaaagcagaaaaggcccttagaaccaaattgattgcccccagtatagctgttaaactttgagagagcagctgggtgcttcttgtggccctgatagtgccagattgttcatgctgccttaggctttcctgtaacatttttgaaaacccttgttatatccagtttaatgacatgtattgatcagaacaaaaagggctgaggtactgactccaggatcaactcacagacagaaccatacatttctattttttagattctgcaaagcacccaagtcaaacataggattattcccagggtcatgaccatacagcattttatctgtgaagaacagatagtttaagtcctttatttccatttgatttcaaatgtggataaagaaacaactaatttattttcagaaatgtacatcacctctgactctcaaattagcacctgattttcttattttcactttgaaaccgctgtgtgctattttgattctctagaaagagttaaacttctcataggcattaaacccaagtggaaatagttggcccaaggcctaaacttgttctttatgagaaatacaagactcgaagggattctagcctttttagaattatcatagaatgtgtacaggaagcatgacattggcagaaagggaacataggtgccttttaccgtgtttatatggacatgggttctgggttttacagatggggaaatattgtacgagtccatggggatatgtagtgaaatggagagggagagggagaaagaaagagagagagagagagagagagagagagagaaagagatattcttttgtactttcagactgagcagtttacccaagtcagagaagcaagggtatacaggtaaagtacagaatagtctggaataatgtcattattgtttggtctctttacttctttatagggcatctcagagagagaacacagtttctcaaagtggatggaaggtgtattataagtttttaacccagaataaccaaaacaatcttgaaaatgaacaaaattgaagattcatacttcctgatttcaaaacttactacaaagcttaagtaaacaaggcagtgtagtgctggcagagactaggcatagagactaatggagcagaattgagattccaaaaataaacccatacatctatggtaattgattttcaactagaatatcaagcccattcaataggttaagaatgtttcttttcaacaattggtgctggtacaactgcttatccacaggcaaacaaatgaatctggaaccctacctcacaccatatacaagaattagaatggatcaaaagacccaagtgtaaaagctaaaagtgtaaaacccttagaagcaaacaggtatatatctttgcgaccttggatttagcaattttgtttttgtttttgttttgagacagaatcttgctctgtcacccaggctggagtgcagtggtgtgatgtgggctccctgcaacctctgcctcccgggttcaagcgattttcctgcctcagtctcctgagtggctgggaccacaggtgtgggccaccacacccagccaatttttttatttttagtcaagatggagtttcaccatgttggacatgctggtcttgagctcctgacctcaagtaatctgcctgcctcagcctcccaaagtgctgggattacaggcgtgagcgactgcacctggctggcaatggttttttagttatgatgttgaaagcacaagcaactaaaaaaagagagaaaaatcagatttcatcaaaattaaacatttttgtgtgtcaaaagagactatcaagaaagtaaaaaaacaacctacagaatgggagaaaatatatgcaaatcttatattgggtaagggtctagtatctaaaatatatgaaggactcttactattcaacaataaagagacaaatagctcaacttaaaagtggtcaaaacatgtgaatagacacttctctaatatacgaatggccaatacacacatgaaaagatgctctacataattagccgtcagggaagtaaaaatcaaaaccacattagataccacttcacactcactaggatgctataataaatttcttttaaatggaaaataacaagcgttggcatggctgtggagactggaaccttcatacattgttagagggaatataaaattgtgcagccactttggaaaacagtttccagtacctctacaagttaaacacaaagttaccatatgacccagctccactcctaggtatatacccaggagaattgaaggcatatgtttatacaaaaacatacatgaatggtcatagcggcattattaataataacccaaaagcaaaaacaacccaattgtccatcaactgatgattgataaacacaatgtgacatattcatactagacaattaaataaaagaaaactttttttttttttgagacaggatccggatctctctctgtcacccaggctgcagtgcagtggcatggtcttggcttgttgcagccttggcctcccggactgaagctatccttccacctccctcgcagagcccgcttcccccaccaatagctgggattatcagcgtgcaccaccacatacagctaattttagtattttttatagagacagagtttccccatcttgcccaggcccacctgtctcatcctcccaaagtgctgggattacagacgtgcgcctctgcacccagcccagaaaacttcttacacattagcacccactccctattcaccgctccccacagcccttggcaaccacgaatctattttctgtctctatggatttgccaattctggacatttcatataaatagaatcatacagtatgtggccttgtgtgtgtgtgtgcgagtgtgtttgtgtgtatgtctggcttctttccttagcatactgttttcaaggttcacacatgttgtagttatgtaccaatcctttattcccttttattgccaaataatactacattgtctaaagcaagtctaacttaaaggaaaaaaaaaaaaatatatatatatatatatatatatatatatatatatatatatatatatatttcattgtatgattataccacattttgttcatccattcatcaattgatagacatttttgggttatttccacattttgggctcttatgaagaatgctgatataagccttcataaacaaatttttgtgtggtctgtggtcatgttttcacttctcttgggtttttgtatatattttaaatgctgtaaaaactttcctgacttagataataatgattcctttattgacaagtataaagctttctcatcaaaagatagaaaactgactccattttgtatcacagtatcacatccttagaacattgagagctcaaaaagaactcagacacctgctgggtgagaccctgattctattgacaaggcctagagaggtggggtgaccactacaggtaagacagccagtgaatgacagagacagacacagaaccatggtctcccaacctacatccccttcccatctagatggacatcatctttaaccccgtgactcttacccagagtgaaccatcggtctttccagagtctgggaggggaatgtttccatggtgaagatgacttcccagagtgggaccttagggggtagtagacatcccctacctcccccaaaccattccccttctccataacttgctacagtacttgcagtttcaccagcagccaatccactggttgaatggagggctcacaaatgaatggcctatgggggccagagaggaatgaaacagagtggattgggcaggctggcaagctggaaagcacatgccccccccacgaaatagcttaggacaaaagccacaggatctgtgttcgtgaaacatcttggaggcttggggttgagcaagtggcttcttagcccagcgtgcaagatttggcatgtgggccatgctagcctccctgtagcgctggcattctgaaatctcagagatgctgctacagaggaaagccaggcattgcagggcaaggctctcacagtggccgccagcacctcatggtggcacgaaacttgagcaggagaggaagggtgggcttgttcctgagcaccagaagctgcaactaccctggcacccttttgttaactggggagaacctttgaggagatgctggtgaacgttccatgcaggggctgagaaccatcacaatttggcccataatactgcaaacaaagtccagcaagcctaggaaatttaggattcatctctaaaacagtattctctgtttagaagcatatagaatattttataatccaaatgagttgattgcctcttggcttgcgttagcgagatgctatcattgcaataagcggaaatctcaactctgttagcttaggcaaaccatacaactcattggggattcagattgctgttccttggtcttgctgtttgccttgctacatgcgtatgaatgtgcagatgacaagaacagatgccagggcccctggaagatcaaagtcctggcgctgccttagaaaatctgtccatgccacatccctaaatctgcaggaaggccatagtaaatatgcaatagatatttgttccattgaatgaactctaaagcaaacccattcttaaccattcctatgtaagaccaaagcacatgtgcaggcggctgggaccaaaaacaaggagtagtacttttggggacacaattgtcactgctgtttccccactatcttagcattcggccacttctccaatatccagattaatttgctgcaatgaaaatttcctctcttttgtattaaaactaccctaacattattttcatggttatttttccaaaactggaaataagaacacattgtttctagattgtggacagtggttccagagaagggaaaaccagaagggttttatgactcaggaagaaagagctcccagaggggcccaggtggtttttcttccatcctcccctttacgatactctgaatatctttttttttttttttttgagacacagtcttgctctgtcacccagactggagcgcagtggcactatctctgcttactgcagcctctgcctcttaggtttaagcgattctcctacctcagactcccaagaagctgggattaaaggcacccaccaccactcccggctaatttttgtatttttagtggagacaggagttcaccatgttggccaggctggtctcaaactcctgacttcaagtgatccgcccacctcaccctcccaaagtgatgggattataggtgtgagccactgcgcctggcctgaatatctttttaaaaattattttggaaggttttctgacttgcccttcaacatttctagccttccctttctgtccccaacattaatctcccgcaagtctcttctccattgcttctccgcgttggcaggcccatatttttgtgtggcttctctctcctgtttactcaaaagctcataattacttttctcttgtggataaaaataagcagaatgccagtagtatgatttttaaaaagagaagcttcccagatgcctactcctgaccgcatggaatcattctgatgagagcatgcttaatcaatcgaccctgcattgtctgcaaggcttggttcaactggctgactccattatcctgtaaactgtgcaattttctctaaagacatttcaccagcacaactgcataaaacaaatgttgaatgggaaaaaaatcagtagtagatattttttaagacatcctaacaccattaaggtttttttccgctgcaacctgcatctggtagtaaaatctttcttttccagacattgttttctccaaagaatcattcaaaaagttactaccgtatgaaaactctttagccatttacattttgtgggttttaacaagcgtgtcttccaggctgactctggctggtagaggttttcacccattcctcaatgggcaccagaattctgatgagttcatgacattcagtttaagaaattacccgcggccaaagatcttgattggcaaggttagtacattttgccatatgttatgtgctatctctgtccccaaatatgcaactcttatggtgtgacaaattgtgggacgacacacgttgcagcccagacagttagacaaaacactccatcagaactgaaaccgcaggctaggtctctgaataagaaatatgcaaaaccacacctgccggccaacattgctgcttatttcttgctcctcttttttttcttaccacaaagaaaattaaatgtaaaatcaatttaatgttgagaaaaggacccagggtgagcttcccacgtacacttaattgagtcagtgatattttgtgtggcctagttatagcttgagtggtgcagctgagtgtaagctgtttgtgatttggagtttaaatcctatgtttaattattgccagtatcacataggatacagtggctgacaacgcaacagagttagacttaacagttgtctgtggtttgggcctggttatctgtttaagatcaatatattctaacaaaaattcttgccatggttaaatcctcatgtgttctgctattaggactcaatatttatgatacttgagggcaggaatttcttcataatggaaagtgatattattgggagtggtagagattcatttttgaaatccattctgacatggaaacgtcttaaggtcattgaatttcaaaaacttgtcttttaagggatagttttcttctgataatataacgagatgagaatgttgtgctgtcttgagtaaaatgtgtggtatttgtgtctgttgggtattaatgtgtattatgtgcattggaatcatgggtgccttctatattttaagtaatgagaaaaggtccacaattttataagctgtgtgtatgtgtgtgtgtgtgtgtgtgtgtgtgtgtgtgatctgtctatcatctatctatctatctatctatctatctatctatctatctatctatcatctatctatctttatttatatatagtaaagtatatatacaactttgccactgggagcactgtaagtttctataaccacttgcagtttaagaattgtgccaaattggccaggcatggtggctcatgcctgtaatcccagcactttcggaggccgaggcaggcagatcacctgaggtcaggagttcaagaccaggctggtcaacatgttatggtgagacccccgtctctactacaaatacaaaaatcagctgggcatggtggcacatgcctataatcccaattacttgggaggctgaggcaggataatttttttttttttttgaacggagtctcactctgtcacccaggctggagtgcagtggcgtgatctcggctcactgcaagctccacctcccaggttcacaccattctcctgcctcagcctcccaagtagctaggactacaggcacccgccaccacgcctggctaattttttgtatttttagtagagacggggtttcattgtgttagccaggatggtctcgatctcctgacctcgtgatccacccacctcagccttccaaagtactgggattacaggcgtgagccactgtgcctggccaggagaattgtttgaacgtgggaggcggaggttgcagtgagccgagatcgtgccactgcactccagcctgggcaacagagtgagactctgtctcaaaaaaaaaaaaaaaaaaaaaaaaagaattgtgtcaaatcaaaggccagttctttggaggttttgtagatctgcagcaccaagtaggtgcttgacacatattttcaggagttcttttgtcatcactgaatcaaatgcaaccttagtttttccagcccattctgtcagcctagtcccaggttcccttttgcagtgtcctctcaggtgtggccattcagtgcctgtcatccaagtccatttttggatccttgagtcatttttcttctaatctctcaaactccatattcaactcatcagtaaattctttctctggtatctcaaaagcattttcaattaactctgtaactcaactctacgcccttaattttcagtacagatgctcctcggtttatgatggtgttttctcctgatacacccatcacaaattgaaaatatcttaagttgaaaatgctttcgatacctctaacctactgaacatcataggttagcttagcccaccttacattaatctatagttgggcaaagtcatctaatacaaagcctattttataataaggtgtcaaatatctcatgtaatttattgaatactgtactgaaagtgaaaaacagaatggttgtatgggtacttgaagtacggtttctactgaatatgtattgcttttgcaccaccatagagttgaaaaattgcaagtcgacctattgtaagttggagattgcctgcactgccatctctcatctggaaactacagtagcctccaaaatatgcttcctgcttcccctctggtccctcactgatccttgatcacagagcagctggaatgatcatcaaaacgcatccatcagatcatctgacttttcttctcaaaactttggatggcttcccacatctcttacaagacatcctaaattccttaggatggcaacatcttattccctgcttcctgtgtctctcttcaaccttatctcataatctcactttccccctttcttgctcaccacatctctgatcctggttcctttcggttctgggaacaagtcaaactctttccagtctcagggcctttgcacctgttgatatctctgacccaaagtgttacatagccccacccttgttgcatgtaggttttggcacaaatgtcacctcctcagagaggtttttcctcaccattttgttttattttatttatattttttgagacagagtttcactcttgttgcccaggctggagtgcaatggtgccatcttggctcattgcaatctctgccacccaggttcaagcgattctcctgcctcagcctcccgagaagctgggattacagacatgcaccaccacacccagctaatgtttgtatttttagtagagatagggtttcaccatgttggccaggctggtcttgaactccggacctcaggtgatctgcccacctcggcctcccaaagtgctgggattacaggtgtgagccacctcacccagtcatccctcgccattttaaaagtagacacttcctgctattctctattcattccctattctttccttcctggtttctgctaccatctgtgattatgttgcttatttacttgtttattgtttgttttcccccataatactgtaaatctcatgaaagtaggaaccctatctatcatgcaccctcagtgcctagtgcagtgtttggcacaaaggaagtgctcaataaatttgttgaatgaatgaacaaacagaaaatcctttcaaatactgaggaaaaaaaatctgcttacttaaaatttctacagttggttctaattctgtttctactattgtttccaattctaaggcaacatgcaataattctgcagcttcatatacatgatcacatttcagatctttgatacccttttattttttgagacagagttttgctcttgttgcccagactggagtgcgatggtgtgatcttggctcacctcactgcaacctccacctcccaggttcaagcaattctcctgcctcagcctcccaagtagctgggattataggcacccaccaccacgcccagctaatttttttgtaattttagtagagatggggtttcaccatgttggccaggctggtttcgaactcctgacctcaggtgatccacacgcctcggcctctcaatgtgctgggattacaggtgtgagccaccatgtgtggccagatctttgatacccttcttaggcatcttacatctgtgctatttatactgctcaaccttcctttgtatggcatggtttctgactttctcatggcagtaatcactctctgttggaagactctagtttgacaacatccttcactaacaacaacaacaacaacaaaaaaataaaaatagaaaagccagcgtggtggctcatgcctgtaatcccagcactttgggaggccgaggtgggcggatcacgaggtcaggagattgagaccatcctggctaacacggtgaaaccccgtctctactaaaaatacaaaaaaattagccgggtgtggtggtacgcgcctgtagtcccagctattcaggaggctgaggcaggagaatggcataaacccgagaggcggagcttgcagtgagctgagatagcgccactacactccaacctgggtgacagagcgagactccgtctcacaaaaaaaaaaaaaaaaaaaaaaaagtgttctgaccgctgcaaggtctaatagcactcattctccttgattagaatcccatcagatttatggtctgtagttttcagaatctattgtttttggtttttttttttccgcaacgtatattgcaaaacagaacattccccaaggtttctggcgttttccccactctccatgatttctcaaacttaccgctagtggttctgtgattctatctgcaaatttcttttgtactctggaatataatttgtttggacccagaagatttaaaatcttgcctaaattttatatattttattttaaaatatacctagatttttccttgttctctaacttactgtaggctccagttttcccttttcatcatctactttgctgcacagttagaaatcagaatccattctcctcgctccagaagatggaatttgagtatttggtagtttgtactttttgtcacctgttaacatttcaccatcttcttggaccttcacttccttcttcatcttctcttccttatcctcttccttcttcttcccttctttaatctttcatcttttgttctctcctccttccctccctccctccttccttccctccctctccttcttaccttccctccttccttctttccttcttctctcctttctccttctttcctttcctccttcctccctcccttcctccttccctcctgctctacttccttccctctctctctctttcctttccttctttccctccttccttctttccttctttccttcctccctccctccctcccccttccctccttccttccttccctcccttccttccttccttctttccttcctccctccctccctcccccttacctccctgccttccttccggcgggcgtacttgcgggcgggcggggctgcgggggggcgtgggtagggggggggggtggggggggggcgggggggggggggggggggggggggggggggggggggggggggggggggggggggggggggggggggggggggggggggggagggaggggggggtgagagggggggggggggggggggggggggggggggggggggggggggggggggagggggggggggggggggggggggggggggggggggggggagggggggggggggggggggggggggggggggaggggggggggggaggggggggggggggggggggggggggggggggggggggggggggggggggggggggggggggggggggggagggggggggggggggggggggggcgggggcggggggggggagggggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaggagtaacaagaacttaacaaaacacaatagataaataaaaaaaaaaattataccaacatttataaaaaccctataaagcaaaatataaaagagaaaatataaaaaaaataaggaccacaaataagtacaaataaggaaacaataatcgcccaaaaaaccaaaaaaaagtatttgaatagagatagtagtcccaataagaggaaaacaacacaaaaaaataacaattataaaaaacctaataaagaagaaaagaaaacaacagaaaaaataagaaagtataataaaagtgttcacaaatatgggaaacactacaaatagagaccaattaggagcgaaataaataataaagaatataataagaggagatttataaaccaaatgaagaaaaaaatgaggataaaaaaataagaacataatataaaataccacaaaaattttaaaaagagacatttattaaacggaaaaaaagtataatcaattaaaaaataaacatagaaaattcaaaaaagagagaaaagacaataatagtgaaacaaagagagaagaacatatataaggagtaaaattaatcatgaaaaattaaaacaagattaggataaaaaagattaatatataaaaaaagaattacgagttaagaattggagaaataaccaaaggaattatccaaaaaaataaaaatatgtagaagtaagcaccaaggaaaggaaaaagataaaataatgaaaaaaatgaaatattaaaaaaaaataaaaaagagaaataaaacctgtaaatccctgcttcctcccttccttccttctctcccaccccattctctctgaactgaatctatcatggaacacctttttaatctcacttgtttctgagatttcccactagctaaggctttagtcttcctaaaagccttctctcttctttttttttttttgttttgatcttggatatgggtcccttattattgcttgtgaacatgtctttaaaaaaaaaacaaaacatgagttcatgagagttttctgagtggccacactggcttataagtttacttatcctttccctatttacaggattgttcattattccattgccttggaatttatgtaatgctctctttctttgctattatggactcccaaaagacatggtcacattctcccaaggtctctataatttccatatagaaaccagttctttctctttggttaaaattgcatgcagaataccagtttctcctttgatctgagagctgaaattgttagctaggaaagtctcaaaatttttataggctgctctactttagcaaaatatgacctccaacagacataaagatagttcaagttcctatccctatgactgcttgcttgtagttatgtggtctgctttcaggaaggctcctccatgcctgggcacccaacctaagccctcgccctcgaaggaatcctgtttatgttttgcccgtaattcccggctgcttccgttcttactgagtaactttctgtacagaaacgggctatctttttgcatcctcttttcacatataaggctgcttcttcctgcctctctcaaaacaatgactctttctattgctgtatttcaggtaggagtcccatcacatctatgtgagaatggctgtgcttcttatattaacataagttaatttctttctttgcatctcatcctctgtgactcagtgtcagagatattttcgtgtttaagggatttttttttttgatgagtttctctcagttttaacaaaaactgacatatgagtaccatctacaagactccagcagtttccccggtatcccattcttctcatgtttgactctcattctccctcatcccctgagaagatttttccctctaattttctagtgttccatccctttaaaattctctcttggctggatacgttggctcacgcctgtaatccgagtactttgggaggccgaggcgggtggatcacgaggtcaggagttcaagacccgcctggccagcatggtgaaaccctatctctactaaaaatacaaaaaattagcagggcgtggtggcgggtgcctgtaatcccagctactcaggaggctgaggcagagaattgcttgaacccaggaagcagagtttgcagtgaaccgagatcacgccactgcactccagcctgggcgacagagcgagactccatctcaaaaagaaaaagtcttccttaaatttttttttttttttcgagacagagtctcactctgtcacccaggctggagtacagcggtgcgatctcggctcactgcaacctccacctcccaggttcaagtgattctcctgcctcagcctcccaactagctgggattacaggcatgcgccaccacacctggctaatttttgtattgtttttagtagagacagggtttcaccatgtgggccaggctggactcaaactcctgacctcaggtgaaccacccgccctaggcctcccagattgctgggattacaggcgtgagccaccacacctggcccaaattttttcactgagcaaatactcttgtgtatggaaaggcatttctcttggactttgcctgctcctctgctagctgatcatcacagtaactggtggtcaccccaggaaccgggggtgttacagatatagaagataccccgcacaaaccggcaggaaaatgatttctaaatctcaatttagctgaccatgtgattctgatgaagaaccatatgagaagcatagatacaggaacacaacttgtagaagtggccccatgcagactgcaaagcaatgccctttgtggtacaaaattaagtgtctcctttttctttggattaggggaaggggctgtgagcaagggagaaggcggttcttggaagcaggtgggattggaagagggagagggggctttggggaggggagaggtctgcaggatttggccttcccttcccttctttccatcagacaaaccattctgcccctttagctcccctgagactaggaggaagccccttgccattgttctctatcactgcctcttttcttcctgcaggattgtgtcccacctaaacaatccccatttcctgcactgcctgccctggtggcttcttccaggacctcagggaagcaggcagcttcatctccaagtctcccaggcctgtggcctcaccccaccactcccaccctcacctcctttgtcaccccaggagttctctctggcattcatgcctgccccaccttgccccagacactgtacctgaggatgcagatctgggaggttgcatgtactcctgggctgtagtttaaggcttattcaaaggcctgtttgtaggcagtatggtataagcagtcgaaactagataaaggcagatttgggttcaaatccaaattttgctaccttccaaccagttgagttatttaatcattttgaatctcagggaccccatgtataaaatatggatagtaatcctagtaatgcacacagatatttgcgtgcacacacacacatattcacacacatatttcctggcatatatgttcaactgatgtatcaatgtttccccatctatgaaatggataaaataaataaatgacacctactttttttttttttttgagacagagtttcactcttgttgcttaggctagagtgcagtggtctcggctcactgcaacctctgcctcctgggttcaagctattctcctgcctcagcctcctgagtagctggcattacaggcgcccatcaccatgcctggctaatttttgtgtctttagtagagacgaggtttcaccatgttgggcagggtggtctcaaactcctgaccaaggcaatccacctgccttggtctcccaaagtgttgggattataggcatgagccacggtgagccacggcgcctggccatttcttttttttttttttttttttttgagactgagtcttgctctttgcccagactggagtgcagtgacatgatcttggctcaatgtaacctctgccaccaggctcaagcaattctcatgcctcagcctcccaagaagctgggattacaggcatgcaccaccacacctggctaatttttatatttttagtagagatgaggtttcaccacattggccaggcttgtctggaattcctggcctcaagcaatccgcctgcctcggcctcccaaagtgctaggattacaggcatgagccactgttcctggccaaatagcatctacttttagtgtttattttgaggaaagttaaaggaggaaaataagtacaataaattgtatccataattaataggtattgtggagaggtgtgtgggctactggcaagggtgattactttagagtcagattaagtttgagagctagttctgccactaactagctgtgtgatgggcaggatagtcaacctttctaagtctcattttcccaaactataaaatagcaactgtattagtccgttttcatgctgctgataaagacatacctgagactgggcaatttacaaaaaaaagaggtttattggacttacagttccacgtggctggggaggcctcacaatcatggtggaaggtgaaaggcaggtctcacgtggcggcagcaagagagagaacttgtgcaggggaacgcctctttttaaaaccatcagatcttgtgagacttatccactatcacaaaaacagcatgggaaggacctgcccttatgattcaattacctcccacctggtccctcccacaacatgtgggaattcaagatgagatttgggtggggacatagccaaaccatatcagcaacaattatagaacccacactctagaactgtcataatgaaacacgataatccacagacagcatccagtcctgcacttggtgctcagtgagggcttcacaagttgctgctgttactgttactagttgtattggttatttcattctccctgctgccctccctagctctggaccaggagtcacttctgttgccttgtggggaaggagaggaggacaatgagcaaaagaatccagaaggcacaaaatccagccctttggagagaggaaagtgaaaggcaggagcagctgaaagggacaaattcagagaggatgtgggtttagtggggataagcacctggcactttgtcgcttttattcttgtcttatgccttttccatcatttttatgggctggtgtgcagacatttgttgaaaggactcttccacctggatctcattgaaatcatgcagcctttctcttcactgaatatttttctatcccagtaactatataaatgttccatttgtgatgtaattgttctgtttcagattttctttcctaaactaaaaacgagagttaccccaaacattcgagacaatggcttgaatgtaatgctttgaatgatgaacttttcatttccaatggtttacatttattttttctatttagtggtctaccctctggtgctaggtggaggctccaaagggcaagggttacattgagaggaggatggagctgcagagacttactttcgatataaaaatttccactttttagagagaagcatgagctaaacagaggcagcttttacttgtttggaaatgcaatcagggtccttattttagttgcttaatatttctacaccaaacaaccagcttctgccaaaatcacttttacacagaaaatactctgttgcattaacgggctatggcagtgactttttcttgaagctaatgaactgtcattctacttcttggctctgccaaataaccatgcatgggaggaggaaggaggaatcaggaaagggccagagttttgcttaggcattttcaaacatagaagatggaccacatcttgttcaatgaggagatgaggctgactgttaagctgtttagttgtggtagatgaaaggaggacggcttcaagtgggtcaagccccatttctcctattcacttatttatatgggctgtaaatctcgattttattagccataaaatgggaagataatgcctagatagcagggctggctgaagcttagcagaaattagatgtgtgcacaagtgacccttctctcaagccatttgtgtgaatgtgataatatgtatgaggaattttcttttttcactggaggagaaaggggagtttctataataggtgtctttaaatgtagggagccaagagatggcaggaggaaaatggaagggtggtatgacaactgtgtcccatgccttgtcccttatcctgggcataagtttccctgttcctgactcccccacctctggcctaatgaagtacggattggaggacagcatagccttgaagcctaggtagccaggtggctcatgcctgttatccctgtactttgggaggctgaggcaggcggatcacttgaggttgggagttcaagaccagcctgaccaacatggagaaaccccgtctgtactaaaaatacaaaattagctgggcacggtggctcactcctctaatccctacactttgggaggctgaagcaggtagatcatctgacgttgggagttcgagaccagcctggcaaacgtggagaaaccccgtctctattaaaaatacaaaattagccaagcgtggtggtgcttgcctataatcccagctactcaggaggctgaggcaggagaatcgcttgaacccaggaggttgtggtaagccaagatcgtgctattgcactccagcctgggcaacaagagtgaaactccatctcaaaaaaaaaaaaaaaaagaagtcgtctaggtgacagaagtctcacctgaagatgagcagagccactgttgctcattccaccaaaaatctgttgcaccctaagggctcaggagaaacaccagcagcaaagtgctgctctcaaatggcttggaggccatgagtgagcaactctgaggatccggagagtagaggggtgtgtgtccttattcatgagccaatctgagacagcttctaggacacctagaaggcaataaaggagacttcaagtgatgagggtgtggggggatcagggctattgaaggcttgtaggtctacaggtggaggcttcattgtaatgggagctcacaagttggtgaggcctggagacatgtgaaatagttgtcctagataatatttcagtgtgaatttaaaaagagaaagagaaaggccatgtgaaagcactttgcaaattttagtgttatagaaaagtgcagaattggtattatgaagaagacattctgggatcgagcacagcccctgttagggtggctctgccaaggccagactcacgtgagaggtatcaggtaacagggataccgaaatgctccccaaaggccaggtgtggtggctcacgtctgtaatcctagcactttgcaaggccgaggcgggtggatcacctgaagtcgggagtttgagaccagcctggccaatatggcgaaaccctgtctctactaaaaatacaaaaattaaccgggcatggtggcgtgcacctgtagtcccagctacttgggagactgaggcagaagaatcatttgaacccaggaggcggaggctgcggtgagtggagattgcaccactacactccagcctgggcgacagagtgagactctgtctcattgaaaaaaaaaaaaaagtaaaagaaagaaatgctccttgcggcaatacatgggaattttgttgagcacctgctgtgtcctcagaattctttcatctgcttaggattcaaatacaattaattctcagtctctgttcttcagcagctcactgtccaaagggagtctctctccccggtccacatgctgaggcttgctccagagtgaatgtgtgcactggaaagaacccacacaggccccctgagagctgtcagccttgccaggcttctgtgagatccctgggtccgagtagccaagctgggaggagcaccatttgcccactgactcttgggcaacgctgcagcctgcatcccagccggcagaaggcaggtggtatcacagctgagtttacagccacggaaggaaccactgtaggcttttagtagataatatgttttctctgcttcaaatccttattttggttgcttaaaatttctgcagaaaacaaacagcttctgccaaaattggctcacaaaattagcttactagtataatcagttgtatagcaagtatttactgagtagctcttggaaggcagtcaacacaagagggatggatcattcttccagttcatcacacgtgggttggacatgctaacagtccccgatagctatcaggcgagtaaatggatgatcacacaaaggcagaggcatcgcagaaggatgctaactagatgtcatgcgtcaaggatactacagaaggatctctttgctgacaaggagggtacctctaaggttccttcagatgggatggttctctgttcaccgtgatcactactatgcaaaggcctgtgggccatttaggagaaaagcattcagtccaattccacagacacagtgaggatgtaatatgccctaggcatatatgagtggatccaaggaggaaatactcagtcactactgtcaagaactcatgacctgctgcagggtttgccaaactatggcttgtgggccaatctggctcaccacctattttagtaaataatgttttactggaatccagacacgcttgtttgattacatattgtctatggctgctgagcacccactataagggcaaagttaagtagatagagactttatcacccacaaaacctaaaatatttgactggatggccctctacagaaaaagcctgcgaacctgtggtcttgtgggaggacactgctgggcacagttaactctaattcttggctgtagcatcttgaatagggtggcagtccctggctgctgagggggacagctggacggctgcctcccaggggcatttccatgacttgcaggcccagaaactagacttgggcatgaccacagagttcttgatggactgaagatgcccaaaccacagactgacttgtaggctagaaatgaacatgtggggtggaatagtccttttggggactagaataatttctagagagccaccctttctacatgatacggcgcacattcaagtgtggctacttacactgagactttctgatgagcacgactagacagcagggggcccccaggatagtttgttcaggtcaaggtaagatgagaggagaaactagccctgtcccttgctggacaccaccactccagtgcctgaaatccaacctccccacccccatcagcattcctcccctggaaaagattggaaaatgcaagaatgtgcttctttgactctggccttcctctaacagccctgcttctgttaacacagcctttttgcagcttccttgacgtcattggctacaggctacagctgttgctagtcaaaggcattgttcctttgagctagcaggcactttgttctctcccatgacacattgttttatgagctcactctagaggagaaacattctatccctgtgctcaagttcttcaggagcacctcactgtctccctctgcccacccacctgcacctgacagctgtgggctgtgctctcagggaggcaccgtcagatgctaccagactacagaggagagcaccctcaatcctgactgaaggtttgggaaaaggctgctcagaagaggtgatacttgatatgggccctggaggaggagaagcagtttgagaagacagcagtgagagatggcatccgggcaggcgagaaatgtcagtggtcatggaggcagcatgaagggactgttggctgcagaaacctggcaaggctcttagagacagagacgaagagggagatggggctggagatggagatgatagagacagaaagattgaagatggcagagtgggggctatggggaagggtgatgaagcaggaaagatagatcgaacgagactgcgaggagcctgtgtgcctgggctttattttggaggcaatgagaaacagaaagtgtttttgagcatgatgggacaatgaggagttctgtggtttaggaaacccagcagtcacgggaagtgcagattcaaagtaagaaaacgtcccagggtttggtgatgatcttggtgggaagtgacacaggggtagtggggatggaattgaaagaaaggatgaacttccagagtatggctgtgctcagtagacaggaatcagggagggcaggaggagagtaaaagggtcctctgagcttaaatccagatgttgaggagatggtggtactatcaatggaggtggagctcttaagaggaagaaagatgggaaagaaaaggatgaggtttttgacaagttgaatatggggtgagcatgggtccaactgaaagcagtggaaatatagacgtgaaaaatagatgcggtagagttgaaaagttggggataattttcacctgaatgttacctaaggcaaagggaagagaggtcatccaggacaaaagtacagaatgaaaagaaaaagcaactaagcacgaaatcttggagaatgtcctcattgaagggtgagcagatgaagaggagcccacaaaagagactgaggaattgtcttcattcactcattcatgcatgtattcatttggtcaacaaatattttttggcacctcccatggacaggtcctgagcaccaagggtacagtcagaaatgatgaatccagaaatgatgccctccagaacttctggtgaggaaggcactcaggaaaatgcagcaccctatggaggcccagaaaggagggcattcaggaagaacacagtctgatggtgtcaagtgcagcggaggctaagaggtagggaggaaaagatggtaaaaggagagaactggggaggcaagagggacaaatgagggagaagagaagggagaggaaatacaacagaggcacagagtggggatttgtctgattcaagaatcctaggcggggcgcggtggctcacacctgtgatcccagcactttgggaggccaaggtgggtggatcgcctgaggttgggagtttgagaccagcctggccaacatggtgaaaccctgtctctactaaaatacaaaattagctgggcatggtggggcgggtgcccatagacccagctacttgggaggccaaggcaggagaatcgcttgaacccaggaggcagaggttgcagtgagccaagattgcttcatggcactccagcctgggtgacagagtgagactccatctaaaaaatgaaagaaaaaagaatcctatgttctttcccctggccttaccttagaaagcagagtgaatgccgacctaatcaggtttacctccattgccatagcaacctctgggactcactttggtgcacattcttgagacctgaagtgaagaagttaactttatatcaagttacctaccaattaggctagcgatttctctgtcttttaaaacattcttttaaagtcttgtcatgtttcatctttctagaattcatttttcacatcttcattcactgggattctggaccataatatatgtaaacacacaaaatactaaagattgaaaatacaattattctgttttctgattattaaagtggtcattgttaaaaaaaaaagacttggaaaatacaatataaagtagaaaatacaaatcactcatttccccaccactcttagtattctgttgtttttcttcccaatcctgtttctagacacatttgatgacatttaaacatatttttattgtgaatatacagtttcatatatggttttgtttgctaactaattatatcatggacatttccccatgccactaaaataactataaaatcatttcattattcataagcttcacattttagcccttcctctattttaatgcagcaattgtccacctttatacataaatatttgttcctgaatcttaaaagtagtcaaattcgttcacacttcaaaattatttttgtatttactttttcttagaatctttgtgtttaatgtctcattcatttcaaagagcaatattaatacaattgaaagtgatcacagcatcttttgtctccaaatgcaagttattttgtaatgtgatctaattttattttgtaaactccattattaagaaatttgacccaaatttgagaaatgatagttactcttgactcataccattcagccctaggtttccatcaatgcttgtttgaattccatgggtatagcactggtggaactgctttttcagatttttagatttgtcagagaatattaatccttaacctaagttttttttccctgatttctctctttacatttatttgttttcttagtttcattatgatatatgaaactaacatatcctttgtatgaggattcagtggttacatctgaaagcaaacaggaagttattattttgcttgttagaaaaattcacttcccttaatgtagcttttcccattattttactctcaaacatttggtgtacttctgttttacatgtgtttcttgtaagaagaatatggttggatttttaaaaattaactatcttttagctgacaagcgtaattcttttttatttaattatgatcattgatatatttggatttattttcaccatctttttacactttctatttgatgaaattcctactccatttttttctcctccaatattttggaatgtatagattctaattttttaatagttaaagttattaattagattcagcctccttctaaaacctagagtattttaactctttctcagcttataagctagtattgtccagtattttatttctattaaaaagtcttgtgaaatgtatcatatatagaaaagtttacaacatgcatgtatgtatatgcatgtttgcgtgcgcgcacgcacacacacacacacacacacacacacacatacattcatatatttaccattttaagaaatagactatgacctctgctttagaagctcatctctcccaacctctgacttttataactttacaagttagatttattagtgttgatatttatttagatgtatccatgtgactacaaatgtctttgatcacgtggttatctttcttacaacttacagttcacatctcctttctggagaagtatatatatccttctttccaaggtatatatatcctcaagaagttcctttactaagaatctgtccagagtaaattatcttggcttttgttcacctaaatatattctattgcatcctcatgaaagataagttttactgggtatccaactgtaaattgaaacatttttcctagcactttgaagacatcatcttgtaatcttttggtttctgctctgttcatatgaagttagatgtaaaacaggaaagctgtctttttctctagctgtttttaagctattaaatttgtctttaatgttctttcatttcaccaggataagtctgggtgtgaatattttttagaattttttgtacttcctaaatataaggaaccatacaaattattgaatattgtttccatctcattttctctagtcactctttctggaactttcattagatgaatgtgaacacttcttaaactttcatgtgtatatcatgatatcctttttctctctctcaactatattctaagtcgttttgtctcatccaactttcaatttattaattatacatttcatttctaattcgttagtcaactcatatgttgaattttaaaattcaactattttactttcagaagttaatcttttttgatgtttataagagtattttgttccttgcttatgttttaaagtttttttaaatattgaaaacatatttatttataaggcatggttttctggcacactctcggtttttgtagatatagttttattaaaacacaggcaagcccattcatttgcatactgcccatggctgcttttacagtagaatagcaaggctgaatctttgtgacagagactgcatggcttgcaaagcctaaaatgtatactatctggccttttagagaaaagtttgctaaccttgctctacgtgataattccaacccaaagcctgaatgtctgattctactgtttgatgtttctaaccctgtctgatgatgtcttactacatgggtggtcttgtgattttttttaaaaattgtgagctcatttttgttgaggcactagctgtgagaattttatgaggcttgaattggagaacattccttctatttgtgtttacctttgccaagtgtctcgtcattttaaattttttttttggtttgtttgtttaaaatatagtttcagaataggtacacagagtgaatttgaacccaggcttgaggcctgactggtgattatttataatttctggtagggggtaggaacttttattttttcttccaaccaaaatcaaggctaagatgcaaaatcttctttgctatttcctttgcatggcgaacattttctaattcactattttattgggaatgtgggcctttcgggactcattccaaagtctccatgctgacactgcactgctttgtcgcctgcctctcctgtcccccttcccccgacacggatgtaaaaactgaaagctctaatttacaaaacactggcaaatgccctcagggtctgatgcctgctccagtgaatatttaccatgctcattctgaattctggcttccaacttcatttttggcctctggggattaagatactttaatttcttgccaagttagctactcattttatccagcattttaaaggtgctttttgggggagaattttcaggatacagagtctgtcatattgctggaagtaaacatcaggaaatttttaaatgaaaaaaaacacacgattcggaaaatggaaatagaaaagtttcataacattccaacatggttccaagtctacctaatgtttatttatatccgagttatgagtgttgtctctggagtcagacaacctcggtttggaatcaggctctgccgcttactactgctagaggtgagggtgggcaaactttttctgtgaagggctggatggtaagtacagttgtccctcagtacgcataggggattcattccaggacaccccatggataacaacatccatggatgctcaagtcgctgatataaaatggcctagtatttgcatataacctatgcacatcctctcgtatactttaaatcatctctagattacttataatacctaatacaatataaatgctatgcaaagagttactgtgttgtattgtttttaatttatattatttttactgtattgcttttttatttttgttttcaaacatttttgatcctttgttggttgaatcgacaaatgtggaaccctcacatatggagggccgactgtattttgagctttgcaagccatatgcaactactcaactcagccactgtatcacgaaaacagccataattatgtaatgtgtaatgaatgggcatggctgtgttccaataaaactttatttacaaaagcaggcacttagctggatttgaacttcaggctatagattgcacacccctggccttgtacaagttaataaatctctttaagcatcagttgtttcatctctaaaatggagaaaataataactgtgtcatccataggttgtttgagcattagtgaatttgtcagaggcatttgaaccatagcaattccatcttaaataggggtaaaatgagactgagacctgctgggctgcattcccaggagactaggcattcttagtcacaggatgagagaggagatcagcacaagatacaggtcacaaaggccctgctgataaaacgggatgtcataagaaagcccaccaaaacccaccaaaaccaagatggcgatgaaagtgacctctagttgtccttactgctcattatatgtgaattattaatgtattagcatactaaaagacactcccaccagtactgtgacaatttacaaatgccatggcaacgtttgggagttaccctacgtagtctaaaaaggggagggactcttagttccaagaaatctccaccccttttcccccggcaagcttatgaataacccaccccttgtttagcatatagtcgagaaataactgtatttagtcaagcagcccatgccacgtctctgcctatagggtagccattcttctgtttatttctcgaataaacttgctttcactttactctatggacttgccctgaactctttcttgctcgaggtccaagagctctctcttcaggtctggatcaggactcctttccagtaacaaattcatgtaagtgctaatgttagctatgatgtcactgctggaagtgatgatgatgatttgaaaccagtttcttgattttttaagatcataaggtgtctcgtcttcaaatcatttaaatacatccaatgtagcttcctatgctgctactgatgacacacagtagaaagctaacaatactgcagtaacgaacgacccccaaatctcagtggctttaaagaactcagatttaagttttgctcacactacattccatcgcacaggttaatgaggggttctcctcactgtcattcctctggggcccaggctcatcgagcagccaccatcttgaaatcactggtcactacaggggaaaggagctttgaagggtctttaaacaacaattaaatgcttggtctgcaagtgaagtgttatttctgtgtgcagttcacagtcagagttggtcacatctttctctcccactagcttattgcttgggtttctgggcgtgttgtcacagacaagcttcatctgttggctcctccaaggagtgcctagaaattcagagctactcacccagggccatatgcttcccagggcagcccacatccagggaatgcttcctgtgtgggtagaagcccagccctttcagcctgatgtgggacaattttgggatttggctcagcctgttgtttggcaacttgacttctccctctgcccaatcctgctttcctcttttcctttccacagggattgttcccaaggatgttcattaataagcatcctgtacactaaactccatctcagggttcttctccaaaaacccagtcgtgacattcaccatgtgcccaagagagagaaggctggactatctcctgaggaacaccaaggactacctcactcactaaagtgaacacagttagcccttatagatgggagagactaagatcacaaccatgataatagctaatatttattaagcacttacctgccgcatgctgcactaaaatacgttacttggatttgctcatttaatcttcacagtgccctatgtattaaaacaggggattagactagggaatgagaagctacggcctgcagaccaaatctgcccacgcctatgccttatgcattgtctatggctactttcatgctgtaactgcatagctgagttgttgtgacagacactgcatgacccacaaagttgaaaatatttactatctagtccttttcagaaaaggcttgccgaatcctgttttaggtattatttccattttacaggtaacaaaatttaagcttgcagaagtgtgtggtttattaaatcacagaatgtcaatttttagtcatatagatcaaagataaaattctaagtcccccaaccaactgaatggaccccttctcccagccaaggacattccaaagttaatctgaaaaactagttcaggccatgatgggaaaggggcagtcagatacacctcattataccgtccttccttaggaattcaggcacaactgaccagcatcaacattaaaacaggccaggcacggtggctcacacctgtaatcccagcactttgggaggccgaggcggttggattgcctgagatcaggagttcgagaccagcgtgaccaacatggcaaaaccccatctctactagaaattcaaaattagccagtcatggtggttcacgcctataatcccagctactcgggaggcctgaggcaagagaatcgcttgaaactgggaggtggaggttgcagtgagccaagattgagccattgcattccagcctgggcaacaagagtgaaactctgtctcaaaagcaaacaaaccaacaaacattaaaacagagacttaagactgacaaaactgactctttgcagtaataagataccaacgtgacagatagcagaccctgaaagcaactgaagtatattttttttacatattctgaaatggccctgcaaagccgtctcttgtggggaaaatctacattctgtagagaatccccttccctttccaggtcttttccttgatccaggagataattacctgagtctggcatctttttaagtctaataagaaacatttacaatctattttctctgaagcctgctacctggaggcttcatctgtatcagaaaatctttgaatctacctatgacctgaaaaccccctgccccaccccactttgtgttgtcccacctttccagactgaacccatctacaccttacctgtattgattgatgtcttatgtctccctaaaatgtataaaaccaggctgcatccccactacctttggcacatgttctcagggccactggggctgtgtcatgggtcatggtcctaatatttggctcagaataaatctctttaaatattttataatttgactctttttgtcaacagtcatgaagacaaacatttaaacagcagcccccttctgtgatggcaggtgcagactcccccctaccccccatgccactgatgggcctttgtaagtgctcagtgaatgataatgaatgattttcttcccttctcttcttcccaccatccttctttgtaaaatcgaggcctcctcctccatctttgctctaaatcccctcccagacaagttctattttctagagacaagcgtatctgaaattgcaaccctgtggcttctctccaccaagtgaaaaacacaagagacacatcagtttttggtacctttggctataaaacctctggaggaagttctgtttttctgaaaatggctttcttttactggaagagttagggtggtaaatctgtagagcctgagctggctaccaggaaacacttcatgatggctgagaaattattccgcatgctgaaccttaaagggataacataaaatggcagtcttgacagaccccttagaatctaacgctgagattatctgtttccaactgcttccagctgagaagtggctctcagggcagcaatgagtactcaaaagcattccctcatagaagtgattgttcaagggggattcaagagtttaattccttaatgcccatccggctgtttcctagattcttccagaacatgggccttatgcccctaaattcactcccatacctagaagcagaactgggaactgagcccaggttgtttgataccaaaatttgtgcccttaaccatgcatttcactcccttctggtacacaaatatccaggatcatgtatttactttttacagatactgttatatgtgctcatgtaaattgtctggcaattagctgcaagaggattgtaggaagagattctacctatccatctctttacaccatgccttctgaagagaagattttcggagagaatccttggatttagtcaggaatattagatccctaaataaaaatgtctaaaatcctt

SEQ ID NO: 929 - DNA, 19009 bp, Homo sapiens
gtctccctctgcccacccacctgcacctgacagctgtgggctgtgctctcagggaggcaccgtcagatgctaccagactacagaggagagcaccctcaatcctgactgaaggtttgggaaaaggctgctcagaagaggtgatacttgatatgggccctggaggaggagaagcagtttgagaagacagcagtgagagatggcatccgggcaggcgagaaatgtcagtggtcatggaggcagcatgaagggactgttggctgcagaaacctggcaaggctcttagagacagagacgaagagggagatggggctggagatggagatgatagagacagaaagattgaagatggcagagtgggggctatggggaagggtgatgaagcaggaaagatagatcgaacgagactgcgaggagcctgtgtgcctgggctttattttggaggcaatgagaaacagaaagtgtttttgagcatgatgggacaatgaggagttctgtggtttaggaaacccagcagtcacgggaagtgcagattcaaagtaagaaaacgtcccagggtttggtgatgatcttggtgggaagtgacacaggggtagtggggatggaattgaaagaaaggatgaacttccagagtatggctgtgctcagtagacaggaatcagggagggcaggaggagagtaaaagggtcctctgagcttaaatccagatgttgaggagatggtggtactatcaatggaggtggagctcttaagaggaagaaagatgggaaagaaaaggatgaggtttttgacaagttgaatatggggtgagcatgggtccaactgaaagcagtggaaatatagacgtgaaaaatagatgcggtagagttgaaaagttggggataattttcacctgaatgttacctaaggcaaagggaagagaggtcatccaggacaaaagtacagaatgaaaagaaaaagcaactaagcacgaaatcttggagaatgtcctcattgaagggtgagcagatgaagaggagcccacaaaagagactgaggaattgtcttcattcactcattcatgcatgtattcatttggtcaacaaatattttttggcacctcccatggacaggtcctgagcaccaagggtacagtcagaaatgatgaatccagaaatgatgccctccagaacttctggtgaggaaggcactcaggaaaatgcagcaccctatggaggcccagaaaggagggcattcaggaagaacacagtctgatggtgtcaagtgcagcggaggctaagaggtagggaggaaaagatggtaaaaggagagaactggggaggcaagagggacaaatgagggagaagagaagggagaggaaatacaacagaggcacagagtggggatttgtctgattcaagaatcctaggcggggcgcggtggctcacacctgtgatcccagcactttgggaggccaaggtgggtggatcgcctgaggttgggagtttgagaccagcctggccaacatggtgaaaccctgtctctactaaaatacaaaattagctgggcatggtggggcgggtgcccatagacccagctacttgggaggccaaggcaggagaatcgcttgaacccaggaggcagaggttgcagtgagccaagattgcttcatggcactccagcctgggtgacagagtgagactccatctaaaaaatgaaagaaaaaagaatcctatgttctttcccctggccttaccttagaaagcagagtgaatgccgacctaatcaggtttacctccattgccatagcaacctctgggactcactttggtgcacattcttgagacctgaagtgaagaagttaactttatatcaagttacctaccaattaggctagcgatttctctgtcttttaaaacattcttttaaagtcttgtcatgtttcatctttctagaattcatttttcacatcttcattcactgggattctggaccataatatatgtaaacacacaaaatactaaagattgaaaatacaattattctgttttctgattattaaagtggtcattgttaaaaaaaaaagacttggaaaatacaatataaagtagaaaatacaaatcactcatttccccaccactcttagtattctgttgtttttcttcccaatcctgtttctagacacatttgatgacatttaaacatatttttattgtgaatatacagtttcatatatggttttgtttgctaactaattatatcatggacatttccccatgccactaaaataactataaaatcatttcattattcataagcttcacattttagcccttcctctattttaatgcagcaattgtccacctttatacataaatatttgttcctgaatcttaaaagtagtcaaattcgttcacacttcaaaattatttttgtatttactttttcttagaatctttgtgtttaatgtctcattcatttcaaagagcaatattaatacaattgaaagtgatcacagcatcttttgtctccaaatgcaagttattttgtaatgtgatctaattttattttgtaaactccattattaagaaatttgacccaaatttgagaaatgatagttactcttgactcataccattcagccctaggtttccatcaatgcttgtttgaattccatgggtatagcactggtggaactgctttttcagatttttagatttgtcagagaatattaatccttaacctaagttttttttccctgatttctctctttacatttatttgttttcttagtttcattatgatatatgaaactaacatatcctttgtatgaggattcagtggttacatctgaaagcaaacaggaagttattattttgcttgttagaaaaattcacttcccttaatgtagcttttcccattattttactctcaaacatttggtgtacttctgttttacatgtgtttcttgtaagaagaatatggttggatttttaaaaattaactatcttttagctgacaagcgtaattcttttttatttaattatgatcattgatatatttggatttattttcaccatctttttacactttctatttgatgaaattcctactccatttttttctcctccaatattttggaatgtatagattctaattttttaatagttaaagttattaattagattcagcctccttctaaaacctagagtattttaactctttctcagcttataagctagtattgtccagtattttatttctattaaaaagtcttgtgaaatgtatcatatatagaaaagtttacaacatgcatgtatgtatatgcatgtttgcgtgcgcgcacgcacacacacacacacacacacacacacacatacattcatatatttaccattttaagaaatagactatgacctctgctttagaagctcatctctcccaacctctgacttttataactttacaagttagatttattagtgttgatatttatttagatgtatccatgtgactacaaatgtctttgatcacgtggttatctttcttacaacttacagttcacatctcctttctggagaagtatatatatccttctttccaaggtatatatatcctcaagaagttcctttactaagaatctgtccagagtaaattatcttggcttttgttcacctaaatatattctattgcatcctcatgaaagataagttttactgggtatccaactgtaaattgaaacatttttcctagcactttgaagacatcatcttgtaatcttttggtttctgctctgttcatatgaagttagatgtaaaacaggaaagctgtctttttctctagctgtttttaagctattaaatttgtctttaatgttctttcatttcaccaggataagtctgggtgtgaatattttttagaattttttgtacttcctaaatataaggaaccatacaaattattgaatattgtttccatctcattttctctagtcactctttctggaactttcattagatgaatgtgaacacttcttaaactttcatgtgtatatcatgatatcctttttctctctctcaactatattctaagtcgttttgtctcatccaactttcaatttattaattatacatttcatttctaattcgttagtcaactcatatgttgaattttaaaattcaactattttactttcagaagttaatcttttttgatgtttataagagtattttgttccttgcttatgttttaaagtttttttaaatattgaaaacatatttatttataaggcatggttttctggcacactctcggtttttgtagatatagttttattaaaacacaggcaagcccattcatttgcatactgcccatggctgcttttacagtagaatagcaaggctgaatctttgtgacagagactgcatggcttgcaaagcctaaaatgtatactatctggccttttagagaaaagtttgctaaccttgctctacgtgataattccaacccaaagcctgaatgtctgattctactgtttgatgtttctaaccctgtctgatgatgtcttactacatgggtggtcttgtgattttttttaaaaattgtgagctcatttttgttgaggcactagctgtgagaattttatgaggcttgaattggagaacattccttctatttgtgtttacctttgccaagtgtctcgtcattttaaattttttttttggtttgtttgtttaaaatatagtttcagaataggtacacagagtgaatttgaacccaggcttgaggcctgactggtgattatttataatttctggtagggggtaggaacttttattttttcttccaaccaaaatcaaggctaagatgcaaaatcttctttgctatttcctttgcatggcgaacattttctaattcactattttattgggaatgtgggcctttcgggactcattccaaagtctccatgctgacactgcactgctttgtcgcctgcctctcctgtcccccttcccccgacacggatgtaaaaactgaaagctctaatttacaaaacactggcaaatgccctcagggtctgatgcctgctccagtgaatatttaccatgctcattctgaattctggcttccaacttcatttttggcctctggggattaagatactttaatttcttgccaagttagctactcattttatccagcattttaaaggtgctttttgggggagaattttcaggatacagagtctgtcatattgctggaagtaaacatcaggaaatttttaaatgaaaaaaaacacacgattcggaaaatggaaatagaaaagtttcataacattccaacatggttccaagtctacctaatgtttatttatatccgagttatgagtgttgtctctggagtcagacaacctcggtttggaatcaggctctgccgcttactactgctagaggtgagggtgggcaaactttttctgtgaagggctggatggtaagtacagttgtccctcagtacgcataggggattcattccaggacaccccatggataacaacatccatggatgctcaagtcgctgatataaaatggcctagtatttgcatataacctatgcacatcctctcgtatactttaaatcatctctagattacttataatacctaatacaatataaatgctatgcaaagagttactgtgttgtattgtttttaatttatattatttttactgtattgcttttttatttttgttttcaaacatttttgatcctttgttggttgaatcgacaaatgtggaaccctcacatatggagggccgactgtattttgagctttgcaagccatatgcaactactcaactcagccactgtatcacgaaaacagccataattatgtaatgtgtaatgaatgggcatggctgtgttccaataaaactttatttacaaaagcaggcacttagctggatttgaacttcaggctatagattgcacacccctggccttgtacaagttaataaatctctttaagcatcagttgtttcatctctaaaatggagaaaataataactgtgtcatccataggttgtttgagcattagtgaatttgtcagaggcatttgaaccatagcaattccatcttaaataggggtaaaatgagactgagacctgctgggctgcattcccaggagactaggcattcttagtcacaggatgagagaggagatcagcacaagatacaggtcacaaaggccctgctgataaaacgggatgtcataagaaagcccaccaaaacccaccaaaaccaagatggcgatgaaagtgacctctagttgtccttactgctcattatatgtgaattattaatgtattagcatactaaaagacactcccaccagtactgtgacaatttacaaatgccatggcaacgtttgggagttaccctacgtagtctaaaaaggggagggactcttagttccaagaaatctccaccccttttcccccggcaagcttatgaataacccaccccttgtttagcatatagtcgagaaataactgtatttagtcaagcagcccatgccacgtctctgcctatagggtagccattcttctgtttatttctcgaataaacttgctttcactttactctatggacttgccctgaactctttcttgctcgaggtccaagagctctctcttcaggtctggatcaggactcctttccagtaacaaattcatgtaagtgctaatgttagctatgatgtcactgctggaagtgatgatgatgatttgaaaccagtttcttgattttttaagatcataaggtgtctcgtcttcaaatcatttaaatacatccaatgtagcttcctatgctgctactgatgacacacagtagaaagctaacaatactgcagtaacgaacgacccccaaatctcagtggctttaaagaactcagatttaagttttgctcacactacattccatcgcacaggttaatgaggggttctcctcactgtcattcctctggggcccaggctcatcgagcagccaccatcttgaaatcactggtcactacaggggaaaggagctttgaagggtctttaaacaacaattaaatgcttggtctgcaagtgaagtgttatttctgtgtgcagttcacagtcagagttggtcacatctttctctcccactagcttattgcttgggtttctgggcgtgttgtcacagacaagcttcatctgttggctcctccaaggagtgcctagaaattcagagctactcacccagggccatatgcttcccagggcagcccacatccagggaatgcttcctgtgtgggtagaagcccagccctttcagcctgatgtgggacaattttgggatttggctcagcctgttgtttggcaacttgacttctccctctgcccaatcctgctttcctcttttcctttccacagggattgttcccaaggatgttcattaataagcatcctgtacactaaactccatctcagggttcttctccaaaaacccagtcgtgacattcaccatgtgcccaagagagagaaggctggactatctcctgaggaacaccaaggactacctcactcactaaagtgaacacagttagcccttatagatgggagagactaagatcacaaccatgataatagctaatatttattaagcacttacctgccgcatgctgcactaaaatacgttacttggatttgctcatttaatcttcacagtgccctatgtattaaaacaggggattagactagggaatgagaagctacggcctgcagaccaaatctgcccacgcctatgccttatgcattgtctatggctactttcatgctgtaactgcatagctgagttgttgtgacagacactgcatgacccacaaagttgaaaatatttactatctagtccttttcagaaaaggcttgccgaatcctgttttaggtattatttccattttacaggtaacaaaatttaagcttgcagaagtgtgtggtttattaaatcacagaatgtcaatttttagtcatatagatcaaagataaaattctaagtcccccaaccaactgaatggaccccttctcccagccaaggacattccaaagttaatctgaaaaactagttcaggccatgatgggaaaggggcagtcagatacacctcattataccgtccttccttaggaattcaggcacaactgaccagcatcaacattaaaacaggccaggcacggtggctcacacctgtaatcccagcactttgggaggccgaggcggttggattgcctgagatcaggagttcgagaccagcgtgaccaacatggcaaaaccccatctctactagaaattcaaaattagccagtcatggtggttcacgcctataatcccagctactcgggaggcctgaggcaagagaatcgcttgaaactgggaggtggaggttgcagtgagccaagattgagccattgcattccagcctgggcaacaagagtgaaactctgtctcaaaagcaaacaaaccaacaaacattaaaacagagacttaagactgacaaaactgactctttgcagtaataagataccaacgtgacagatagcagaccctgaaagcaactgaagtatattttttttacatattctgaaatggccctgcaaagccgtctcttgtggggaaaatctacattctgtagagaatccccttccctttccaggtcttttccttgatccaggagataattacctgagtctggcatctttttaagtctaataagaaacatttacaatctattttctctgaagcctgctacctggaggcttcatctgtatcagaaaatctttgaatctacctatgacctgaaaaccccctgccccaccccactttgtgttgtcccacctttccagactgaacccatctacaccttacctgtattgattgatgtcttatgtctccctaaaatgtataaaaccaggctgcatccccactacctttggcacatgttctcagggccactggggctgtgtcatgggtcatggtcctaatatttggctcagaataaatctctttaaatattttataatttgactctttttgtcaacagtcatgaagacaaacatttaaacagcagcccccttctgtgatggcaggtgcagactcccccctaccccccatgccactgatgggcctttgtaagtgctcagtgaatgataatgaatgattttcttcccttctcttcttcccaccatccttctttgtaaaatcgaggcctcctcctccatctttgctctaaatcccctcccagacaagttctattttctagagacaagcgtatctgaaattgcaaccctgtggcttctctccaccaagtgaaaaacacaagagacacatcagtttttggtacctttggctataaaacctctggaggaagttctgtttttctgaaaatggctttcttttactggaagagttagggtggtaaatctgtagagcctgagctggctaccaggaaacacttcatgatggctgagaaattattccgcatgctgaaccttaaagggataacataaaatggcagtcttgacagaccccttagaatctaacgctgagattatctgtttccaactgcttccagctgagaagtggctctcagggcagcaatgagtactcaaaagcattccctcatagaagtgattgttcaagggggattcaagagtttaattccttaatgcccatccggctgtttcctagattcttccagaacatgggccttatgcccctaaattcactcccatacctagaagcagaactgggaactgagcccaggttgtttgataccaaaatttgtgcccttaaccatgcatttcactcccttctggtacacaaatatccaggatcatgtatttactttttacagatactgttatatgtgctcatgtaaattgtctggcaattagctgcaagaggattgtaggaagagattctacctatccatctctttacaccatgccttctgaagagaagattttcggagagaatccttggatttagtcaggaatattagatccctaaataaaaatgtctaaaatcctttccccattctttgttgttgtttttgagatagggtctcactctgtcacccaggctggagtggtggtggtgtgattacagctcactgcagcctcaacctcttaggctcaggtgatcctcccatcttagcctcccagtacacccggctaactttttgtatttttggtagagatggggtttcaccatgttgcccaggctggtcttgaactcctgagctcaagcgatccacctgccttggcctcccaaaatgctgggattacagacatgagccaccgtgcccaggctgttttttatttgtataaatttaaggggcaaaactgcagttttgttacatgggtatatcgggtagtggtggagtctgggcttttagtgtggccatcacctgaatagtatatgttatacccattaagtaatttctcatcctcattcttggttccttaaaaaacaactggccctcaaaaacgtctagggaatggtgtacaaatgaacgaatgagtcaatggatgaaagaattaattaatcaatctccagacccttgacaacttaaggatcttgggcacagtttatgctcatgataaacaaacaaaaaaaagatagtcagcagttttcttattgtgacataggcatcagaaggttcacaatcattcatttaacaaacactgaaccttgaccatgaattgcacaccgtattaggcacggaggacgtgacacgcaaggtctctgtcctcagcacaggcaggactccagagatgaggctgaagcatggaacgtagtgtggccacaggaagcttcacctggggctttggccagttgctcatatgtaaggaatagaacatagggagacatacaaagatagaagataccctttctaggaagtgaaatgggagtgcaacatccaggtcgaggattgggaagggttaagtgtaaggttctctggcagctggaagatgtaacccgatccgtctcagcagtagctttttaaacctgggctttaaaaccgggaaacctggaggaatcacagacgctgggctggttttactggtctcccctctctgcttagaaagacagctcatgccttgtatagctaatgtttctttggtggtgagagggacttctgtatattgctcagtttatccatattgtgatgatttgtactagttgcaattctcagagtatgtcctgatctccacaaacgggaagttgagaggacaacaaaagagagatgttttaaaagcactattttaatgacataattctgtaaatattacagtgtttagacacaaatataacaggattctttctacagaactttttaaaccattaatttaggattaggaaactcccctcactccccctagggccactgcttgatttggttaaagcaacttaattcaggttagggtaaaatttaagcaaactccattgctcagcaaaatgctgcctgaaaacagctaaagacaggtcagaatgtccctaaccaaacctcaggcattattaaccaagacctgccttaattctggtttatctcatgatgaccaaggagaaaaaagtcttcccctgctagaagtattctatgtctatcacaaagcaaggattgtgtgttcaatggtcataagagaatggataatatacataagagtttagaagagagagtaaactgaagttaaggtcatttcaaagggcttcatggatgaaaggatctcaaattctaattgaaggagaaggaagacttagttgaggaggtgagagaatttcagaatgatatgaagggaggcttggaagcagcaatttgggtgtcatatttccacagactagtgactgatcagggtctttttttttccttccaaagagtgagaagaaaaatatgaggttggtgcaaaagtaattgaggttttgcaaagtaatggcgaaaaccgcaattacttttgcaccaacctaaataggtagataaatgtagttggaacagaaggtttatttgaggatgtagcccaagattaggttgaaaaattaagaaggaggcaatctgtgatgggccttaggttttagaagagcagacgaggccaggaattgatatgtagaagtggaatagtattttttctcctagttttcttctgtttctagattgctttggtcactatataatgtctttctcagtttgaaggcagacagaaagattatcgggaaaaaaattaggatcaagtgttaaactcaggcagcatcatgttctagtgctattgggtgaaacttctaatgtagacaaacgatataacaattttaataactccctgaaatttaagtaaagaagcaattctaggccaggcgcggtggctcatgcctgtgatcccagcactttgggacgccgaggtgggtggatcatctgaggtcaggagttggagaccagcctggccaacatggtgaaaccccgtctttcctaaaaatacaaaaattagccagtcacggtggtgtgtgcctgtagttccagctacttgggtggctgaggcaggagaatcacttgaacccaagaggtggaggttgcagtgagccgagattctgccactgcactccaggctggcagacagagtgagactccgtctcaatatatatattatatattatatatattatatataatataatatatataatatataatatatatataatatataatatataatatatataatatatataatatataatatatattatatataacatattatatatattatatatattatataataatatattttatatataatatataatataatatataataatatataaatatataataatatataatatataatatataataatatatattaatatataatatattatatattaaatatataaataaataaataaatatatataataaaagaagcaattctagcaactcaacaacatgaaagacactgaagttgaagcaaagcaggaggttccttttaaaactggatcacaatttatagatagctgtatccaaatagagagaacatgattgccatccagccctcaaacaaccttacaggtgtctgggcacctttgaactgaaatttaagcagggaagttccaatgactgaatggaacgtcaaagaagtgtttgaaactgaaataccaaagtaaaataaaatttggaggccttttggtgatccgaaggcaagtatttcatagatttctctgttgaggtgcatctcattttggtgtgcgtccaagtgttttccaagatgcaaactccttgagagcaggaacatatttcctttatgcctcattgaatgcaggccaaccagtggcctgatgaggtttggagggtgtgaatgacaagtgtaaataaaattgtgttgacagctatttaattatcatgtagtttcatgtttaatgttcaaaagttctgaataaatgagcataacaaatctcagtgaaagctaaattaattgacacattttggctagctgcagagagccattttgctgtctttaggagtccccacggtgtgatactcatcttgattatgtaaggcaagtgaggaggggaaaggaaaactttattttttgtgagttccctttttgttgattgacacctctaaatttgtagcaaggcagaccatgcccctgacccattttcctctgatgggtcttgtttcccaccctgtagttcctttttttttttgagatagagtcttgccctgtcacccaggctggagtgcaatggcatgatctcgactcactacaacctccgcctcccgggttcaaacgattctcctgcctcagcctcccgagtagctgggattacaggcgcccaccaccacgcccggctaatttttgcagttttagtagagacggggtttcaccatgttggccaggctggtctcaaactcctgaccttgtgatccgcccacctcggcctcccaaagtgctgggattataggcgtgagccaccgtgcctggcctgtaattcctttttaatacctgcttcacatgcgatgatttgttcaggatctatttacaccaggaggctgtctgctcccagtggacagggtctgtattgccatggccaggcactgagggccagcacgagggcacttgctggtccaggggcaactttgggttgcaatctaacaacatattaattctaacttctccatctaaaatggaaatctgttctgaatttgctgtaaagtttctgtggaagctagctgaggaccctatagttgttcaacaaatgtttgttatatgaaaacaaaagggaagggaagggaaacgctggggtaaacctcagttctacttgttgctcattcctgggggtacgtcatctttttctgcaaagcagacctgtttctaccttgctcacacagcttggtagacagacactaacattttcatcacatgagcccacatgagcctctgctttaattctgcatttgtaaagcttcatgtttttttctcatggaagtagagtcataggtggaggaggtcacacgtttctaaactccctcacccctacttttttttttttttgatatggagtcttgctctgtcacccacgctggagtgcagtggcgagatctcgactcactgcaacccctgcctcccaggtttgagtgattctcctgcttcagcctctcaagtagctgggatgacaggcgcccaccacaacatccggcctaatttttctattttattttattttttttttagtagagacagggtttcaccatgttggccaggctggtctcgaactcctgacctcaagtgatccacccgcctccgcctcccaaagtgttgggattataggtgtgagccaccgcgcctggccccccacccctaccttttgatgaaatggttaaaaatacaaaacaggactgtgtgagtgaataagctacctatttttgggcagtcatgaggtgaagattccattcttggcctgctgcttgtgtaggagaacacgagacttcctgtccctaccactttgtgtgaggtatggggcagccagccacactgtgctagcacctaataaggttgcagatttaattctagcccaaatctggacaaactgatgttcaggttacagctagctgatgttcagaaaaggctgccagaatcctaatgagcagcctgaggaaatggagccgtagattctgtttaaaattctctcctttcattttttcattttctccatctacatctctgtctgctccctttctcattcattgctttctgcttccttccccctttctccattcattcctcttccttctttgcctctatccgtctttctgcttttctttctgcctttctgtctttcccttctcaccctctctctcctgcttcctctcctctcactttcctttccctcagtctctctcttgctcttgctctttctctctcttccttttatctacagcctattggcttctcatttcttttccttctcccctcccattttctttctaagaatttcttgatgaaactaaaagaggactaaaaggagctccatgaaatgcttgcctggaagaaaacatggctggatgctcttctgatcataggcagccactaaatttgatttgtagctgatcttaaatgtaggaaaagattttcaattacaaaactcataaagtgtaaagatgagggaaactggccatgctttgagtttgactaatggtctcaaagcgctttaaaatgtttggcatttgccagcctttctttcttctcctaatcctcaaactcatgagtttttatgggaaacataatcctcttttctgattcatttacacttagctcatctgagtattgttttgtaaaaaccatctgaagtccaagaagttttatgagatctttaaaggcttgttttttgaaccaggaagttgtgtactgccaacataaatggaccttgaactctaggggggtttgagtccagcatccatagcattaaactgggtctagaattggcaaaggcccatcctcatggctgacagaaactgggctttcaccttcagaataatagtgagttcagtgtttgggatgagtgaccatctcagatgatagtacatggggtgcataacaggtttttcaaggattatcttgctagttacgtaaatagcaagagacttatgtggaaacctgtgattttgctggagtctcccaactacagagtcgggctgcttgctcatgtgtatatttccatattaattgtgtgcatacacacatacactaatgtgtagacggatgggttaacattcacactagagatttatttttgtatttaaaaaattttttttagttttagtcttattatttttttgagatggagtctcgctttgttgccaggctggagtacagtgacacaatcttggctcactgcaacttccacctgcagggttcaagtgattctcctgctttagcctccggagtagctgggattacaggcatgtgctaccatgcccggctaattttcgtatttttagtagagacgaggtttcaccatgttggccaggctgttctcaaactcctgacctcaagtaaactgcctgccttggcctcccgaagtgctgggattacaggtgtgagccactgcacctggcctatttttatttttttcagagttggggtttcaccatgttgcccaggctggtctcaaactcctgacctcaagtaatctgcctgccttggcctcccaaagtgctgggattacaggtgtgagccatggtgcccagcctcacactagaggtttttttttttttttgtttttttttttgtttttttcctgtggttttgtttcagagatgatctgattgtgatatatccaaatctgtcataaggcaggttgtaattgggttaaagattggtgtgaaatgcccacctcgccattgctgtgggttgagaggaaaactgcattctgcattttttaatggttaaaaaacatttttctgcagagccaaagggcctggttaaggtcatttctcccccaaacactaggatctcaggcagagtcccaggccttctggaaactgaggctcagagaggtgaaatgtcttgctcaagtttccacgggaagttgatatggtttggctgcgtcccttcccaaatctcgtcttggattgtaatccacgtgtcgtgggagggagccggtgggaggtaattaaatcacgggggcggttaccctcatgctgttctcctgatagtgagctctcaggagatcagatggttttttaaggggctttcccctcttttgcttcggcacttctccttgctgccgccatgtgaagaaggacgtgtttgccttccccttctgccatgattgtaagtttcctgaggcctccccagccctgcggaactgtgagtcaattaaacttctttcctttagaaattaaccagtctcgggtacgtattagcagcatgagaacatactaatacagaagtaaagcagcaggtagagcccagccccctagagtccccatccaggctgtgccctccacaggtagctgccacttattgcccaaaagcagctttaatgcttgccatctgtccatctggggactgggagtgaccaccactgaagacaggtagaggctggtcctgttggggatgctgtcctttactctttcctgagctttcctctgtctgacatctctcctctcctgtcctggctctgcagaatgttgtagctatgctaatcaccctcctccccacctccaaccatttcatctgctgttacattatccctacctgagaggtaagagctctgtgaactgatctgagttgcaggtaggaagtattttccctacatgttggtgaattttccataagatgacaaagaattgtgggctgtactatgatacaggcatcatacaaatcaggtcctcccttgtgagaggtctatcatgatctcaaagtgttgcttcattaagttgttatcatttttaagctttcatttacatcttctctccctaacaagacacgaagtttcttaaagacaagggctttatgccttgtgatcctttgtatttccacagcctcagtgcctccttcagagatgcggtggatattagcttctgttgtatccttcatacagaacctggtgctgagagacagcttcttctttttttttttttctttaaacttttcttaagactagtcaagtacagtatcaagaagacgggaaagagtagaacaaggaattggatccgtaactgactgtgaacaatcaattgaggtaactcattacctttgaaccaacctgggaggcagccttgtgactcacctcaatcctcaatcttctcagctagttcactttggcctggctcaggggctgacctagaatgatcctgtccagaaggaccctggatgttcttagagacacagactgctagggctggcagggacttttcatccaattcctctgtgacagaggaggaagtggaggtgcagaaggagaggtgagctgcctgtggtccttcagcttactaatggcagtgttaggactggacctgagggctcttccctccagtccggcgctatttattccatgacagtgcctctcaaactgtgttctcacaagcagctagtgctcaggcagctggactgaggccctgcctgccaaatcaaatattggaggtctttctccaatgtgcagaaaaaaaaagtaattaatgggttaagtttccttagggttaaattatttttccattaatgcttcttaaaccattgtcacctgctaccaattgtctactagccaatgcatgcaggcaacaaaacaaaaggataagccacaagtaaataagaacaagaacaaccaaagccttggaaacacaccatcattcttaagttaaaggcttaaaaaaaaaatagaggaagactgctatgactgtggactttctattgcattcacataataaaatcatgcgacattgttttgaattcaa

SEQ ID NO: 930 - DNA, 452207 bp, Homo sapiens
ggtcgcgcccgctggggcccgcgatggcgggggcctggctcaggtgggggctcctgctctgggcagggctcctcgcgtcctcggcgcacggccggctgcggaggatcacctacgtggtgcacccgggccccggcctggcagccggcgccttgcccctgagcgggcccccgcgttcgcggacattcaacgtcgcgctcaacgccaggtacagccgcagctcggcggctgccggcgcccccagccgtgcctcccccggggtcccctcggagaggacccggcgcacgagcaagccgggcggcgcggccctgcaggggctcagaccgccgccgccgccgccgccggagcctgcgcgtcccgcggtccccggcgggcagctccaccccaatcccggcggccacccggcagccgccccgttcaccaaacaaggcaggcaagttgtgcgctccaaggtgccgcaggagacccagagcggcggaggctctaggctgcaggttcaccagaagcagcagctgcaggggtaagcccacacccccttccgcccgcccgcccgcctcgcgcgcaccgcccgcggagggacctgcggggtcagggccactcggagccccgcggtggccagggcggtcgcgcgcggtgggtcggctttctcctcccgcctccgcctgctctgggcgccgcgggaagaggggagtgcggggaagcccaggaacttttactgacgtgaaactccgagtgcattgttaccgagctgcgggtaaacacaaaaggcatttctgcctggggcgtaaccttctgcgcgcaaacccaactgcttctagaagatgggcgtaaacttgaggtcactacagtttaatccctcagcatcaattaaactctgcaactgagttttaattttggtctagctaatgaaaaaaatgtttcgagggcgggctagccgtaaagatccagctcctgttctgtggcctggaactttgcagcatcagagaaatcatgggcttggacttcgctgcacctgtggggtctgctttcctggggtggggtgtcttggtattgataaaagttttggttggaatgtttctgttactgggcgctcatagtgccttcccgttgtgggaattcatctcaggttggggtgtaggggaaaacttgttttgcttagttggcatgtttttttcaggggtgattccaggccatgtgccctcactcctttttggacagttctctctgaaactcatttccaatttaaaatgttggcccagataatagaaaaaataaatttggctctactgtaatttgggggtaagaaaaccatttgttgggccctgttctcccttcctgtatagccctaggtttatgcaggctttttggttctcccagcattccctgatatatgtatgggccttgcccctctgcttgggcagctttgggttgggcatccagggtacctgttaggactctctctcatccagagggttgcagaagctggaggctggcctttctggaacatgctggaagcttgggttcttgggaagggggtctttctgctgctggactcagcgatcttgctttgtttcagggtcaatgtctgtggagggcggtgctgtcatggctggagtaaggcccctggctcccagaggtgcaccaaacgtaagttgccatgttcacagtggccctgcacagtaggcaaagtggggggaggtgtccacatgggggcatctcacaagggccacttgaaagggctcgggggaagttgaagtctgaaatacaatccacccaggcttcattaccacctaggaagggctgggtcagggtaatgttagtatcaatgccagcagcaatacattgtacagaaccgtgctgtgcatccaagacttctctgaactcaacagagatattcatcattctggcacatctgtgaatcaggagctaggaaaaaaatttccatttgaggatatgccatatggcagaaccaatgtaattaatttgaacatgataccaacaaatgaaagacattctttacggtgatggcaggaggggcttggggagtagagggccctgttctggagtacaacatcaaagtttttatagcttcctgaaaacagcaaccagaatccttcatccttgaggcctgatggttttctagaatgcacttctctgctgctcttcagaactgatggatggggttctctgcagtgcttctgcagttcacatgcatgcccagcagtgttttttaaaaaatgtgttaatgatgcatacagatttcagaacactggaaaatttttctcctatgcattgtgaaattaaagatcagattaaaatgtattttgaggttcttcttgacgaattgatgctatcgggtgctcattggacataaaggagccttaccttccccctcagaaaaagtgaagcattcttagttgttctttgcatagagattgaggcattcccatgtggattggaattgtccaaaatttctgctgcttggattttaaaatacaggtggatgaattttaaaaattttggatacagtcaatctggtgaccttgtttgttgaaaatgtcttcaatcctgaaggaaacagaagggttttggcataatggccttacttttgtaaaaagggaaatgtccacaggttttatgatgtgttatgatcaagcagtaattgcagacatgaacagtcttctgactattgaactcaaaccactagatcagaaatgctcagggttctaggcattttagattaagtcataatttttcattttgtaacttcttaaattatacttgtcagaaatgtgttagcatttgtttagaatttagcattgctcaggccaaatgacatgtcccctctcccctcagtaactcattctgtccaaaacctgctatgatatggtttgcctgtaacatggagataactcgtctgttaacagcaccactgcaatgggatattgctgagtaaaggttaaaaatacggaatagggcctggtgcggtgactcatgcctgtaatcccagcactttgggaggccaaggtgggtggatcacttgaggccaggagttcgagaccagcctgggcagcatggcaaaaccccatctctactaaaaatacaaaaaaattagccaggtgtggtgttgtgtgcctgtaatcccagctactggggaggctaaggcaggagaattgcttgaacccaggaggtgaaggttgcagtgagccgagatcgctccactgcactccagcctgggtgacaatgactctgtctcaaaaaaaaaaaaaaaaaaaaattacccagacatggtggtgcatgcctgtaattgtaatcctggctactcaggagtctgagtcaagagaattgcctgtacctgggtaggggagattgcagtgagcagagattgtgctgggcgatgcagagagactccatctcaagaaaagaaaagaattcagagcaggattttacagataggcagaagctccttgatgcctgttggagagaatgctcaaaggctttaataagtttgcttggcaaatgatgcaattgagtgctgtctctgaaaagaggataggcccccattttcaggttgcttggggaattcggggatccaaagatgttctagaagatcccaagatgttccaaatcttggggaatctcttcatggcttcctgcttctgcaggcaagagaggcaaagaagtgggtgcctaggtttagctgggtttgccccctggtaatccagagagagatcacagaagactgctggtcagaaaaatcagtgttgaagttacttacagggctctagaggaagttgctatgttggtttaatcttacggtacctacaaccaatgcttccagcatttggcttaagttttcctgctggcttctaagaggtagcccttggacagtaccagcatctaagcaatgtgacatcactttccttttctgtggttttcagcattcagaagattaaccttcctgtacttcccagtttaacaaatgaatttaggtacaaatgctagaaacttaattcacagctctcttcagaaataattatgtttttaaaaggcatgctggggtaggtcagcgtgcgatccaaaataatgtatctctgaggtggatatttaaaagaggggacttactttgcatgtgtctgggagatccagggagctgagagagccttctaccttcagatgggaccactggggctcctgctgatgctataaaccttgtgtccatggctgagtagtgtgatgccaggaaagacccccggctttggggtcagaagacctaaattcaaatgctgcagccctcactagctgtgtggcctcagggagttcacttgacctgtctggcctgtattttcccactcagaaatgactgtgctaaaatcttgccttctttataggatggttgcaggtattaagatgaaaaaaaatgggtatgaaagccttggtgaaaccagaaagattaatattagagattagtattggatcaagccaagtaaattctatctcctttgtcgatgatttggttttcttctgtttgtggtttcctcctctcacttccttattatgcggagattgaacaattacacttgggtatggtttattacacataagaatacaaaaaccaatgatacgcccacatgaagttcccccttataatagtcatcataaaatatgcatggacatttaaatgtataacccaggatgtcttctaattgtcattacatgttgaagataatgaagaatttgagtttatataggtcatgtgcaattgatgcgaaaaaaatttctgtgtaagaggttggaagtgttcatgttgttcagtatttgcctaatccagtgaagaaaataaggtatccctttgagaaagcctggattgtttttagttgattgaaacctaatttaaatggaccatgatcaaatgcttctgaagactaaagatttagtgaaccttaaattgcaaatcagagagatgtgaacaagcaagcggcagactcacacaagggcaaagaatggatatgtgcactcaccaaagtggtcctctaggctgtagctgcccagtcacaatgtagagatgcctggttgcatgttaatgttccttttccagacaccatttgtatgtggatccctaggaatcgaaattatcgtgtgggatgtgtcattttagttaatattggatgactcttgatagccttacctgttttggacaaaagagatggagagatggaccacatttgtgctctttccaaggaattaacacttaaaggaatgttttgtgggttagggactttgtcttccaagtggggcattaaacccctgatgtgtaacatttttgcctcctatcatttttgtagttttttttttctgcgcccaaactgaacctccccccatgccctgcattggttctgccagtctttttgcccccgtctcagggtaagtgcaggccagacagagacattgccggtaggctcagctttaatgagaagactggacacgggaataggcaatacaaaagaatgaaagagaggagagtgaggctgggctggcagggttatggggtagagggaagagagatgatggcagatacgaatccaaagcgggtgcctggcacattgcaggccttccatacacgcatggatggttctttcatttactgtttagcttttaccatgtgccaggttctatgaatagaggagaaacacagccagctgtagggagtgcaggtctgtttttactcacttaactcgtggcacatcaaatgacttgttctctccttagaaagaaacagaaaatcgatattccattgcttttccattggcattcagcccatgctacttttggggaaaaaacccaactctagacattttccttaaattatatgcaaaggagacagagtcacatgcacccttggtgctcagagatgcagtggtggatggcatcatccaggagggtgtgatgtggctggagttcaggtgacctagagaacggtctcaggctgtcccccatccctcttggcttggcatcgtgcttgccaaacttgggagtcgagcccagagtgattatatatttttttgtatgcctgctatggccattggcagctgctttgccaatagatctgcagtgaggtttaccatgacaactgctaggagggccaccccggcccccatgtgggagggtcagctggagaatcttgtcatgtgacacagacaacctcggtgaagagagaggaacccagaggtcaagttcacactaggtcaaatatgtgttctcgagactagttaaaatccacatttaggaaccataacactgtaatagtgcttaaaccttcatgatgaagccctcctccggcccatgggcctgctgaggatgccgcccgccccctgcctgctctgctttatcgaagtttttgctgcccagtgaaccctgggcccttaggaagcctgacttgttgaaaagacctttgacaaccacagggttttgctgtttctgaccctgttatttgttgtcttggatatttcagacgtactcaaacatgttcgagagctcaaattaaattttcctaaagtgcagattttgcttcccagtccttcctagcaatgaacagaggcgacttggagtgtgagggctatgtcaccacccttttaatacggaccaaaatcaggtccagcagagaggagctgccgatggggtgggggtaacttgtgtggtgctgtggagcttacagagagcattttcttgatcttcacaccctgtagtgtcattgaggcagggatgctttattaaccctattccagacagtggggcagtgctcagatgccactgcagatcttgtggctcttcctactgccctgggcttcctggacatccagtgctgtgacattctttcttgaggtcttggtctgaaaactgtcctgacagtcctcagttatctggattggcttccactgcctaacttcacatcatgattttccaagctatgtgagttttctcgggcttctgtaacaagttccacaagctgggtgacttagaacgatagaaatgtattgtctcacagttctgcagtccagaagtccaatgtcaaggtgttgatagcgttacttccttctgaaggcagttctaggcctctctccttggcctgtagatggccgtctcttccctgtgtctttatacattgtcttgtgtgtgtgtctgtctctgtgtccaaatttcccctttttataaggacatcagtcatactgtattagggcctccactccccgcccccccccaccaatgatcccattttaccttgattacctctgtaaagaacctatctccaacagtggtcacattctgaggtacttggggttaggacttcaacactttgtttttttttttctagggggagtacaattcaattcatgatgtaagcctgcagatgccttgcacataggttggagagatgggctattcagagttggctcattcctggggcacttgggaaccctagcagctgacccaaggatgggtgggcggggctttgactgggcccctgccacacaatctgtgactgtggatctaatttggttacttttctactgcagcagctctggctgctccagggggtgttaggagagatgaggaattggccacaggtaattttggtgatgcctctggccatttttactggggctcttttaaagagattctaggttggtgtttcttacacatgaatgtccagcgggaccactggaagggtttgttaaaatgttgaaagttgttaaattcaacaaattgaatcaaaatctttggggtttttaacaagcatcccaaatcatgctgatggaggtggcccacagtttgagaaactgatctggaaggaactcagtcctgggcaatatttatgaccctttatgtgggaatttaaaggccaacctcaacgcttagcaatttagagaaacctctcaagcaaggcaggaaccctctaaacattgggatagctcggatttgaagaatgtatatacagtcaaagattgctgcacatgcagtttttacatccagtttttctttagttagttgaatgtttgaagtatatatgtgtatttttgggagagctggaaatttgcaaaattgttgctgcatcagtgattatgtagagtgccttttaaaaaagatttaaacactttggaacagttgggtgttttcttccactaattttttttaattacaaaatttttaaagttatatacatgtatatttttgcgagagctggaaatttgcaaaattgttgctgcatcagtgattacatagagtgccttttaaaaaagattttttggaacatttgggtgtttttttccacaaattttttttaattacaaaatttttaaagtacacacaaacatagaagctgcccatcagggtcatgtttttaaaagctccctgatgtggtagttaagtacaatgatttatacataaaggagaaactatggtcttatctttctgtaaatgcgtgttttactaatggtttcctgctttcttagtggagagaaaatattacataatttgttggtgtgacacaaattggttgttttcgtacttatggaaaaatacatcagggttgtatttgcaagcatacctcagatatggagggttcagttccagcaaatatctcaataaagtgagtcacaaattttttggtttcccagtacatgtaaaactcatgtttatatactatattgtagactattaagtgtacaataatagcattatgtctaaaaaggcaagtgtataccttaattaaaaatattttgttactaaaaaatggaatgatcaagtcagccttgagtgagtcattatctttttgctagtggaaggtcttgccttgatatggctggttgctgaaagttggggtggctgtgacactttctttaaaataagaaaatgatgaagtttgctgcactaattgactcttcctttcgtgaaagctttctctgtagcatacagtgctgtttgatagcatttgacctactgtataacttctttcaaaactggagtcggtcttctcaaacgctactgctgccttatcatctatgtttatataaaattataaattctttgttgtcatttcaacaatgctcacagcatcttcgccaggagtagattccatctcaagaaaccaccttctttgctcattcataagaagcagctcctcatctcttcaagttcgaacatgagattgcagcaattcagtcccatcttcaggctccacttttaattctcttgctatttccactacctctgcagtgacttcctccactgaagtcttgaactcctccaagtcatccatgagggctggaatcagcttcttccaaactcctgttaatgtggatactttaatctcctcccgtaaatcatgaatgttcttaatggcatctagaatggtgaatcctttccagaaggttttcgatttactttgcccaaatccatcagaggaatcactatctatgacagctatagccttatgaaatgtatttctcaaacaagaagacttgaaagttgaaattactctttgacccatggactacagaatggatgatattttagcaggcatgaaaatgacgttaatctccacgtacatctccatcacagcttacaggtgaccaggtgcatagtcagtgaggagtaatattttgaaaagaacctttctgagcaataggtctcaacagtggggttaaaacattcagttaaccatgctgtaaacacacagactgtcatccagtctttgttgttccatttacagagcacaggcgaagcagatttagcataattcttaagggccctgagatttttagattggtaaattagctttggcttcaacttaaagtcaccagctgtgttagctcctaaaaggagagtcagcccatcctttgaaacattgaggccaggaattgacttctcctcagttttcttcaagaactttttctttgcattcacaacttggctagctggtgtaagaggtctagctcttggcctatcttggctttctacatgccttcctcacttagctttttatttaaagtgagagatctgtgagtcttccgttcacttgagcccttagaggccattgtagggttattaattagcctgatttcaatattgttgtgtctcaggtaatagggaagcccagggaaagggagagagatgagggaacggctggtcggtggagcagtcagaacacacacaacatttctcagttaagttttctgtcttatattgggtatgatttgtggtgccccaaaacaattacaatggtaacatgaaagatcaccgatcacatatcactgtaacagacacattaataatgaaaaagtgtgaaatattacgagaatttccagaatgtgacacagagacagaaagtgagcacttgctgttgggaaaatattgccagtagacttgctgcatgcaaggttgttacaaaccttccatttgtaagaaacacagtgtttgtgaagtgcagtaaagtgaagcaaaataaaatgaggtctgcctgtacatgcatatactgatgtgtgtctgttaatttttcctgcctgttacggattgagcacgtcatgtagacacagtccattggatactgcaattctgtgcatacattgccatcgagaccccaagactgtgtggttataagaaggaagtgccactgcttactcctctcctctcccttctatcttacctgcttttgttgcctttctcctcttcctccccttacttggtctcagtttggtttgtcctgaatgacaggcagtatggctcagtggttggaagttcagtctttggaattagaatacggagctcctaattgaccttaatactttctcactgtgtaatctcggacagtcaagcttgagacctgaagcagggctaagttaactccattcacaaaataggaataatgatggtctctgtcatcatccaggggcttgctacggggctgcattaggtaatacattaaaaacgcatagagagcagggcccctgcacagtaattgacaaaaatgagctctcagcacctttcatttgtctgctcaggaccacttcctcctgggtaccactgcttcttccatgcccctcttctaagatccttgggggctgatcctgtttggtgctccctaagcagattctatttgatgctccctaagcactctgatttcactcttagttggctctgggtatggctgagccaggtagaagaggcatctgtcccttcatcagcgttgagctcctgggaagcaggtcccttgctttgccacagtacaagtgccacagtacaaatgctacctaggaatagaatggagttgagtcgaagtagcatttctgattttgcgatgttgctaatgctgtcctctaaatactatagaaagaattctttttcttttctttgtttactctcaccttttggcaataatttccacttgtttttctttcctgctttttctctctgtacttttccttgcccagcagacactgctgattgtgacagctttttcaagggcacaacaccttactctgtttcctcctgcctttgctctgtaaggctgctctggcatggcccaaactttgagatgacttttcctttctccttgccaattttagaatctttctgttcaacatcatcatctgatagagatttgggactaagtaaaatgaatgttgtatgattttccctgtaattttagatccccaaatactgctcttggccaactacactattccctgtggcttttttactccaccacatttgagtaatattgttggcatggacataagtaaacagtttgaaaatgttgtgttttgtaaactagaagatggatgggctggttttttaatgcatgctcttggttctgctgggccaaaggaaagatgaatttggtcagtggatgggaagatgaattggaggaaggtgttgctatccgaagttgatgtggccaactttactgaactgatgagatcagttatttagaggtgaaaaccgagtggctggaggcgactcttcggagggatttagataatgcagttagagggaatttttatagaggagatagcatgctaccagtaagaagccaccaatggaaaatatgataataaagtaaggaaaatagaaggataaggatcttttgtctttgtaaatttaaacatgtttttatttctttgtagaattaccagacaattccaatgtggcttttaatctttcatgaacttcattttattattgctgtatatatatgtgtgtgtgtgtgtgtgtgtgtatgtatatgtatatatatgtacgtgtatatatatatatatatatatatatttttttttttttttttgagatggagtcttgctttgtcgcccaggctctagtgcagtggcgtgatctcagctcacggcagcctccgcctcttgggttccagcgattcttctgcctcagccacccgagtagctgggattacaggcatctgccaccacacctggctaatttttatatttttagtagagatggggtttcaccactttggccaggctggtcttgaactcctgacctcaggtaatctacctgccttggtctcccagagtactgggattacaggtgtgagccactacacccaccctattattgctatttttaattaaaatgtagagtctccatcctcccatatgcatttcatgttcacaccatagcgagtagacagttaacacttagcatcttcaaaatatgattattgtaaaagctatttaaatgagccgagacttatcacttcaccttcataaatcatttactacaatgattcaagggtgaggatactcctgcctcttcattggctgtgaaacttcaagcagattaatgaactcctctgagacttttctcaaccttcagacgggaagagtaccctcatcacacaacttcattcatgttgttgtgaatgtcaggcatacacatcctctttgctctgaatgcttgtcacattgcatcacagacatttatgtattgtctggcattgctgcttgaatgtgagctctatgagggtagggattatactatagccatctttttgtcttcagtacctggtaagcatgtacacctttatggaatgaatgaatgaatgaatgaatgaatgaatgaatggattgatttgttgtactttcaccaagctcctatatagtaggttttggtacacggaaggtgttaagatgactttttctttctccctgccaattttagaatctttctgctcaatatcatcatctgatagagatttgggactaagtaaaatgaatgttgtatgattttttttccctctaattttagatccccaagtaccatgtacttgaaaaaactaaaacagggtcacaggctagagagtgacaggagctggaactggaggtggggagagggctaaaagaaagtctctataggaagtgacatgtgaggcctgtgtgatatgaaagggtctgagagaagagtattttaggccaacagaatggctagcacaaaggccttggagtggggataggcctggcttgttgtgggaacataggtcattatcgttgggttgtcagtgagggctgctgtaataggtgatataagatagggttggatcccaagtcaagtcttctaggctgtgtgaggccacagataagataacaagaggggactgtacaacacaagcacagtcaacacaagtactataaaacacgagtgcatgcaagtgtattttattactaagaaattaaagaaaataaaggatttagtattttttaaggcatggaaaaatatcttacgtagaaaattcattagatcactttgattgctattttttattgatgagaaaaactgcacgtggaacagtgaagtacccaagtccacacacaaattattctcatagcctgaccacctgcctggtgcccagattgccagaccagccttgtgctgactggacctccgggtctctgccgagctctcgtggaaaggcaagaccctcagcagggagctgcgaggctgcggtttaggatgaaagtgtgagggtgaagaaagccaagtcactggtcactattgtgttaaaagtcaaattaatggggatccttacatggtactaaatttaaaaaaatgttcaatcctttaaaaattgattaaaaattttattttgatgatcatagaaaatctacagagagctgataggatgtgttaaagtggaagttaaatatttttggaacatttgtatgctcttctgaggttttgttcatcccccccacctcaacatctaatttacacgttgaattagtcattgactccgcctgccattttgtggtaaagatcaagtcaaatgaggctcatcacagtgcttcacaaaaggggccgggtgtggtggctcatgcctgtaatcccagcactttgggaggctgaggctggcggatcacctgaggtcaggagttcgagaccagactggccaacatagtgaaaccccgtctctactaaaaatacaaaaattagccgggcgtggtggtgggcgccggtaatcccagatacttgggaggttgaggcaggggaatcacttgaaccaggaggtggaggttgcagtgaatcaagattgtgccattgcactccagcctgggcaacaatagtgaaactccgtctcaaaaaaaaaaaaaaaaatccttcaatgcttcacagaagggccatataaacataaggtgaccttattaataaggtttttatgaccagtttgtacactttttttaataatgtgttggtgcatttcttgtcttgaaaaatggaatgcataaaatgtacccattttcaatgagtttttggtaactaaagaattggtgtctctgatgtttatattgaccatcgagtttaccaacaatgtctctggtacacctcctagaagttggtttgaaaataaacaaaaacacctacatctccactttaattctaccctccctggaatttattttattctcctaaaagtagggttcgtgcaaagacaagaattctttcaagagagccctgtttcttttattttgagatagtgaaaaggttatgttaagttagtccaaaatttcatagtaattgaaggtgaaataatacagacaataagtaaattaaaggtagagactgtttttgttttactttttcatccatttaggagattggcctacacagcggttctctttatatacaatagaccctcagtaaggtttcttgattagtaagcattgcaagttacgtttgtttcgagtggaagaccagctgaaatccatttaaatcaatgaatactgagattatgttattaaatggttctttttgttttacgagaatgtatattacaacaaatgtccctgtgtaagtttggaatgctttgttttgagtgttaaaggctcttttctctggcaaaatttccccatttcttcctttaatacagagtgcttgaatggcacctcacagacacttagcctcgtggctctcaaagtatagaccctggaatggggcgtcagctccgcctgggaacttgttagaaatgcaaactctccagccctgttaaaccaggagctctgggatggggccagccatctgtgttttaaccaggcctcttggggatcctgatacagctgtggcttgagaaccactgctctagcagaacccatctcctcctccctttccacatccccccaccctactgtgatcacttgtggtgtgatgagggggacagggaaatcagctcttttgggctccaggccttgagagtagaggcttcatttaccctttcccccttcatttctgcctaaggatgagtttatatggtataaagcccagtggaatggatcattttccccagtttcagatgggaaccttgcaatcggataagatgtagctgtgtatgttgttactgttattattaattgttattcagagacaaggtctcactctgtaacccaggctggagagtagtggcgtgatcatagctcactgtgatcttgcactcctgggctcaagtgatcctcgtgcctcagccccccgagtagctaggactacagatgcatgccaccatgcccagctattttttttttttaacttttttgtagaggtgaggtctcgctgtgttgcccaggctggtcttgaactcctggcttcaagtgattctccaaccttggcctcccaaagtgctgggattacaggtgtgagccactgcacctgaccaccatgcacattaatacacattctatactgtatgctcactgaggagtggcaaagaaaccagttttcattcagtgaatatacctataaatgtgttttgtacctttaggtcttcctaattctgttctgttccttaacataaaagatgcctaaaccacacttcttcatattcttcaaagccacatttatcaaggtgtggttccaggacctcctacaacagaacccctgtgggatgcgtaacaaatgcaggttgtgggactttcccacacacctaccaaattggaacccctggtagtagaccccttggccctcattttcacaagcacccatctgactgatccacactgaagcttgagggccctgagtttaaagtacatatgctggaatacaagatatcaaaagcgaagaatgatgagaaagagattgcaaaattaataaaagtaacgaaggagcaacattttattttagaaataggtgccattacttgtttctaaaataatttgaaagtgaaatgaagaacaagctcttgtctagagcatactcttggaattggcagggattgtgcttcctcgcgtcaagatcaagaagctcagatgcagaggagacagggctgtgctgcccagttgttccttggggtcatgctgactccatcctggaagttgctggaggaatgcatcatatgtttggaaacagcccagttgagaatttcagcaatgatacactttttttattagatgtgtatttaggaaaggaattgcctattataagactagggccctttgtagaaggagctgaaaaaggagctggtttgcttgtcctgtgaaatagggactgttttccccattatgcatcttttcttttctttccacaaaataaataaatgcaaagacatgtcacttgaatgttgtataaaaatcaggtcttttaaaaattacttgtttctctccaagtagaaaggcattttttccccaagggaaacttattaaaatcatcagttattgtagtaatagctatgcctccttaaaagtaaatagatttttttttcttcccagtgccagtagcatgtagctatttccaaatatgttaacttttgatgaagcatccaaatgtttaaatatcttataaaggccacagttctaagaaatggtgttaaaattttgagaaaattcaaatttgaagaattacctaaatactaagtaaatcaaaaagtatttgtaacattaaaaaaaatttatgtcaaaaatattttttaatgtcaaaaatatttttcaatacttaaaaaactagcactttgggaggctgaggcgggcggatcatgaggtcaagagctcgagatcatctggccaacatggtgaaaccccgtctctactaaaaatataaaaattagctgggtgtggtggcgtgcacctgtagtcccagctactcgggaggctgaggcaggagaatcgcttgaaccagggaggtggaggttgcagtgagctgagatcgcgccattgcactccagcctggcgacagagcaagactatcttaataaaaaaaacaaaaaacaaaaacaaactttagtccttactccttcagtctcagttgggaaaaccatagaataatgaagacaaagttacagattaaagcaatagctccatggtcaaagtggacagtggagttattaaatagtgtatttaaatagacttttgagagaagttttaggttcagagcaaaattgaacagaaagtacaaaattcctatatacctttgaccccacatacacacaacctctcccaccatcaaaatcctgtccctgtcctgttacaatcgatgaacccctatattatcacccaatgtccatagtttatattagggttcactcttggtgttgtatattccttgggttttggcaaatatataataacatacatctacagtatcatagagaatagtttcactgccctaaaaatcctctgtgccctgcctactcatccctccttcctgtctaaaccctgacaaccactgatccttttactgtctccatagttttgcctcttccagaatgacaaatagttgagatcatactgtaggtagtcttttcagattggcttctttcacttagtaatagccacttaaagttcctccatgtcttttcatggcttgatagcacgtgtctttttaatactgaataatattccattgtctggatgtaccatagtttatttatccatcatctgctgaaggacatctttgtcacttccaagttctggcaattatgaatagagctgctgtaaacatttttgtacaggattttgtgtggacgtaagttttcaacacttttgtgtaaataccaaggagtgtgattcctgaactgtatagtaagagtatgtttagtttggtaagaagtggaaactgaaactgtcttccacaatggttatactattttgcagtcccaccagcaacaaatgagagttcctattgttccacttcctcatcagcatttattgttgtcatcagtgttttggattttggccattctaatagttatgtagtggttttaatcttgttgtaatttgcagttccctaataaataacatatgatgttgaacatctttttataagcctcagatacttgagctttttttggtaaggtatttgttcaggtcttttgcccattttttaatcaagttgtttgtttccttattgttgagttttaaggttctttgcatattttggataatggtcctttatcagacgtgtctcttgaaaatattttcttccactctgtgtcttttcattcttctcagtgtctttttcaggacagaagtttttttattttaatgaagtccagcttatcaattctttctttcatggattgtgcctttggtgttatatcttgttttattttattagctaggacttccagtactattgaaaaggagtgatgagagagaatattcttgccttattcatgatcttagcaggaaaactagttgctcaccattaagtatggtgttagctgtatgttttttatagatgttctttgtcaagttagggaaattcccttctattcctggtttactgagagttcttatcataagtgagtgttggattttgtgaaatgctttttctgtatctattgatatgatcatgtgatttttcttctttaggttgttgatgtgatggattatgttgatatttgaatgttagaccaaacttgcatacctgggataaatcccatttggttgtgtataattgtttttattcattgttgcattcaaatttgctaatattttgttgaggatttttgtatctgtgttcatgagagatacttgtctgtagtttcctgttcctgtaatgtctttgcctgattttggtattagggtgatgctggcctcagaatgagttaggaagtatattctcttcttctatcttctgagagagattttagagaattagtatactttctccctgaaatgtttcctagaattgaacccatcctggcttgctgttttctgttttgaaaggttatttattattgattcaatttctcggttttggcagattatgtcttttaaggaattgatccatttcatttagattattgaatttgtgggcatagaattcataatattcctttattattcctttaacgttcataggatctataatgatgttcctgctttcatttctgacattagtagtttgtgtcttctttttttcttagttagcctggttagaggcttatcaattatattgatgatttcaaagagctagcttttggtttcatttatttcttttgtttactttctattttcagtttcatcgatttctgctctaattttcattatttcttttccactgcttactttggatttaatttgctgctctttttctagtttcccatggtggaagcttagattattaattttagatctttcttatttttaaatatatgcattcattgttatgaatttccctctaaacactgctttcactgtatcctgcaaattccattaagctgtattttaattttcatttaggtctaaaatattttaaaatttctcttgagatttcctctttgacctatgctttgtttagaattatgttgctgtatctccaagtattttgggatttttccagttattgttataaatttctagtttaattccattgtgacctgagaatggatattatatgatttttactcttttaagtttgttaagatgtgttttatgacccagaatgtggtttgttttggtgaatgtgctacgtaatcatgagtaaaatgtatattctgctgtcgttggatgaagtagtaaatacatgtcagttattttcagctagttgatggttacgttgaattccaattatgtccttactgattttctgcatgctggatctgttcattttgtgataaaggagtattgaagtatccaacttcaatagatgaattatggattcatctattattccttgcatttctatcagtttgtttgtttgtttgtttgtttttgagacagggtggagtgcagtggtgcaatctctactcactgcaacctctgtctcctggtttcaggtgattcttgtgcctcagccttctgagtgctgggactacaggtagatgccaccatgcctgactaatttttgtattttttggtagaaatagagtttcaccatgttggccatactggtcttgagctccttatcaggtgatccgcctgccttggcctcccaaagtgtaaggattacaggcgtgagccaccatgcctgattatctatcggtttttgccttatgtatttggtgctctgtcattaggtgcgtacacattaaggattggttatgttttcttggagaattgacacttttattatatgtaatgctcccctttatgcctgataattttccttgctctgacgccagctctctgtgaaactaacatagctatttctgctttcttttggttagtgttagcatgatatttattttttcatcccttacttttcatttatatcaatctttatattgaaagtagctttttgtagacaacatattgttgggttttcttttttgatccactctgacagtctctgccttttaatgggtgtattgagaccattgatgtttaaagtgattattgatacagttggattaatagctactgtatttgttactgttttctattcattgcccttgttttttgttcctctttttgtcttctactcttttttcctgccttttttttttttttaagacagggtcttgctctgttgcccaggctggtgtgcagtggtgcagtctcatctcactgcaacctccacctcctgggctgaagtgatcctcccaactcagcctcccaagtagctgggactgtaggtgtgtgccaccacacctggctgatttttttctttagtgtgtgtgtgtgtattttttttttttttttgaggcggtgtctcgctctgtcacccaggctggagtgcagtgggcaatctcggctcactgcaacctctgcctcctgggctcaagcagggctcgagcaattcccctgcctcagcctcccaagtagctgggattacaggtgcccgccaccatgcctggctaatttttgtatttttagtagagatggggtttcaccatgttggccaggctggtctggaactcctgacctcaagtgatccacctgcatcggcctcccaaagtgctgagattacaggtgtgagccatggcacctggccaatttgtgtgtgtgtgtgtgtgtgtgtgtgtgtgtgtgtgtgtgtgttttaatttaaaaagttttattttcatttcaggggcacatgtgcaggtttgttatataggtaaattgtgtgttgtggtttgatgtgccagattatttcatcacctgaggaataagcacagtacctaataggtagttttttgatcctcacctttttcctatctccaccctcacgtaggcccagtttttgttctcttctttatgtccatgtgtacttgatgtttagctcccacttggaagtaagaacatgcagtatttggttttctgttactgtattagttcacttaggataatggccaccagctccatccatgttgttgcaaaggacatgatctcattcttttttaaggctgtgtaatattccatggtatatacataccacattttttcctatctaatctactgttgatggacatgtaggttggttccatgcatttgctatcgtgaatagtgctgtgatgaacatatgcatgcatgtgtctttatgttagaatgatatatattctgggtatatacccaataatgggattgctgggtgaaaaggtagctctgttttaagttctttgagagatcgccaactgatttccacagtggctgaactaatttacattcccacctacagtgtataaacattccctttttttctgcagcttcactggcatctgttattttttgactttaacaatagccattctgactggtgcaagatggtatcacattgtggttttgatttgtatttctctaatgattaatgatggtgagcatttttcatgattgttgctgcatttatatcttcttttaaaaaaatgtctgttcatttcctttgcccattctttaatgggattgtttgtgttttgcttgttaatttaagttccttgtaaattctggatactagacctttgtcagatgcatagtttgcaaatattttcttccattctgtgagttgtctgtttactgtgttgatagtttcctttgctgtgcagaagctctttagtttaattaggttccatttgtcattttttgtttttgttgcatttccctttggcatctttgtcatgaaatcttttccagggcctatgttatctttcagggttatcttccagggtttttatagttttaggttttatgtttaagtatttagtccatcttaagttgatttttttgtatatggtgtaaggaaggggttcagtttcaatcttctgcatgtggctagctagttacctcggcaccatttattgaataaggagtcttttctccattgcttgtttttgttgactttgttgaagatcagatggtggtcggtgtgtggctttatgtctgggttctctattctggtccattggtctatgtgtctttttataaaagtaccatgctattttggttactgtagccttgtagtgtagttccaagtcaggtgatgtgataccttcagctttgttctttttgattaggattgccttggttgtttgggctcttttttttttgttccatatgaactctaacatagttttttctaattctatgaagaatgtcattgttagttgataatagcattgaacctgtaaattgctttgggcagtatggtcattttaataatattgattcttcctgtccatgagcatggattttttttttccatttgtttgtgtcaattgttatttctttcagcagtgtttttcaattcttgttgtagagatcttttatctccctggttagctgtattcctaggtatttgtgtgtgtgtgtgtgtgtgtgtgtgtgtgtgtgtgtgtgtctgtctgtcttttgtaaatgggattgcattcttgatgtggcgctcagcttggatgttgttggtgtatagaaatgcttctgattgttatatattgatactgtatcctgaaacttcgttgaagttatttatcacatctaggagtttttgggcagaaactttggggttttctagatataaaatcatattgtctgcaaatagagagagtttgacttcccctcttccaatggaatgccttttatttctttctcttgcctgatttctctggctaagacttccagtaatatattgaataggagtgatgagagtgggcatccttgtcttgttctagttctcaagggtatgcttccagcttttgcccattcaggattatgttggctgtgggtttgtcgtagatggcccttattattttgaggaaaattattccatgcctagtttattgagggtttttttcaaacatgaaggatattgattgttatcaaaagccttttctgcatctattgagataatcatgtggtttttgtttttacccctctttttgtgatagatcacatttattgatgtgtgaatgtaagaccagccttacatcccagcgataaagcctacttgattgtggtagattaaatttttgatgtgctgctggatttagtttgctagtattttgttgaggattttgtatctgtgttcatcaaggatattggcctgaagctttttttgtttggtttctgtttgtgtgtctctgccaagttttgggatcagaatgatgctggcctcgtagaatgagttagggaggagttccttctcaattttttggaatagtttcagtaggaatggtacaacctcttctttatatgtctggtagaatttggctgtgaatctttctggtgttggactttttctggttgctagtctttttattactgattgaatttcagaactcgtttttggtctgttcagggttccagtttcttcctagttcaatcttaggaggttgtactttccaggaatgtatctatttcttgtaggttttctagtttgtgtgcatagaagtgtttgcaagagtctctgagttttttgtttttttttttctgtggattcagtggtaatatcttctttatcatttctgattgtattcatttggatcttctctttttttttcttagtctagcagtggcctatcaatctaatttattctttcatagaaccaacttctggtttcattgatcttttgtgttttttttccttctcggttatatttagttcagctctgattttggttatttcctgtcttctgctagctttggggttgatttgcttttgtttttctagttcttctaggtgtaatgttaggttgttaatttgagatctatttttttgatgtgggcagttagtgctataaactttcatcttaacactgctttagctatgccccagagattctggtatgttgtattaatttcttgatttctgacttaatttcatgtttatccagaagtcattcaggagcaggttatttaatttttatgtagttgtatggtgatatggtttagctctgtgtcctcagccaaatctcatcccaaattgtaatccccacatgtagagggagggacctggtgggaggtgactggatcatggggatggtttctcccatgctgttcttgtgatagtgagggagttctcatgagatctgatggttttaaaagtggcagtttcccctgcacactttctctcctgctgccatgtaagatgtgccttgcttccccttcactttctgtcataattgtaagtttcctgaggcctacccagtcatgtggagctataagtcaattaaacctcctttgtttatacgttacccagtctcaggtagtatcgttatagtggagtgagaacagactaatacaaatggttttgagtgatcttcttagtgttaatttctgtttttattgtgttgtgggtccaagggtggttggtattattttggtttttttgaatttgttgagaattgttttatggctgattgtgtggtcaattttagagtatgtgccatgtgaagatgaaaagaatgtctattctgttttttttgttgttgagacttctgtggatgtctgttaggtctacttgtccaagtgttgagttcagctcctgaatgtctttgttagttttttgccctgatgatctgtctaatactgtcagtgggtgttgaagtttcttgctattattgtgtcattatctaagtctctttgtaggtctccaataacttgttttatgaatctgggtgcttctttgttaggtgtatatatacttagtataattaaattttcttgttgaattaaaccctttaccagtatgtaatgctcttttgtgtccgttacataatgctcttgtctttttatatttttatttttaatttttgtgggtacacagtaggtatacatattcccagggcacataagatgccatgatataggcatgcaatgcctgtatcaaaaaagcacatcatggagattggggcatctttccctacaaggacccccttatctgcgttacaaacaatcttaactacattccttaagccatttaaaaatgtacaatcaggttatcatagaccaaaatcaccctattgtgctatcagacaataggtcttattcattctttctattttttttgtacccctgaaccatccccacttctcctccagcccctcactacccttctcagcctctggtgaccatccttctactctctatgtccatgagttcaattgttttaatttttagacaccacaaataactgagaacatgtgatatttgtctttttgtgcctggcttatttcatgtcacttaacatgatgacttccagttccatccttgtagttgcaaatgactggattttattcttttttatggctgaatagtactccattgtgtacacgtaccacattttctttatccattcatctgttgatggacacttatgttgcttccaaatgttagctattgtaaatagtgctgcttcaaacataggagtgcaaatatctctttggtatactgattttctttcttttgggtgtatacccagaaatgggattgctggatcatatggtagctcaatttttagttttttgaggaacctccaaactgttctccatagtgttgtgctaatttacattccatgaacagcgtatgaaggttcccttttctctacatccttgtcagcatttgttattgtctattttttcatataagccatttaactggggtgagatgatatctcattgtagttttgattagcatttctctgatgatcagtgatgttcatttgcctgttggaatttgtatgtcttcttttgagaaatgtctgttcaagtcttttgcccattttcgatgggattattagtattttttctatagagttgtttgagctccttacatagtcttgttattaatcacttatcagatgggtagcttgcaaatattttctcccattctgtgggttgtctcttcactgtttcctttgctgtgtggaagctttttaacttgatgtgatcccagttttccattttgctttggttgtttatgcttttagggtattgctctttgtcttttctgattgttgttggtttaaagtctgttttgtttaaaattagaatagcaatctctgcttctttttgttttgtgtttgcttagtagatttttctccatccctttacttttagtctacggatgtcattttatgtgaaatgggtaggtatcttgaagacggtatacagttggttcttacttctttatccgacttcgtactctgtgccttttaactgagacgtttaacccatttacattcaaggttaatactgacgtgtggatttgatcctgtcaccatgttgttagctggttattatgcagacttgattttgtagttgctttatagtgtcaatagtctgtgtacttaagtgtgtttttgttgtgaccagtaatggtttttcatttctgtatttagcactcccttaaggacctcttgtaaggctggtctggtggtaacaaattcctttagcatttgcttatttgaaaagggtcttatttcttctttgcgtatgatgcatagtttggctggatataaaactcttggttgaagtttcttttctttaagaatactatattttggcccccagtctcttctggcttagacagtatttgctgacaggtatgctgttagtctggtggagttccctttgtaggtgacctgccccttctctctggctgtctttaatattatttattttatgttgatctgggtgaatgtgatgactgtgtatcttggggatgattgtctcatatagtatctaacaggggttctatgtatttcctgaatttgaatgttggtctgtctagtgaggttagggaaatttttgtgaagtgaatgatatccttaaatatatttttcaaggtgtttactttctcactctttctttcagggatgcccatgagtcatagatttggtcccttcacataatcccatatttgttggaggtttcattcattctttgttttttttttttttttttttttttttttttttttttttgtctgactgggttaattcagagaatcagtgttcaggctctgagattctttcctcagcttggttaattctgctgttaatacttgttatgatatcgtgaaattcttgttgtgagttttttagctctatcagatgagtttggttatttcttaagatgaccattttatcctttggcttctgtgttattttattgtattcctcagattccattgattgagtttcaactttctcctgaatctccacgatctttgttcctatccattttcagaattctatgtctgtcatttcagccatttcatcctagttaaggaccattgctggggaacttgtgtggttgtttggaggtaagaagacactctagctttttgaactgccagagttcttgtgctgtttctttctcatctgtgtgggctgatattcctttaatctttgaaattgctgtcctctggatgagtttttttgcttttatcttctttgctgccattgggggtttgattgtggtctaaagtgggttcagttgactaggttcagttgactactatgctgtgtgctctaattctgtggggctggtatggggcccccagctttgttccttgacacctttgtgttaggaacctggtgtgctgaaggggccaaggtgttcccggtccactgacctcagtactctgatggggggtgccagccaacacctttcctcagggccgtggcagtgggatccatgctggcttgtgtgtgccagaagctgcagtggcgcagtggggtgcacatgtgttggttggggtggggtgccagtaggagcctttgcattaagttttcataggcactatatcctggcaaaatattttaccattgtattttgggctgtgagccagtaggcaccatttaagaatgttagccagcagataggctcttaccgtactgcaaagcttttttgttttagcacagtgggtaggagtgctctatgttgggggttagagagatgactcccttacctagtttgttccggtgccttggaggaggcccctccaatcactggctctgtgcttgcatttcttttgttaggagttctggttcatgaggatccctcaggcaggggccacggttggcacataggccatatccttgctgtttcctgtggagggaggcacactccggtcctccaccagcctgtgaacccaggcatcttctctcactgacctgaaagtgagggctcctccctgcttgggtacagcaaacaagcaagctctccttggctaggagccgtgagggtgagtgaggtcacctaatgttctgtctgggtgcttcctgggggaatatggggttgtgcctgcctgcagagttcagacagaagtgggaccattctgctggaagctctagcatgcctggcccctctgcctaccagtggtggaggtgggtggagatgcctgccctgctgtccgggtgttatcctggggcaaaaggatattgtgccccttggcagaattcagatagaagaaggaccagtggactggaagctctagcaggcatggcctgcctggctaccggctttgggggtgggtggagtggcctcccctgctgtccaggtgtttcccaggacaacaggaggttaagtctgcctgctgagttcaggcagaagcaggactgctgggttggaagctctagcaggcgtggcccacctggctatgagccgactgggagagtggagtcaccttccctgccgtctgggtgtttcccagtacagcaggaggctgtggctgctggctgacttcaggcagaaacaggaccactgggcgggaagttggcactgagccttgtctatcaagggcggggtgagggcggctggagcaatcttattgcttccaggcaccctgactgtggcctctactggggttatgtcactggtgccagttttttctggggtccaaggcttgtataggtgtccttggacttgagagttgcctctggaaaatctccaggtggctctctgcttcagtttagaagcatggttgggtgtgcaggggcctagaaggattctcccattcccagtcctgcacaggtccttgtggaaagtgtgaatcccctgaggggctctcactcaccactcccttgttggggagcttctcatgggtctgtgttgactccagataggctcctgcgcagcttcactcctctttgctctctgtgtccccttgctgccttgatggatcccggagtagtttcatggatgatcagcttgtaggatcagtgttcagtttgtttccctcttcagtttcttgcatcaatgttttgtagttttcattgtagagatctttcactgcttgggttaattcctaggtattttattttatttgtagctattgtaattgggattactttcttgatttctttttcaaattgttcactattagcatatagaaatgttactgatttccatatgttgatttttatatcctgcaactttactgaatttgttttattagttctaatagttttttggtggagtttttaggtttttccaaaaataagatcatatcatctgcaaacaaggataatttgacttcttccttttcaattcggatgccctttatttctttctcttgtctgattgctctagctagaactcccagtactatgttaaataacagtataaaagtgggcctccttgtcttgttccagatcttttccccattcatcatgatactagtgtgggtctatcatacagactttttggcttttattgtactcaggtatgtttttttctatacccagttgtttgagtgctttttttcatgaagggatgttgaattttatcaaatgttttttcagcaccaattgaaatgatcacatggtttttgtccttcattctgttgatatgatgtatcacattgatttgcatatgttgaaccatccttgcaaccccgggataagtcccacttggtcatgatgaatgatctttttaatgttttgttgaatttggtttgttagtattttgtctaggatttttgcattaatgtttattaaggatattggcctgtagtttttttttaattttttttttttttttgcatgtgtctttggttttggtatcatataccagcttcatagaacgagttttagaagtattccctcctcctctatcttttggaatagtttgagtaggattggtattagttcttctttaaatgtttggtaaaattcagcagtgaagccactgcgtcctgggcttttccttcctgggagactttttattacagcgttgatatcattactcagtctgttcaggttttgaatttcttcatgattcaatcttggtaggttgtatgtgtctgggagttgatccatttctcctaggttttctaatttattggcatatagttgctcatactagcctctaatcctttgaatttctgtgttatcaattgttatgtagtttttttcatctttgattttatttatttgggtctcctcttttttcttagtttggtcagagatttattgattttgtttatcttttcaagaaaccaacttttcatttcattgatcttttatatatatatttttttcatttaaatttcatttatttctgctctgatctttattatttcttttgttctactaattttgggtttagtttgctcttgctttctaggtctttatgatgcagcattaggttgtttatttaaagtttttctacttttttgatgtgctcatagctataaattttccttttagtactgcttttgctgtatcccataggtatagtatgttgtatttccattatcattgtttcaataatttaaaaaaattccttcttaacttattcattggccctctgatcgttcaggagcataatgtttaatttccatgtgtttgtatagtttccaaaattccttttgaattgatttctggttttattctattgtgttcagagaaaatacttaatataatttcagttttaagagttgttttgtggcataagatacggttcatccttgagaatggtccatgagctgaggagaagaatgtatattctgtagccactggatgaaatgttctgtaaatatccgttaggtccatttggtctattgtgtagattaagtccatgatttctttgttgatattctgtctggatgatgtgtctgttgctgaaagtgtgcagtgttaaagttttcagctattattttgttagggtctatctctctgtttagctctactaatatttgctttatatatctgggtgctccaaagttggatgcatatatgcttacaatcgttatattctcttgctttatatccctatataatgacttttcttttctctttttataatatttgtcttgaaatctattttgtctgatacaagtataactatttctcctctattttggtttccattggtatggaatatctttttccatctctttattttcagtctgtgtctttgtagatgaagtgtgtttcttataggcaacatactgttagtttttttaaatgcatttaaccactctttgtcttttgatggagagtttagtccatttacattcagtgttgttattgttaagtaaggacttactcttacaattttgttatttgttttctggccttctcttctttcttttctttctgttttcgttttagtgaaggcagttttctctgttggtatgttgtaatttctcactttttattttttgtgtatctgttgcatgtttttagatttgaggtaactatgaggcttgcagatactgtcttataaacattattttaaactgatgacaacctaacactgattgcataaagaaacttataccaacaaacaagtaaaaagaaaactaataactttaactttcaagcaagtaaaaagaaagctaataactttatctacctgctttttaactttttgtagtttctatttatatcttactgtactgtgtatttcttgaaaagttgtagttattatttttgactagttcatcttctttcttctgaaaatattagtagtttacataccacaattacagtgttataacattctatgtacttaatattactaatgagttttgtaccttcagatgatttcatattgctccttaatgtccttttctttcagattgaaggactccgttttagcacttcttacaggaccagtctggtgttgatgaaatcagcttttgtttttctgggaaagtctttatttctccttcatgtttgaaggatatttttgccatagatactcttctagggtaatagtgattttctttcaggactttaaatatgtccatgacactctctcctggcctgtaaggtttccagtgaaaagcctgctgccagatgtattgcgctccattgtatgttacttgtttcttttctcttgctgcttttaggatcttttctttatccttggtctttgggaatttgattattcaatgctttgaggtcatctttgggttaaatctgcttggtgttctgtaaccttcttgtacttgaatatggatatttttctctaggtttgggaaatttctctgttattattcctttgagtaaactttctaccccagtctctctctctacctcctctttaaggtcagtaactcttagatttgccccattgcggccattttctagatcttttaggtgtgcttcattctttaattgtgtatttttgttgtttagtataacttataatttttcttggtagctggatatgttgtacttggtattggttcccatgaaggtttctgctcaggtgtttctgttccagtaaattgtatttctatgtatttgcctgtctgtttgtccaattttggggcagctttgtgatctcacttttgctttgttacctcacttttctgatggatctatgcagagttgatgatttttcagtttgttcagctttttacttgttaagatggaatgatgacttccaagctccttacatgcaggactggaaagtagaagctcacattttatttttagaacaataaaactacaaacataagctctctgatatggtttggccatgtccccacccaaatctcaccttgaattgtagctctcataattcccatgtgtcatgagagggacctggtggaaggtagttgaatcatgggggcgagtttttcctgtgctgttctcatgatagtgaaaaagtctcacaagatctgatggttttagaaagggaagttcctctgcacatgctttcatgcctgctgccatgtaagacgtgcttttgctcctcctttgcctccccagtcatgtggaactgtgagtccattaaacctgttttataaattatccagtcttgagtatttcttaatagcagtatgaaaatggactaatacagtaaatcggtaccagtagagtggggtgctgctctaaagatacccgaaaatgtggaagcaactttggaattgggtaacaggcaaaggttggaacagtttggagggctcagaagacaggaaaatgtgggaaagtttggaacttcctagagacttgttgaatggctttgaccaaaatgctaatagtgatagagacaataaagtccaggctgaggtggtctcagatagagatgaggaacttgttgggagctggagcaaaggtgattcttgttacacttaaaaaagagactggtggcattttgcttttgccctagagatctgtggaactttgagcttgagagagatgatttggggtatctggtggaagaaacttctaagtggcaaactgttcaagaggaggcagaatataaaagtttggaaaatttgcagcctgatgatgaagtagaaaagaaaaaccaattttctggggagaaactcaagcctgctgcagaaatttgtgtaagtaacaaggagcccaagacagtgggcttaatcaccaagacagttaatcaccaagttaatcaccaagacagtggggaaaatgtctccaggacatgtcagagactttcatggcagctcctcccatcacaggtctggagggaaaaatggtttcttgggctaggtccaggactcccctgctgtatgcaggctaaggacttggtgccttgagctccagtgctccagctgtggctgaaaagggtcaagatacagctcgggccgtggcttcagagggtgcaagccccgagccttggcagcttccacatgatgttgagcctgtgggtgcacagaagtcaagaattgaggtttgggaacctccgcctagatttcaaaggatgtatggaaatgcctggatgtccaggaagaagtttgctgcaggggcagggccctcatggagaacctctgttacggcagtgcagaagggaaatgtggggttggagcccccacacagagtcaccactggggcattgcctagtggagctgtgagaagagggccactgttctccagaccccagaatggtagatccaccaacagcttgcaccatgtgcctggaaaagctgcagacactcaatgtcagctcatgaaagcagccaggagtggtgctctatcctgcaaagccacaggggtggagctgcccatggctgtgggagcccatctcttgtatcagtgtgacctggatgtgaaacagagtcaaaggagatcattttggaacttcaaggtttaaagactgtcctgttggatttcagacttgcatggagcattgtaggccctttgttttggctaatttctcccatttgaaatgggtgtatttacccaatgcctgtaccctcattgtatctaggaagtaactaatttgcttgtgattttacaggctcataggtagaagggacttgccttgtctcagatgagactttggactgtggacttttgagttaatgctgaaatgagttaagacttcgggggactgttgggaaggcatgattggctttgaaacatgaggacatgagatttgggaggggccaggggtggaatgatatggtttgtctgtgtccccacccaagtcgtatcttgaattgtaactcccaataatccccttgtgtcgtaggagggacctggtgggaagtaattgaatcacaggggcaggattttcctgtgctgttctcgtgatagtgaataagtctcaggagatctgatggttttataaagggcagttcccctgcacacactctcatgcctgacgccatgtaaaatgtgcctttgctcctcctttgccctctgccatgattgtgaggcctccccagccatgtggaactgtaagtcaattaaacctctttctctttatagatggcccagtcttgggtgtttcttcatagcagtatgaaaatggactaatacattctctaaagcatcctctgataatcctttcttttattcaagtcttaagttagatctttggaacataaagccagattgttaaaactgtactgcataattttcatctaagacacttgttttaaggcattttttcccattgggagggttttgagattatgaagatgacactgtacatttgtaatgttttcaactttttggagcactcaagggaggtcccccaagaacactctttaagaatgactttttttggaaattacctaccgtgtgataaggtgtcagggatagagtggctccacacacagcttagagttttgacagcacaagactgtctgtttccactttattgctagtgatcatctcattcgacttctgatactacaagtggttttggccaagtctctctttttttccatctgaataaatttctgcttttcctttcatctttccttctgatagttttcatcacccagcttgctagtaaaacacatggctttaaagggccatctgatcttgtgaaatctcctttcctgatggtttttcaaaaataggagagcaatctctctggcatgttttaactcagctgcacctgtagcagcagcttgacctggacctgtggggtcaggacgagagaactgaaactcagactcccattttatagaggagataagtaaagctcaaaagaaaagaagtgactttccagtttctgtgggctctgattgcccttttgtacaaaaagagtgaaaaacaattctgggccaggcgcggtggctcacgcctgtaatcccagcactttggaggccgaggcggatggatcacctgaggtcaggagttcgagaccagcctggccaacatggtgaaaccccatctctactaaaaatacaaaaaaaaaaaaaagttagctgggcgtggtggcgcacgcctgtaatcccagctacttagaaagctgaggcaggagaatcgcttgaacccaggaggcggaggtcgcagtgagctgagattgcgccactgaactccagcctgggcgagaagagtgagactctgtttcaaaaaaacaaaacaaaacaaaacaaaacaaaaccagttatggtcattttttctctagggcttgataacatgtaagacaaattttaaatttacttgaaagaaagtgctatgtagatattgactatcattagacttatattttggataaggtatctcattttaatattgctaaactaggatcgatataactactagtattaaaaacatagaaggtcaaatctgttttcccccggaacacaggagaacaccctacttttgaacaagtgatgtcccattagatctttatcaattggtgggttggaacatgggttttcctttgctgagtgacatggtactgtctactgagctcttgatgttgccaggctctgggctgacagctctacatggattacttcaggtaatcgctacagtaagcccatgattggctatcattttaacctccattttatcgatgaggaaactgaggtttagagaggataaattctcacagcaggagtcaggcccaaagacagcactcttctgtctcctagaggagctcagtacaaagcccacagatagtgcttgccctagtttagagcccagctaccaagcctggagatgtgtctaagggacaatgagccctctgacctggctgctgagagtctggatttcccagactacagatgaatcaaatgcagtcatctgtgtttacaaactcacctaattgatccaacagggttagaaatacatgagagattcatttgttcattgattcaaataatatttattgagtacctaccatgtagtaggtacatgtcaacatggaagatgttgaggggtggcagcgggcactctcagtgatggatggggccctgtgtaaccctccaggaagcttcttggttttacatttgctcctttttaaccccttcttttcttctggaaacctcagggaagatctgagtgttccttcaccccttctgtatctggcttctgattggcttctttcctcccttctcacacctataagcttctctgcctgtctgtttctgaaggaaggacatcgcttatttgagggtttctaagggtgtttttttcctatcaattgcaagtacaaaaaatgttccttttatctctcctgtgcctagtacatggtaagtattcaataaatatttctttgaatgaatgaacaaataaatctctcgtgtctttctgaccctgttggatcaattagatgagtgttgtaaacatagatgattacatttgattcatctttagtctgggaaatccgggctcttagcagccagggcagaggaccagtccaggactcctaggatgatgttggtgaggagatggatggactagaggtgaatgcagaggcagccggggctgaggggaatggatgtgtgcaaggtgtggtgggagagggcgtggtggacttagaggcagtggtgtgcaggcagatcctttggttgtaagtggatgatacacagactgacttaaataaaagaggttgtttattggcaggtaactgggaatcctaaggtttatgctgacattaagcctgattggctctccaggggttcaaatggtgataccgtgacctgaaccggctacatcatttgcagggctcagtgcacaaggaagatgtgggatctcttgtgaaaacaaaaacagaaacaaacaaatttcaagatgatgacagcagaaagttaaatcaagcacagggcccttctaagcacagcacctgtgggactgcacagattgcagtctcatgaagctggccctgatcaggatcctgtctctctcaacaagtctcagccctggtgatctccgtttgtcttcattctcagatggattttctccatgtgacatcaaaatgacaccaacaactccaaaccttcatcgtctttagatctaatgatctcagagtaaggcaaaattctgaacctgttttcagagctttagtgacagtcccagagagaactctgatgggtgattggccaagattgggtcatgttcccatccctgaaccaatcacctggccagtggtttgtgttgctctgattggctagggttgtggcgatgggggtgtgatgggaaggcagggctagccccatgtagctcttatggactgtgggtgcattgtggaatgggaggggaaggtcccccaaggaagggatgctggatggacagaaagttagatcagcatcagctatagctggggaggtaggagacggaaaagtagccccacatcacccatcttgtgatgagagcaagtgggtatgtgattggatggggtgggtatagttgcagaagatgtggtttctgacaacagatagttgaatgagtatagaaaaaggggaacggtgaagtggggatgatatcttagggtgggggcagatggagaggaaggaatagaagacccttgggacttctggcctataggttagggtggctgtccttgcttgctgttcatgtattgagggggttgcatcagctgggccagcctttagtcactctgggccaggttttaggaattctcgtagttagtgaggagatgagaagcaggaagctttccatcagtttcctgcctctgggaggtagaagtagctctggagccatttccctgccacccactttgtgatcttgggcaattatattacccaaaacttagcttcagttttgtcatctgtatgtgagaatcttataattccctaatagttagtgggaacttgtaagatgcttggtctaatatctaaagtaggtgcttaggaaatacacactgttgttattgttaatattggtttcagggctttcaggaaacaaaggtcactgctgtgccacatccatgcattacatactcctccagaatacctctagccatatttacaatggagaactagaataatggttccctgaaagataccagctcctaatgcctggagcctatgaatgataccttatggcacaaatactttgaagatgtgattaggttaaggatcctgagatgaggaggttttcctggattatccaggtagttttataaggcatccttttaagagagatagagatttgatgtacccacagaggtggtaaaggcattgtgaagatggaggcaaagattgaagtgtcacagccacaagccaaagaatgctggcagacacctatagtgtacctggaagaagcaaggaacagcttctccctagggatattcagagggattgtggccctggtgaaaccttgatttcatcccagtaatatggattttggacttctaagcctccagaactgcgagagaataagtttctgttgtttaaagccaatcagtttatcataaattcttaaaacagccacaggaaaattgtacactcttttgaggtggacctttgttatttgctttggttctcgtgtttagcatgatattgcacctgctacagttttctggtttaaactctggggagtcaggtgagactttcaagatggcagtagcccatgccatttctaccacactgagctcctaaagagccataggaaccctaggattcaggttatatggagccagctctttaattctgagataatcagctaatggtgcagttactacctgagatgatgtatttcattgggaaatctctagactaaatgaggcacgagtaatttttaagttttagaagaacaataatctattcttagagttcacacctcatggaaattgttggttgaatatgagtaacaagcacgagacttatttcctcaattccccagtatttagaagtgtgaacgcccttcaggatcagcctttcccaccttccacatgctgcagaggtccactaagcagaggtccacaccctcatctgagaatttactgaatgctgcagtgatgttaacattgtttgttctgcctttcttgataggaatgtaattatccatataggattaagaataaacaaaatggcacttgagtagttatatcctgtctttgttttgggtaatattgcataatttatcctaaatgcttagacctctttttttttctatttctcagaacagaatttaatatttttgtgccactatcaaactttgaattccaaaatgacggcacattttggaccaagattcagacgataagttcattccagaaaggtggtgtttggccttgaaatgatgacaacaaagcattggaacattgctataacggagtcccttattgaactctgatattcttctcagaaatccatgttagaagacaattttaaaataaggatataattatgactcagacagatataaaatgaacatgtgtgagattttaacttattaattaatgtgggaaccagtgaggtgtttcaacacattcaaaggaatgccgaaatgaatttataaatagatgcaaaatgggtttatccatagggcaataaccacattggattccaaagatacaattaatttccattttatagtcacaaatcatttgcataattatcagttttctacatcttacatggtgtatattactcaaaggtaatgaaaggcagaggtaacttggaagggtgagttagacctttttttgggtctgtttcaaagtgttttacagtttttccagtatatgctttactctgacccgtggatcaaattctacttggaatagcactgtggtaatgtggacaaggaaaagcccagggacagagtgtgccagtcatagaggtgtctggggaacaagtccctttctcctttcagtgcagggacttgtcagttgtatagattctgaggaaccagttgcattgtagacatgccatcatcaaggactgtgtgcttacctttgaaagatcaaatagtgtaatggtcaagggagcgaacttgggttcacattttagctctgccacttactagctatatgacctctctgtgccttagcatcctcattggtaaatgggggtaatatggtacctacggcaaaggtagtaggtaactaaatacattaatatctgtgaggcagtagaccagaatctggcatttacctagcactaggtagttgttagctattattaatttccaagcaaataatagcacctgtaatttcagctacttggaaggctgaggtgggaggaccgcttgagcccaggagtttgaggctgcagtgggctatggtcatgccactgtgctccagcctgggtgacagagcaagacccagtctttaaaaaaggaatagcggcaaccaagtgtaagtcctgcatttcaccatttcgggagctgctttatgatctgatgcttattgtactctatcgatattccatgcatacgcaattgacagaggcctctggccaataagctcgtaaactctcttgtctactggatatcgtcatggtctctgggcattttgcaggactggggcacttctagagctcacatttaattttcagatgtcaacatagtgatgactttatctcaaattacatggaagcaaagcgtagggtattaatttttttaatgtaatgttagttgcattaacttttctgtaaagtactaatggagttccatgtaaaatgcacttagaaacacactgggtgagtttcacaaaacttcagactgttgggttggagtcatattattctttagtatttacttacgttgtttacatgaaaactgatttcagagtgactgtacctgggtgattaaccacattttcataaatttggatgcttttcatatagtttctaatgaatgtttgataaactgttaaataaatgagtatgtgtgtgtgggagcaatcttcagattacctgttttgcacagtagtgcaaaacagctgtgtggggaaaagttatatgtgtcattagtaatttttatgactcagttcggtattatgagtctacctgtctgcacagcattttcatcttggtgggagaaaattgacacatcatggtggatgtaaaagttttccatgaagaaattactcagttcctttgactgtgtaggctgttggatgctgtcttttctctggacaagcatgtggcattggctctcagtggacagttcatctctcacagataaacagtttaccttccaagattataatagctactccccctggctcaaagtaggattacacagttaatagagagagctgtagcaaagtttggaaagtgtaatgacaacattatggcttgaggagaagaaagtgccgattttcctttgtttgagtttgttactcattttgctttttatctcatataactttttgcaaaaagttacgaaacagaagatatgatcttatatgtttctcttttaataaatatttgcccgcattaatacctgcaactacagaggattcaagccagtacattttaaaaatggatcttaggtggccagaattggattaatcatactttttggctcattacacactattgttcttacttgtaaataaactgtcatgattctaatgacttgaatactttttcttgaaatatagttgtttaacttttccctaaatttggcaaaataattgctgtctgaactatctaaatataaagctagctttggacaggtttggaacatgttttaaaaatcacacataggctttcatgataaaaataagggtttgagatcagaggatgaactcatggacttctttgaccttttattcttgcggaacttcacagttgagtgatacattgatgcttggttaagtgacatgggtaaagtttcggtcaactgttttcagttgttgtaacatgacagaacatgctagccatcttcagtgggcgtcctcaaaacagagagggatggctttagaattctgtttggaaatgacctaggaagtcagtcatctaatctagctcctccagccctgttgcaacccaggagtcctctgggtgcctctgccacaggcaacttagcctgcacttgaatctttgtagggacaaaaaactcactccctcatgaccaatccttttctttcagagacaactttaatgattaaaaatgaaattggttttgttgagcttaaatgtgattccttaacacttctactcatttgctggtattattggtctccacttgtagatgacacaaaaacagtcctcctgcttatagggaattctttgttgcatataaattctgacttttgtcagaatttgtgttttctcagtgtgcttctctccgataagatcttacgatatctgctcaattcaacaagttgagaatcagttacatgcaaggcactgtactgtcctcagtgcctgggtgggagaggtagggacacaagatgacttggttcctgccatccaaatgtatgctgccacgtgaaatgcattggaaaagcacacagattgatacaacagagaaacccaatgccattggggttcaaaggagaaagagtgatatcaaactcagctgtgctagaagagcttcagcatcaggagggaagggagataggcaggtaggatatttttgcaggttgagacgggagaagggcattccaggaagaaaccagtgtggacaaaagcccagggatgggaaacatgagtttgtccaaaagaaggggagtatcttatttgctcagcatgtaggatgcttgcagagaaatgaaggattagatggtaggttgatcccagagctcagacaggcttgatctctctgcctcagttatttgtgttttggtactaggattccattgcaggagcacagacctggatttggatccaagtattgccacagagcttcggcatcttagtctgaaaatggagatttgtgtccattctaaggattccaggacatgtaagggaagaatccagcactctgcctggtacacagcagaggagatcagtgacagttgttattgctgaatgtgataggcctcaggaggagatcctgcagggggttcagggtggcgcatggaggaagacctgtgagagatgctcctccagcgggaagggaaggtgtgcgtggcagtgctggagtgggagtagggagtgggaaacagggctggcatcagtggggaagctggagtcggcagaactggaagcagatttaatgtactgggcaggaggaagaggagaagtcaccccaagtttttgttggggaaggagggttaggcaagaatggtgagtttggtatcgggtgcgttgaggtgctggtgggcctgcagatggagagagcccacagcagctggcagcggggggatgctgggccttaggagtgagccagggaggtggaaaatgcagcatgaggagggtcaggatccaaacggtgtgctaggaatgcaggcacgtgcaagcaagggagggtccttgatcatgtagagcctgcactttggcgtgggtatgtggaaagcagccagcacccaaccagggctggcgtaaaagcaaagaaaggaaagaattcaagagacatggggaagggaaaattggtggagacagcctgacagatgattcccagtatcttagagttctcaggaaaaaacggaaaacaatcttcacattgtttttatacacacacatatgcacacacactctctctctctcatatatacaagttcaatccaaacaccatctattatttggtcctgttagtttcctcagaaagaccctcaggaaatccttgctctcccagagattgtgtctatgtttagaagacttttagaaaaagcctattgttaaattttagtttactgggtagtcactaggagaccatagaaatgtaacccacaggttggctgtattgagtgggcttttgttttactgaaggccgtgtggggaaaacaggactccgtctttggtgagtggctcttcctggtactgtgaacccagggaacccaagaagggaagcgctgggggtcagggatcacctggcctgacccccttgtgtaacagatgaggaaactgaggcctaggccattggaaccagctcagggtcacatggcacatggctcatttgaggcagagcctgtggcttgatgttgggcattcctgctacttgaagttacctgtttatcccaggccgggacctctgggctcatttacaagtggatggcccaaagaggggacttcagttaggggagtgtgtgtgtgtgtgtgtgtgtgtgtgtgtgtgtgtgtgttgggggttattcagggaccattcattacagagcttgactgtgggaaagagtagtcagatccaagtgattattgtagtgccctcgtcatttattagcagatctttctaagaagtgtcctacagaggagagtgctaaaacataaagggtgaaacccttgtcatcagaggtctttacgtagaacctaaatatccacccactcgagttagcaagagttaacattcactgaggactgatggtgtgcctggcactaagtgtgttttctatggaatgtgtctcatttcatcctcttagtgtctttatgagataggtactattattatgctaattttacagatcaggaaactgaggcaccaagggattaagtaacctgcccaaggtgacacagccagtaagtggtagaaccaagattataccatctgttaacctcagagtctgcacgcttatctaatattagtgagtcttttttttttttttgagatagagtttcgctcttgttgcccaggctggagtgcagtggtgcgatctcggctcacagcaacctctgcctctcaggttcaagcgattctcctgcctcagcctcccaagtagctgggattacaggcatgtgccaccatgcctggataatttttgtatttttaatagagacggggtttctccatgttgatcaggctgttctcgaactcctgacctcagatgatccacccacctcgccctcccaaagtgctgggattacaggcgtgagccaccgcgcctggccacattagtgattcttaaccttgctgcgtataagaatctcttgggaaaattaagaaaaattccagttctcaggctacatcccaaaccaattgaatgaaactcatgggagatcttgcattggtattttcttttaaagctcttcagctgggcttggtggcttatgcctataaccccaataactcaggaggctgaggtgggaagattgcttgaggtcagaagttcaagaccaacctggacaacgcagagaaaccccatcttttaaaaaatacttagctaggtgtggtagtacgtgcctgtagtctcagctgcttgggaggctaaggtaagaggatcacttgagctgagaagtttaaagctgcagtgagctatgatcacaccattgcactccagcctggcaacagtgtgagaccctgtctccaaaaaaaaaaaccgctcttcagatgactgttactcatagcgaggttgaaaaccaccagagtgctccacagccggtggagatgttatagggcagtgcctctcgaactaatgtgcataggaatctcctgggggtcaagtgcacattctgacctagaaaacctggggtggagcttagagtctgcatttctcacacgtgtccaggtgatgctgtgctactggtctttgacttttctgtcttggttgaaggctaatcattgtggttgtgtccaactccaggatttaatggctctagtgatacttataagaacacatgatttggccgggcgcggtggctcacgcctgtaatcccaagactttgggaggccgaggcaggcggatcacgaggtcaggagatcgagaccatcctagctaacatggtgaaaccccatctctactaaaaatacaaaaacaaaaaaaattagccgggcgtggtggcgggcacctgtagtcccagctactcaggaggctgaggtgggagaatggcgtgaatccaggaggccaagcctgcagtgagccaagattgcgccactgcactccagcctgggcaacagagcgagactctgtctcaaaacaaacaaacaaacaaaaacaccacatgattttactgtgtgtcagcctaagaacattacatacattatctcttgccctctcagcagcctctaaaggaggtatcattttccctgttttatagatgaggaaatcgaggtctattgagtttaaccctagtcctaacctgagtcttcgtaatcttacacctgtgggattaactaccatgctatgttgctttcctatacatatcgatatgtgtttcctatatacgtatcgatatagttaccaagaacatcttttatggccttgtctttgttttctaacttgatggattatgtttggaactctcttagtgtattcaggatgctataacaaaataccgtaaactgggtggcttataaacagcagaaatatttctcacagttttggaggctgggaagtcaagatcagggtgccagctgcttcagtgtctggtgaaggcctgcttcctagacggccatctttttgtttataacttcacgtggtggaaggggcaaggagtctctctaggacctcttttatgagggcactaactccattcataagggcttcatccttatgacctaatcaccctccaaaggccccaccttctaatattgtcgtattgggggttaggatttcaacatatgaattttgggagagtggatacaaacattcagcccatgacactgttcatttatttaataaatagttttttacgcctactgtgtactcagagctgtgctagatgctgggggtgcagtggtgataagaggagacatctactatgtacaaagtagagtggttgctgctgttgtctgcttggctactagaggcacgtggagcttcacaataatatctgcatggcacttcggagttttcaaggaacttgcacaacaaacccatgaagagttattatcacccacattacacagatcaggaaactgaggctccagaggtttatgtgtagtccaaggttgactgtctaacttgcaaggggcagagcagaaatgtacacccaggccagtctcgcgcagttcctactgtgccacactgcctcccgcactgcccaggggtggtatgggtggaacttttttttgttttgttttgttttgagacagagtctcgctctgtcgcccaggctggagtgctgtggcataatcttggctcactgcagtgtccgccttctgggtccaagcgattctcatgcctcagcctcccgagtagctgggattacaggtgcacaccaccatgcctggctaatttttgtatttttagtagagacagggtttcaccatgttgcccaggctggtctcgaattcctgacctcaagcgatccgcccacctcggcctcccaaggtgctgggattacaggtgtgagctactgcacccggcctggatggaacttaatctccatgctgatgccaatcaaaactcagtggccaggtgtgttggctcacttctgtaatctcaccgctttgggaggctgaggtgggaggattgcttgaggccaagagtttgagaccagctgggcaacaaaacaagatcctgtctctacaaaaaataaaaaaatttgcaaggcatagtagggcatgcctgtagtcctagcttcccaggaggctgaggcagaggatcacttaagcctgggagtttgaggctatagtgagctatgattatgccgttccagcctggccaacagagtgagaccctgtctttaaaaaacaaaacaaaagaaaaccacacacacatgctattcctgaatcaaatggagagcggcttcccctggggtgcctaaccaagctaaatgctcttgggatggtgggatggtcgggatcctgtgccttcattcccctgccttaccaggtgggttcagagggtatcaggagttgaagggccaggacaactccaaagctgtgacaccctcaggacgtagctggacccagcagatgtgcagaccagcttagctttgctctagttttacttgaatgaattgtggagaacacaattctagttgtggagaacacaaacatttcgaccatagcaggagccccacccagagaccatattccaggaacccagcagttactggcaacttttctggttccaagtgtccttgttcttgcctccttatgttggacctggtattgatttatgagaaagtgttgtaggtttctttgtgaagtatgtttatgatgttcagactgtttccagtaaagtttgttatcagtaccagaaaggcttattgcatttgcaggatataaattctagatttgagcatggttcctggattaatggaccatactagtaccttgaaaagcttattgaattataactcttggactcctccccagacctaataatcaaatggatcaggcctggcgacctctgtttttgaaagctccccaagccattttaatgtacactaatatttaaaaaccatggttgttggctgagcacggtggctcacgcctgtaatcccagcactctgggaggctgaggtgggcagatcatgaggtcaggagatcgagaccatcctggccaacatggtgaaaccctgtctctactaaaaatacaaaaattagctgggcatggtggcaggcgcctgtaatcccagctactcgggaggctgaggcaggagaatcgcttgaacccaggagtcggaggttgcaatgagccaagatcgccactgcactccagcctggcaacagagtgagactccatcttaaaaaaaaaaaaaaaaaaaaaaaaaaaaaaaaaaggttgttatgaactgaatgtttgtgttgcaaaaaacatataactgaatgttatgaactgcaaaatttctatgttgaaaccctacccatgtgatggtattaggaggtgggcctttgggagataattcacgttaggtgaggtactgcaggtggagccctcatgactgaaattgatggagagtcatacaagagcttgcctccccactctgttctctcccatgtgaggatacaaagtgatgttagcagtttgcaacccagaagggatccctcaccagaacctgactatgctggcaccctgccctcacatccacagtctccagatctgtaagcagtaaatttctgttattagccactcagttcctggtattttgttatagcagcctgggctaagaacatggtctggaccagtggttctaaaaggtagttcctggaccatcagcatcacctgagaacttgttagaaatacaccttatgaggccccacccagacttactagaaacttagggatgggtcctgcaaagttttaacaagcctccctgtgattctgttgcttcctaaagtttgagaaccactagatccttgtgattcaaaatgtgagctgtggaccagcatcatcagcagcatctgggggcttgttagaagtgcagggtttccggccccacctttaccaactgaatcagtatctgcattttagtgagatctgtgcatattcacatttgagaagctgcactctagatagtcgttttctttccgggatgtgcattttaacccgagatgccttaaaaagataccaaggccttgcctccatccaaggtgattaagacagaatctgtgaggttgggcgaggcctagacatggtgtgtggagaccccggtctaagagttggtgcctagattggagcccaattttcacacctaaaggataagactgtgaaaaggggtcaggactcccaacactgctttctccttcctcctctctgctcttccaccatcccagaatgtgaccccacacccaggctccaggagggaaggctcaagtctccctgcctcaaaaagatccagaggcggctgggcgcggtggctcacgcctgtaatcccagcactttgggaggccgaggtgggcggatcatgaggtcaggagttcaagaccagcctggccaatgtggtgaaacctggtctctactaaaaatacacaaattagctgggcatggtggcgccaagatcacaccactgcactctagcctgggcgacagagtgagactctgtctaaaaaaaaaagatccagagggaaaagttctctttatattttcagggttgtgtgtgtgtgagagatcgagggaggcacagacaacagcgttgtgtgtgttggagggatggaatgtggtatctggcaccaggccacagtgcttctcacacctgatgtatgtaagagtcagtcaccttcacaatgcagattcctgggctctactccagagagccagtatcagtagggcttgggaaggacccaggaatttgcattgttaacaagttctcccaaattcttcttatgtgaaagtctagggtcctgctctgagacaaacactactcaaaggctgtgatctggctgattctcagaattacttggagaaactaaaaagtacagggctccaggccttgccccagctcctctaattcagtaggactggcgaggcccaggaatcagaatgttgtagtgtaaacatatctgaaagcaataacttaagcctacccttagaatgaccctatatggcagatgcacctgaatgtgtataccgagctacggaatccaggattcattccttgtctgtgagggacatctgagccccacgctcatcctgtggagcatgagccgtgcatgggattgagacctttggttttgggttaaatggaggttgccaggtggaggtggaagttgttgggggaagggtgctaagtgaaaatgctatgtaaactgcatgctgtttgcaagtggtcgcaggtttcctgcccagcacactgccactgggcctccagcctctcccactggactgtgtgtaaggcggtctcctgtgcagcccgccgccactggactgtctcctgtctgtaagcgcccaataaaacctcatgcctcatttgctgcctccagatctcttcttgccatttctgttgaggttaataggggttcagtataatgcatgtttaataagtactctgggtttttcaaactgtgttctcagaaacccttaggattcccccaaagtatattggaggctaccaagggggagaggtaagaggagaaccaaggttgttgacaggagggggggttcaaacactcaacccgcttcatctgcttcatgtattaagcttcagtgtacaattgcatttgaaaagaggattttttttccaaattttgaaaacaagtcatagctgttcattgataagggcctctttaaagttggcagtgttctccttttgagccacagttcaggacagcctctcgcccttgtgaccacctgtccttcctgacacgctgacctttagtccctgagctgcctcatacctggcccatgatgctaactatccacaatgaccctgactccattcacattgtgggattgcctggctctgccatttgccccaattaccaaattcctttactactgaaagaatgctggtcacaccagaaatatgctttgtacaaatcatagtacctcaagacagtgagtctcaaatatggctgtggctttcaaatatttttctgcacgagaatcatctggagagcttgttaaagcacagattgctcagccccaaacccagagtttctgattccatgggtctgaggtgggacgtgagaacttgcatttctcgaaagattccaggtgggactgatgctgctggtctggtgaccacacctagaacaactgccttaagattaaataatgttggatacagcttgggtccaattctcctgttaggtgttttctcactgagtagttcctcctttggtgttaaaatatatgaggagaagaagtgctggaatgaagaaatcagtgtcagttgggattatggctcagtcctgctctgcactaattaggttttgctggactctcctgcccagctaacagccatttatgatattgtttctgcaggacagtgcattgcatagtatggtccccgtgctgctcatcgtataggccctgccagaatggttggcaatgacaaggatctgacagtagcttcttattgccagggcttgattagaatgtgacaagtcattgctgaacattggttaccataaaggcaaatattttgtcttccctgaaacaaatagtaagaggagaaagtgtcctgttgtagaaactcccatctttgtagagatttccatcctttcagtcttagacgcttgcagaaagctggcatggtggcaaggcagaggtgtcctgtcagtggccaagcaaacagcaaacacatgctcatggtcactgctgtctaggtcagaggccttcaaagctttgatcaaatacaacaccagtcactgttgggaaatcctcctggacatgtcccctcatttgttgaaatgttttgaccaggcaaatgactataattattgttatattaaaaaaatagcctttgagttttttaacctctgtaatggttcagctctgtggtggaaaatatttaacttcaattttcagaagtacacctgagtgactttattaactacccttgaacaaatgcaaggggtgagttaataaggtggttacatttgtgcaggtggtggagtgagcatctgtgagacggtggaaagaaaatgtttgtgttatgttgggtgggtaaggacaggtaaaaccaccttctccttttctgtgtgtgaggctggctggctgctttaggataaatacttccaggtgagtgtgagcacagatgctgctaggcattgtctgggagtaccctggaaggtcaggcccagcgtctcttctccacagtgctcttgtgggtggattttccagctctctttatcctgctgctgaaggaagtagcagacaatcaaaaacataaaaagaggtcctgggcatgatgccctgaaaaaacatttctagcactgggctgagcactttggtttttttgttttgttttgttttcttttttttttaaaaaaaggggtctcaccctgtcgcccaggctggagtgcagtggtgtgatcttggctcactgcaacctctggctccctggttcaaacgattctcatgcctcagtctcccaagtagctgggactacaggttcatgccactatgcctggctaatttttgtatttttagtacatgtggggtttcactgtgttggccaggctgatcttgaactcctgacctcaggtgatctgcctgcctcagcctcccaaaatgctgggattacaggcgtaagcgaccgtgcctggcctaggctgaccactttggaaacatcgcattcgatttggtccttcccttacaatacgtagaataataaaagctagcaatgttggcaggcttcctgagttccagactttgtactggttgcctgacgttgaggtgggttctgttaaaatggggtcgtatcatagaaacatcgaatgtgcttgaatgacgacatgtgcttggcagaggcaaagagattgtgtttaaacaaaacgacctgctcaaatgtagaaagacattttgagagccagtatgttggtcctactgagtagatttgcaagagtaattttgactgtaagtgattttcatcttaggaactaacttcactccctgctttgctccccctccaaatgaggcttctttcaaccatccccaatttatagatgttgcagttgaggcttaagagggttaaataacttgctaaaggtcatgcagccagttagtgatggaagtcagatttaaacctgtaaacctatgcattccaactctgaaggttacgcttgtcaccagtgctggggcatgctgtggtgtatgcagagctgtgcaaccaggtgacggcagaacttgaagcgctgtccacatgaggagtaactgcaggaatgggtatattgagtcagaagaaaagaagtcacaggcagggtggtagagcttccttccaaccttgtggaaaggggaggcaatgagtgtagctctgggcatccattttaacttggtaagaggcatgaaagttgtaagaatcagaatgtcacttgtgtcaaaaccctgacaaatagagctgggagaggccacgaaaagaaggttctcacacatatatgcctgataacaagaactgtcacaaaaacctctgcaaaaaccacaaccttgcacaaagcctgtggcagtcttacacacaaaaacatatttctgcaaggacatctgcccagcaactgcctgtccaacgttgggttgatgccaccattgttactgatacctgtacccaaggataattgtctcaaaacaacttatatagccatccttatttttccttgaaaagcccttgttttcctttatctccctgaatacactcacatggattcccattgcaatgcccattccttaataaatatcatttttttttttttaaagagagtctgcctcgctgattgttacttaggtttgataaggtaaagtcttttaaagatggagctgttccaacttcactgggctgtttgcaggtagagatccttgttggagctacttaacttgtgcagagagattgtagatgagttttaatcctagggtaaggtcctgcccatcctgacagtcagtgacttaagctttggccacactttggccagtttgtatttgtcctcacagagttctgtgggctttatgataagctgtttgatggaatccccttatatgggcatggcgatttttttttaaacagctttattgagatataatccacataccatacaattcccttaacgtatataagtcaatttttttgtatattattttaaaaattatggtaaaattggtcgggtgcggtggctcacacctataatctcagcactttgggaggctcaggtgggcagatctcttgaggtcaggagatggtgaaatcctgtctctactaaaaatacaaaaaattagccaggcttgttggtgcgtgactgtaatcccagctactcaggaggctgaggcaggagaatcacttgaatctgggaggtggaggttgcagtgagccaagattgtgccactgcacttcagcctgggtgacagagtgagcctcagtctcaaaaaaaaaggaatatatatatatatatatatatatatataaacataaaatttgtaaaatagtatttattgtggctagtattatcaaagatgagtatttttctgcacctggtaacttggccaggaaatcattggaaagctggctttgcatttgtatttgatagtatttagtgcttgaaaatgcatggatatggaggcctatgctgggtcttctccctgcatcacaggattcatgaagttattaatcatatctgtgctgatttttattttgacgacttgttcatacagccacagctgtgagagttaatgcagcaggctcagcatggtggaattagcagaagccctggaatgaagtgaagtgactctttgggaagattcagttattcctgcaagatgacaaaatacctaaaaccaacacaaccatttatttgcttatggttttgcaatttaaattggacagggctcagtagggacaacttgtctctgctccatgtatcagcgtggacggcttgactgagagcagaggatttacctccaaggtggcacactcatatcactggcaaggtggcactggctgctagttgggagcttagctggggttgttggctggggacctcagttttcttccaggtgcacctttccacatggttgcttgggcttctccattacatgatggctaggtcccaagaaggaagaagtgttgctgcctgaccttcctgatgcctgggctctcaggtcttagtatggcacttctgcatgtcactttcagaacagtgacaagtccagctcagattcaagagagagggaacataagctctaccttttttttttttttttttttgagacagtgtgtttctggctggagtgctgtggcacaatcttggctcactgcaacctccgcttcccaggctcaagcaattctcgtccctcagcctcccaggtagctgggcttacaggcgcccgccaacatgcctggctaatttttgtatttttagtagagatggagtttcaccatgttgggtaggctgctctcgaactcccgacctcaggtgatctgcctgccttgacctcccagactgttaggattacaggcgtgagccactgtgcccggccggctctgccttttgatgggagtagcagcataaagtggtagggaggggtagaatcatttgaggtcatctttagagactagctaccacgaagaaccacaatggtcttttttctctttcttcctcattctcactccacagaagcctgtccctaatcattgtgtgagccagtgatgacaaatactggcaagaaatctaagaaaaaatttaaaaatcagtactaggaatacatagtatttaagagatcgtggcttggtctcaaactccctacctcaagtgacctgctcatcttagcctcccagagtgctgagattacaggcgtgagccactgcacctggcctgctcttaatgattatttaaatttatatttgtttagtgattacacattatttgcttacttctgacatactctgagtctcactcagatcagagattataggagggggaatatatttactagaataatttctccattcagaatgtcagaaataagaaagccttttttttttttttttttttgagacagagtcttgctctatcacccaggctggagtgcagtggcgcaatcttggctcactgcaccctccgcctcccggttcaagtgattctcctgcttcagcctcccaagtagctgggagtacaggcacctagccaccacacccggctaatttttgtattttattagagacgggatttcaccatgttggccaggctggtctcaaactcctgacttcaagtgatctgcccatcttgatctcccaaagtgctgggattacaggtgtgaaccaccatgcctgacccgagaaaacctactgaacatttttaaattttatatgttactgcttggaaaacagagctttgcttgttcctttcagctattccctgatgagcccttaaagtccacaattctgtttcagcttaatttctgaaaatagttataccacattttcacagtaagagagctagtagccagatgcatcgtgtgttttgtttgcaaatgcatcatctgctgtctagcttccttccatggagaggaatggccttatatttcacagtgaggcttcaactgctgctcccttttggcatgtcaaagtctaattactgtggtctctgtagcaggggctgtatccacagcctgcgaatgtttgtgttctacgatgatacttgggcatcagtgacatttgaaaggggtggttttttgagacggagtctcactctgtcgcccaggctggagggcagtggcacgatcttggcttactgcaacctctgccttctgggttcaagtgattctcttgcctcagcctcccaagtaggtctcgaactcgtgacctcaagtgatccgcccgcctcggcttctcaaagtgctgggattacaggcgtgagccatcatgcccggccttgaaagggtttttattttagcatcaaaaatctatggcatggcttggattgcatttcttctaggctgttccatccttagtcacataatgctactaattcacctgaaggaatgctgtcaaaataaatcaaatggtaattttaaaagactctgtctcattcattgtagcttttactcagttaagaacagtttggaaatatgagccttgagcatgagaacactcacgtagcattttattttagcttaatgctgctggctgtcattttgccgctatcactgttttacgctgaatggttaaatgtgagaaagaaagaacaaaatggtagcatattgtgcttgactcattgagaaaggctgttttaggttaatgtagaattccaatagtagaaagaaaattctatcccatatacaaatgtgacttgcctctcaagagcttctttgaaggttattttggagcgtgtgggggatgaatttggtgcataggataataataattgacatctgtctggtgctactctgaaccaggaactgtccctaagtgctttgcatgtattaattaatctacatataagcgctctttgtattatttccatttacagatagaaaaattgagatgtaaaaagataatagaaacaaggccacacagctagtcagtgttgagctggggcttggttttgactgtctggcttcagtggactctggctttagccactatatgacactcgctaatcaaagtaagttatgttttcttagtcttttttttccctttatttgaaaccaagtttcagatgttgatttgcaagttggcagtcatttctgttttataaagcttattttttattgccccagttttcaaaaaagcttttcttgtttaacatttttgcctgatgaaaataaaagtcaacttttcaaacagattatacatgttgataatagtgctagtcatatgaaccactaatagtatgttaagaataagtttcaaagtaaaaataatgtaagttccaacatagtacatttatcatatagtcgagtgaatagtactctgtctcacatattgtttagattgtagaaattacagcccttaaaaatttaagtatgtttaaagtagcccttaagtgaattaacatttcttttttaaaaaaatattattgatttttgccaaacaataaaagtaataacagacttttagaaaatctggaaagtataatatggtataaacaaaaaattaacactgtgtgtaatttcaccacttataggtagatgattcattcatgttagcatttaagtctatttgccttccagccctcattcatgcatttactccttccacgattactaactgattatcttctaggcgcagggcaaaagcagcaactaaaatagtctttctccctgtggagcttatactttactggaagaagtggacaatgaccagataaatatgcaatatgatgtcaggtagggaaaagtgctttaaagaaaaacaaggcagggtaggaggatagaggcacaagggctgctgttttgggaagggcagccccagagaaggctgagtggttttaggaagggagcctgtgactgtctggtgaaggacatgacaggtggggacacagccagtgcaaggccctgtgatggaagcaggcttggtgtgtctggggaccagcaagcaagccagggtgaccggagtgtggcactcaagggagtgcaaggaaatgacatgggagagatggcagaggtttgcaggctgtaaaaataagggctttgcatttcactgagtgaggtggaagcctttggagggtttgaggcagaggagtaatgtcatctgggtttggttctaacagattccttctggttgctctggtgagaatagactgcaggggataaggtggctgggagaagggtttgcggggaggtggtgagaaaaatggtcagattcaggatgtctttaaagtagagctaacaggatttggagctggattggatgtgtgttatgatgaaaacagaagagtcacatatagtgataacttggtgttgtggtctgaaatattgcccttccctgattcacgtgaagtcctaacccccagtacctcagaatgtgagcttctttggacatagggtccttgcagatgtaattatttaagatgaggccattccagagagtgtgtatgtgtgacgtaatccagtggactgatgtctttatgaaaaggggatatttcagcataagcatataataagagggaagatgtgaagatatagcaataaggacatctgttaagccaaagaacgcttgaggctaccagaatctaggagagaaggatgaatagattatctttcagtcctcaggaggaaccagtcttactgacatcttgatttcagatttccagcctccagaactgagtggtagtaaatttctcattttgtgatacttcgttatggcagtcctagtaaactaatacacttggtgagcaaccttgtgaatggccgtcccttttaaggcagtgaatgccaggaaggagcaggtcttagagtttggggtggatggaggggacagaagacatgctaagtttgagaagcctgttagatacccacatggaggcatcgatgagaccgttggatgtggaaatctggagttccaataagaggacaaggccagacatctaagttcgggcactgaattagatcttcaggagaagggtccaaggatcaaggaggccctgggaaattttgacatttggagggtggggagagaaggaggagacaggagacagagcagaggatggcagtgaagtgggagaaggctggcagggcgtggtggctcagcagccatggggggacatggggaggaggagggaccaggcctctgtggccagcatggctgatggtcaggaatggagaggaccaagaactcccactggatttagcagcctggaggccactgatgacttggacaagaacagattccgtggaaaagcggaaaagtggatgcacaaggctgattgaagggagttcaagaggaagtggcattacatcataagcattatccagtgtcattaaaaatctttttcaatcagaggctggctaggaagagtgcatgggtgtgtgggggggatgaagagaaattggttaatgagcacaaacatacagttagatagaagaaagaaattctgagtttgatagcagagtaggtggctaaagttaacaacaatgtgttgtatatttcaaaatagctaggagagaggacttgaaatgttcccaacacatagaaatgataaatattcggggtgatggatgccctaaatatgctgacttgatcatcacacattctctgcaggtaacaagatatcacatggaccccataaacatgtacaaatattatgtatcaattaaaaaaagtttttgaacattgtttttgatgactgtatcacattctaggattttaatcctttttttttttttttttgagatggagtcttgctctgtcaccaagctggagtgcagtggcttgatcttgtctcactgcaacctctgcctcctgggttcaagtgattcttctgcctcagcctcccgagtagctgggactacaagtgcgtgccaccacacccagctaatttttgtatttttagtagagacggggtttcaccatgttggccaggatggtctcgatctcttgaccccgtgatctgcctgcctcgacctcccaaggtgctggaattacaggggtgagccaccaggcccggcctaatccattctttacttgttttatgggtaggatggttctaacttttaccactatattggttgtgatactgcagtggacatatttgcatacaaaattccctagattaggaatgacaagacacaacaggatgattatttttagggcttaatcctaaaatatggccagtcatttacagaaagtctgtaccagtgtacactcctcttggcatgtaggagtgggcttgtctcactgcacagctcccctccatgtatttttgaattgactagaacatccagaaaagcattgttacagaggtgatggtagggcttatgggctgaattttgtttccccaaaattcttctatagaagtcctaatccccagtatctcagaatgtgagtgtatttggaattagaatctttaaagaggtaattaagttaaagtgaggtcattagtgtgggccttaatccagtgtgactgatgttcttataagaagaggcaatttggacacagagacagacacagagggaagaccgagtgaagtcacagggagaagacggccatctacaagccagaatgaggccaactctgctgatgcattgaccttggacttttagctcccagaattgtgaaagaataaatctctgttatttaagcccctgactctgtggtactttgttatggcagcctggcaagctagtacagtgggcattagtgttttgttcctgatttacaggatgatgtctctggtgattatactaaatcatactggacctgcatactagacacatatatttaagaatatattataatttatcctcccaaacctgatcgcttatgaaacataaatcctgaatcagtggggtctattcccattttgctgctctgtggcagattttaacactgacatttggcctggtccgtgtgttatttatttctctccgatttcaggtctcctggttaaattcatggtctcagggaggtctttcctaactccctgacccccactgtgatcaccccccatcagacactcctcttctctttccgaaagactggtaatagttataattactttccctgtggggtctccctggctgggttgtgaatgccaaggggcagagatgatgtaaaaacatcatctctgtttccagttctagccacagggcgtatgacagtgcctggtgcaaaattgagcatagaattgtcactcagtattttgttgaatgaataaggcatgagtcaaacttggccacttgcccaagggcacagagctgggatggggtggggggggcttcacactcaaatctctgtgaccccagagcatagctccctcttgtacgtgtctgctcatcagtagatgagcttgggcaaggaggtgtgtagtcacattttttgattttctctcaggctcggtagtagctcctcaaggaaacaaaccatttctaagaattctttgtatcctttatggtcccttgaatataataactcacaaatatttgccaattgtccaattaaggccgccatgttcctctttctacacctttgttattatgacacgtagctgtatggtgattctttttctgtacttgtgtctttcctattggactctgatctacttgagagcaagaaatttgtctccatcttttgtctgcagttcttggcacaatgcaggcatttaagagggggctcaattggatgaataaagataacatggatgggattaaaacaaatttaaagattatttagaaaggtattgtcttcctttgaatgaactctaaagataacagttataacaatatatgtgcataatagtttacagtctgtaaaacccaagatttttcaaaatatgtactcatcatacatatatactagcatgaatgcacaaagtaaaattatactattagagaaggtgcttaaggagtgaatggcagtgaataatgaaataacgtgttttaattcactttatcaatgctttaaaagctggtagtatcactttatagttctaattttgaatggctgttaataccatattctactcaacctttatggttcttttaaattttttcttggcacaaatagcgctgctgtggacacctacatatatgtatgcccagttatttcctttttttgattattagaataaatttctaaaaatgaggctactgaaatatttgaaacatattgttaaactgctttctaaaaaggcttgtaccatattccttacctcctttgcagcacttagtactaatatttatattttctaaaaaattagccgtgatgtatctccttgttttagtgttcatctcttttgatgactttgttaatttggacattaccctataagtttctttactaatttcatttccctctgtctaaattatctatttctgttctttttttcattttttgattttggtcttcctttgttaaaggcaacttttattaattttttttatataatagcattttcagaaaaattttttttctgggttatttttttcccttttgctattttaattaatgttaaatgcttatatacactaaactgtagatagatattttaactttttcttttttttcattgaatgcctgtgattaaaaaaagttatacatggcagtgataagatcagaaacaatccaggaaaactgctggttgttttgtattacaggacttgtgatttaattacgttatattctgtgagtgcttttacaactattgacggtattgggaagagtgtgtttgggcccagctgaccacctattttaaattacatcacatggttaacaaccactcctgctgagcttaggtttagaaaacttcaagcttccagaacacagctcttggggagctgggaattctggggctgtgtacttgacataaaggcattaaactcctgaatgaaacatgagattctgtacccagcctttgtgacttgtagtccctttaatttttgctatgctcaactatctggttggtgaagttgttactcgtaagattagaaaggcaaatagggtaggaaaatagggtggaaagaatgcttgtgtgacttgacgatctgactcagagggaagagagagaacaatgaaagcaaacacccatccctcacaggtttcaaatagattttcataaggatgaaagacctgtaaagatttattaaatatattggtgattgatgggcatggtccacgtatttagaaaatttcattatgtggaattcttcattattccaggagactggatagaaaaggcattgggatgttatgctaatttttttttctctttagggattttggaggaggctaacccagagacatttacaacgaaacaacagcatttatttggatttggtacaaggagcaagcagacagagtagactaaaatgtgtgacctcatgctatatttcttgtgatctgatatcacttagtgttattgaatgacttcaaagggcagctgggaattactgtgaagacacacacagcaaagcaatttctcacctgctgtctctgatcacagaagacacagttagactcacatttctccccaggacacatgcggtagacatgctgcaacttgtttggagagaaaggcaaggggcagagagtcacactgtttgcactgtgtggactgagacaagttttaaatataactaagggttacttttttagaattaaaaacagtagaagctgagcttcagggcatgggttacttcctaaaaatacaatcactgaacttttaaagaactctaggatcagcttgtcaaactggagtagatacgaatgtgaaagacatctgagactctttagtacttggcgcacagattgagaattaactcaattttgactgtttcaaatgatgaaagtattttcagaagaccaacctggtagccaggatggtgtagggttttgttgcttaacctgctcacctagatcttgatgtcagtgggctttctgcaagcccactatctgagtttatcgctgtcttggtggcagttttggccacttttttttttttttaagagatggggtcttgctatgttgcacaggctggactcaatctcctaagtgcctacaataacctcctaaatgttatgccccttgtgatgttctcttctctttgaccttgaccagtttgcttcactgtcgctactcttcagagttcctctacaacacattggatctggtttctgaacctgtttctatctgtaactataacataaggttaaatgtcactgcagactttgtgtctttgcagagtttacttgaatttaattttgatggaaaaacatctgctttgaaggattggagactgcttgattgaataaatcgcaaatcaagtctgcaagtgtagatgttaccatgtaatgaattaagagaccattggccatctttcctttatagacgtccttaaatcccccagcatcatttggaaagtagtggctctatgtttatatcagtcagtcaaccaagtttaggctcctatcccaggctacagaaagttctgcataagtcacttaactgacctcacagcttataacctagttggcaaataggagagaactgtaagaagttgactagcatgtggaatgtgaatgatgacagtggacaagagccagatggtacaaaggtcgtgatagggctgggtgggtgggtctgttagtcacttctcacactgctataaagaaatgcctgagactgggcgatttataaagaaaagaggtttaactggctcatggttctgcaggctgtacaggaagcatagcagcttgtgcttctggggaggcctcgggaaacttccaatcatggcatgaggcaaatggggagcaaggcacaaaacatgaccagaggaggaggaagagagagagtggggaggtgccacacacttttgaacaaccagatctcagaatcacccactcactcactattgcaagaacggcatggatgggatggtgctaacccattaatgagaactctgccccatagtccagtcacctcccaccaggccccacctccaactctggggattataattcaacaggagatttggtaggactcataccaaaccctgtcagtggacatttgggagagacttcatacagaagggtgggagaagggtgggcttgaaggcattggaggttttaattgttctcattggattgaggggcctgtgctcctgcatagggctccctctgtgcagagacaaggaggtgggaatcccagaggttgggtgagcttctgcaggggtagaccagtgagaagtgagggtggaaaagggggtttgggttagatgtagatggccttaacatttacccttggtcagctaaaatgtgtggaaagtttttgaatgaaagggaaaaaaatgattcaaagagtagcgttttagaagactagtctgtccgcaagcctggattaggtttttgttcctaacccactacttttcagacttggctgtatatttcagtcacctggggagttaaaaaagtactgaagcctggagccctcccccgctagagattctgatttaatctgtttggagttaggcctgggtttggggagttttaaaagttccccaggtgattctaatgtacagccaagcctgagaaccaccgcccaatccactgataagatcttgatatagcctccactcagcctccactcatcgagctgaaccacagcacagtgctggccaggaaaaagcaatcaactgatgggaaaaaaaataaaattaaattaaaaagtacttctggctggctgggggcagtggctcatgcctgcaatcctagcactttgggaggctgaagtgggtggatcacctgaggtcaggagttcaaggccagcctggccaacatggcgaaaccctatctctactaaaaatacaaaaattagctgggcatgcatgcctgtaatcccagctacttgggaggctgaggcaggagaattgcttgaatctgagggacagaagttgcagtgagtcaagatcgtgccactgcactccagcctgggtgacagagtaagactatgtctcaaaaaataaataaataaaaataaaaggtacttctgtgacaatatttataatattccacatagtccaacaccttagttataataagttttcacgtaaatgctatgaatttttgcattggccatgaagtagatggggacaaatgtgtagacttttggcaatgtatagatatggaaaatgacatctaaaattgcaataaaaatggcaagataaaacacttttatcatagccaagaattcagtagcctaaaagcaattacagcatgaaagcttgcaagtataaaaatataagtcctcagaaacttgctgctggaagacctgtttccagatgttgtgtgtcagtgattctcaaacctgagtgtgcatcgacgtcgcttggagggcagtcactgattgctgggctccagtttcagatttagcaggcttggggtagcccaaggatatgtagtttcaaagttttcccggatgatactgccggcctgggcaccatactgtgagaaccactgatgcttgctgccatgtaagaactgctactgcatgggcccaaatattgtaggaaaaggggcttgataaatgtgatagaaggacatgagttgttttgttttgttttgttttgttttttgagatggagtcttgctctgtcgcccaggctggagtgcagtggcgctatctcggctcactgcaagctccgcctcctgggttcacgccattcttctgcctcagcctcccgagtagctgggactaaaggcacccaccagtacgcctggctaattttttgtatttttagtagagacggggtttcaccgtgttaaccaggatggtctcaatctcctgaccttgtgatccgcccacctcggcctcccaaagtacaagttttgctttttatgtcagatgacgggcttctcttgggagttagggaatctgtcctcctccagttcaatccagcccctcctcatctccgtgctctagggggcacctgtctgagtctaggtagggtaggtagaagagaaaattgtcttttcattctcctaattgtccttttaaaatgtactacaaagggaggtattatatacatagctgtaatattatataacacgttctttacttttcttccagtagaaaatatttgtaagttcaaagttttttttttttaacttttatgactgtctccccaccccccttaccctaccacatgaaaaatttgaagagttaaaaaaaaatgctaaccatccatgtcttccttaaaacaggttcttgcggctcattcttggtggtacattggaggatgtcagtccttggcctccccctaggtgccagcttttgcaccaaacagccttcctggtagaaaacacatttgcagtgtaccttgggcgggaggagaagcggaaatcattctcagatgttaaaaagaaacatgtttctaattgaaagcatgatgagaaggcacacatgaaagggcctgggtggtgagctcaggccaaggcacagctttgaaagcccagctcagtccttgctgtggccacttctgttctcttgggtggatcccattcccattcctgtgacattccagaaataaccatggctgagcagggacccaggacagcatctcagatatagcaacaaagtttgctcagttggtcaggaaactctgatagttagaattctgaattctagaaacacagagcttttgaactagaattctagaagcagagtgtgggaacagcctttattctcatattgtggagaccattttagaacaaatcgctgctgccctcctcataacccccaaacacacacaagtgcagaggccagggttaagtggcttactccaaggtcacctagggagctggctccatttttttttttcttttagagaatccttcccaactttctgaaaatttgtcagcttggtattctgacacccaagggccattttagaaaaatcattacttgctgtaacgaataggcatcatattgtaggaagatgggaaaattattttgtctcttttatagaaaatcaataggttttgaggcttttaggtcttggtcttttggatcttcataactgagtctcctgttgttcgttttgcttgtctattttgtaattgctttgtggactgaagcttgttttgaactttatgggagacttgatagtgtgatctgcctcaggaccaacagtttatgtaaaaggtgagctgacagcaacagggcagcatagtaaatgtatttgaacaaataaagaagggactgaaggaatcatggccataagcttatgacattacataataaaacttaagtcagtagcatgtacacttcttttttttttttttttttttttttttgagaccaagtttccctctgtcatccaggctgcaatgtgtggcaccatctcggctcactgtaacctctgtcctctgggttcaagtgattctcctacctcagccttccgagaactgggattacaggcccctgccaccacactcggctagtttttgtatttttagtagagatgaggtttcactattttgaccaggctggtctcgaactcctgacctcaagtgatccaccgggctccgtctcccaaagtgctaggattacaggcgtgagccactgtgcccagccagtagcatctaaacttctaagggaccttgcctatcataaaacctacttactctaccaatgacccacagccctgataacttctctttttaaatttttaattttgagattgggttacattctgttgcttaggctggagtgtagtgctgtgatcacggtcactgcagcctcgacctcctgagctcaagagcctcctgagtagctgggactacaggtgcgtgccaccatgcccagctaattaaatttttttttttttttttttggtagagacagggtcttactacgttgctgaggctaatctcaaactcctgggctcaagcgatcctcccaccatgacctcctaaagtgatgggcttacaggcgtgagccactgtgcctggactgataactttaaaactctgtttggtcaggagtgtggtgattcagagtacatacatccttgcaaataggagatgaagaagttgtttctttttggttgcctttcattattaaattcggaatggtgcctagcacactggatttttatacaaactagcaggtgtgttttgggcgactctcaacctttctgcccttggttttctcgttttctcgtatgtcaaagagtagattggactaaatttctgacacagtctctcgaagatctgatagcctatacaacatgaggtctataggagagcactttttggggttggggattggactgaacttttgttttttgccaagtcttggcaaaaaatttaggcttaaaaaattttaaattaaattttaagttaagcgtatatttaaatttaagccacagaacataactttaaaataatggcagagcattttcttacgatttttcctggattttctgatgcatttctgggaggcagatgcagtaaaatggttaagaatgatagctttggagctggctcacttggtttcaaatccgagctcttctactgagtaataattatataatgtttaacaaatcacttaatctctgtttctgttttttcatctgtaaagtgggcacaataaaatatctacaaaacacgttgctgggggattacatttgtttatatattttagaacagtgcctgtcacataggaagccattaatattagctctcttccccctcctccgcccaactgccccaccttcctccttatgagtatttgtgtggttttttattggagaacaaacaacctgatgctactgttaaccctttggaaaaattaggaagtctacaatgttgttcttcaaagctgtgccttctgttttctttctgcagctagctgtgttccgccatgtcagaatggagggatgtgtctccggccacaactctgtgtgtgtaaaccagggaccaagggcaaagcctgtgaaacaatagctgcccaggacacctcgtcaccagtctttggagggcagagtcctggggctgcttcctcgtggggccctcctgagcaagcagcaaagcatacttcatctaagaaggcagacactctaccaagagtcagccctgtggcccagatgaccttaaccctcaagccgaagccttcagtgggactcccccagcagatacattctcagtgagtgtttcgaactttcatttagctaaggatcatcttaattactctcttggatgccttgctttaaatcactgtccctttcctgcacaatttgcagaaatcacttggataataatgtttttctttcctttcttaaggctttacacgttaggctttacacatggaatctcttaaaaatatttggtgtgtgtatttagcctctgcaggaaattttaccataagtacaacccatggcaaccatgaggattatagggatcaagactggaagggaatgataaaaatagttatttttgataaagttgttagtttaaaaattctgtttttgaggggggagctgctttatagagttttgaaataataatttaaaaaaagaaacagtgttatttttaaagttatctggaaaaggtaagaactcagcttgcacagagaaactactcaaatgaaagggagtccttgcaaagagagaatttctcaacctcagtagcaggttaagtgtaccttctgttaacaccatgtttatctcccagttgccgtgtgggtccatttttggtgaatgagcttgttttctatttatgggaacaaggttttttttttcttagtgttaggaagtaagtgctattctgaacaaaatgagaactcagagaagaaagattaccccgttctctgagttgcattacaagcagccactcagctgcaccgggtccttaaacaaattgtctcctcttaatgagctattctgtatggataataagatgcagaatgtactgcaactatcacttgtcatttgtctaggaaggtaaaatacaggaagttcccaacttaaaaatgggcttgacgtagcagttcatttgtaagtcacttgcttggaatttagaatgcttcttccctctgcagagacagcttccatatggtgattagtatccagtcagcccacagaagttattcagtctgttgctatagatgaaattatccttatttttacttccccttcgaatagaccacctactgtttcttctgagtgtggtctttttcttttctcctattccctcctcaatcctcttttttttttttttttctgtttttcttcattattctctaatttcttcttgtctcataatacttcagttctattgtggtagctagatttagggactagtttgaaatgctactttgctgttggaaaacacattctgcagccctcaacaagaagcaaaggtaagataggtatagctaatacttagtaagggcttactatgtgccaggtactcttttaaacacttattgtgtattgttcacttacagctcacaaggatcctgtaaggaaggtaacattattaaacccattttacagatgagaagactgaggtacagagtggttaaatagtttgttcaaggtcccacagttactaagtgacagtattacaatttaaacagaggcagtcacgtttcagcatccatgccctgaaggaaggagttggcaaaaattttctgtaaagggacagatagtaaatatttttagctttgtgggacatacggtttctgttgcatctactcagttctgccatggtagcacaaaagcagccatagacagtgtatgaattaatgagtgtgactgtgttctaataaaactttatggacattgaaatttgaatttcatataaatttcacaggtcatgaagtattattcttttttaaatttttttctcaaccattaaaaaacataaaagttatccttaacttctgggccataggaaagcaggctgtgggctggatttggcccatgaactgtagtttgctaactttttctctaaaggatagtagtgctttttttgtgtgtgccagaacatgaatataactgtgtgtccttggaacggtataaagctttgattatatcatagctagacatctcccttccaacattgttttggatattaaaaacaaaaaacaattctgtgttgaactatgctttggcgatcaagagtcagattactgtgaattgcaattagttttttctagcattatgacttacataaactgtaaagtaatttacaagcaacattattcatcttcaatatcaccatccactgttagaatttgaccctctatgatgtatatatatggattgttagtaagaaccgtatgtcggatgtcagataaaggaacagtctattttttttccttccttttggtagccgcggtgtactttagacaagaatgttgtgagtcaaagaggaggctaaggtttcagctctgactcagctttggtaaaataaagtcattaggcagtttgctttggagacttcatctgctgaatgaagatgcttttttatggtagcattgttataggcatgtatatatgggtgtgcctactggtgcacttttaagtaaagagaagagatgagaagagatggccttgggtgccatcaatcctgatattaataaactatatagtttgccccattatctagtccctgcagagaagattaagatgtacaagatccagtcctgctcttaaggagattttgaaatgacaaatgagctatacaaaggaaactatacaaagctatagaattagccctttgattaatttaggttatgacataatcacagtgagtcatgtttaatcaaatggccaaggaatcacatgtgataggcccactttggctacttttgagaaatgttacaatccttaagttatctttcagattgcctattttaggatatttcaggttttgtgtttaaccagtaaaggaggagattgattaagcctccttaaagtattcaactatatacataaatatgtctaacatgccaaaatgtttagtgttacgttcattgtgtgtcacatgaagtgctatcatcttgatcacttattcaacaagtttttatggagcatattttatgtatgagggcacagttcagggagctaaggatagataacactaggcaactacataaaatgtctgctttcttggaacttacagtttagagagggagagacagttgataaatgacataattaaaatacacattagatattcataagtgctgtggagaaaataaaactgcattagcagataggacatgctgggttggtgtgtggtggggaagagtgaggggtgtggcagttttaaataggctgccagggaagaccctactgagaggcatttaagcaaaggcctgcgataagtgcatgaaccctgcagatatgtaggggtgaggcagaggctttgaggcaggagtgtgcctgagatgtttgaggaacagctagtttggtaaaattgtagtgttaaaagcacatattttaggcaggtggggattagatgaattggttttacctttggctgaattggttttaggcaacttgatttagaaccaaatacaaataaagttccttaggaaatcaaaggaaagagcagttgtttccagattttggagtgttagtgcagtggagtccagggatggctccttagagaaggtgtctgtgaaaagatggttggattcagatacatacaactggaggagaagggtgtatccaggggaggcaatgatgtgaggctaggtagcctggcatattagttttctttggctgtgtaacaaatcaccccaaaacttagcaacctaaaataacatgcatttattgactgacagtctgtgtcaggaatccaggggctgcagccaagcagtcagcaggggtggcagtcatctgaaggctcgactggggctggggaatccactgccaagatggctcactttcatggctgttggcaggaggccttagccctggcactggctgttggcagaaagcttcacttcctctctatgtggacctctctgtagagcagcctgagtgtcctcacaatgtggccataagcttctcccagagtgagtgatcctagattagggagagcgaggagaaggccacagtgcctttatggtcttggtcttaaggatgccacaccctcacgcttaccttattgtactgattagtagtgagttgctaagtctagtcctcactcagagggggtagaagtatgctgcactgcttaaatggagaaatatcaaagaattcgtggacatatttaaaaataaccatatttaggatatgatttaattagaacttgataaatatgaagattaacggtaatataaggtaatataaagctctaaaggttgcttgaaaaccaagctactgactaagatttcaacaaaacaattccaaaaagacacaaaatagagaaaaaagtaatggaaggacgcctcgtagcttaaacaaggcttaagaaacacattaaccaatcacagtattttgattatgtttctatcctgtttcaaacaaactgctaataaaagaaaaagataacaatgacgatttatagaacaatcatgaacatgctaacattggtaatttgatgatataaatgaatgattgttgattttgggagctgtgatgatggcattgtagttatgttcataaggaggagaatcatgttaaagtatttacagatgaaatgatatgatatatgagattttattcagaataatccagtgggttgaggtatagaggtaataagattggcttgaggtggtaattattgaagcttgatgatgggtacataggggtttcttacaaaattctttttatatttttgaaattttctgtaataaagagtaataaaaagatgaagtttcttatagtcctgagtgtggtcctgagtcttcaaaaacctaatgctatgatatctccaaggatggaagaacttctgggatattccttgaagtatgccacctcctaattgacaatagtaacaataaaacgtaagctcattctctttatttgtagtaaaggaaaaaaaatcccattataaagctatgccaatagttaaacactttggggaaagagttcaagcttgttgcagtactgatagttattactgggaccttgtctgaacttattaaaggatccaaggaattggtcagtagtcaaacggatgatttccttaaacgatctctcagactgtaggaggggaccttgctcaatattgaacccccacctcaaccccaccaactctctcccaggtttctcttgtgtgctttcctgtacttaacattgtcatgacacaacacagtctttgatctctttgtccacagaggtacacagaaaggctccaatcaatgtttgcttaatatatatatatttagagttttgcctagagaaaataagtgttaataatgtctaaatccttgtctatggattgtttcacgaatgcttatattgcaggacgtacccttctctcttggaataatagcatttgcctttgtaaagccctgaacattttgcagagtattttccattccttatggtatgtggtctgcccaacgagtctgtgaggtagttgaaggttttgatcctactttattatgtggaaaaaaaaggcattgaacgaaagttgaacaaaaggaactcactccaaggtgctcagtgctcaattcatgacacctggggaatgggatgagaactaaaaatttgaaccaatcactgattttatcgtgttatacatatttatttaaacttaaaaagatgttaaattgaaattacatacagaaaagtacaaaagtcaaaagtgtacagtctagtgatgatcccaaagtgacatattcatgtaagtgccatcaacattaaatagaacatttccagcaccacaaagccccttgttcttagactcagccatcttcctcctcaccggagggagctactctcttaacttccaatgccagagatcagttctgcctgtgtttgaactgtatgtaaataatacggtgtgttttttttcactcagtgttatgtctgagattcatctatgcagttgtgtgactatagcttgctcatttatattataccaccaatgcttaccacatcatgtgagtgtaccacaattcattatttattctgctcttgatggatgtttggatttttttcaatttttggctctttttatcccagattgactaaggtataattgacaaataaaaattgtatgtatttacagtatacatgatattttcaaatatgtacacattgtaaaacgattaccacaatcaagctaattaacatatctcttatcccacatagttaccatttttggtttgtggtgagaatgttgaaggtctactctcttagcaaattaccagtatacagtatacagtattatttactatagtcaccatgctctttgttagatctctgtaacttactcatcccacgtaactaacattttataccctttgaccattttttggttcttaatactgctgtataggtatgtatatgtgaaaattctagaagaaggccgggcgcagtagctcacacctgtaatcccagcacttttggaggcctaggcagctggatcatgaggtcaagagatcaagaccatctggccaagatggtgaaaccccttctctactaaaaaaaatacaaaaattagcggggcgtggtggcatgcgcctgtagtcccagctactcaggaggcagaggcaggagaatcgcttgaacccgggaggtggaggttgcagtgagctgagatcgcaccactgcactccagtctggcgacagagcaagactccatctcagaaaaaagaaaaagaaattctacaataagacctttttgaaataatcaccaagcccaactggatatagcagtatggtagtttgagaaggacttcctaatccatgaaaaccatgtaaagtttgatcatatcattagctattggtcagacctattttgttgtttgagaaaaacagacacatggggaaaatggtgaggtgaggtagtgtgttgaggagctggaagtgagcagctcttaattttttcctcctgagactgagttcggaagaagagtagaccatggcatggaggtgggagagacaaggacagagttggggaggtcactgcctcacacttctgctcacaccgctgggtctggtggaaactcaaagtttgtatctaaaaatgggaggtgttgggatagagtttgcttcctaatacaattgaaataaatcaggataatgttttggtgctatgtaataataatagttaatatgaccaattattctgtgccagacacaattctgagtactttttgagtgttgtctcatttaatctcttcaaaaccatgtgagaggcctagcgtggtggctcacacctgtaatccctgcactttgggaggctgaggtgggcagatcatgaggtcaggagttgaagaccagcctggtcaacatggtgaaaccctgtctctactaaaaatacaaaaattagctgggcatagtggcgagcgcctgtaatcccagctgtatctcaggaaaccaattcaaaaagtcactgattggaattagcaaaactttacttaatcatcctggtcaccatcccaggccagtaagtagttcagctattcaagtaccataaagtcccattctttacggtacttgtagcaaatgatgggacccacttcttgtatatctctggatgtcataagggttttcattgatcagaccatatttaattttctgtgtcttatgttcttgaccttgcagtgttgaatcttcttgctccttgcacttagaatggctgtgatagacataaggcatgttaacaaggaaaaggctgacggcaaagcccaggcagccagcctcttgggaaaattactgaaactggtactataaatccagtttatgggcttgaaatttcctagtactcatgaatattcaattaaatattgatatgaaccttgacacaagtttggctcaagtgctggtagaaagcaaacagggacattcagacaaactttaattatttttcacttagagatcatacagttctagagtagtgtgagtaattggagttagctctcaccaaaacacagaagaaatatttaatcaatattagtatctttgaatagaatttatcctgggcacttgctagttattatttgtccgggcgtgatggctcacacctgtcatcacagcactttgggaggctgaggcaggtggatcacctgaggtcaggagtgcaagaacagcctgcccaacatggtgaaaccccgtctctactaaaaatacaaaaattagttgggcgtggtgatgcgtgcctgtaatcccagctactcaggaggcagaggcaggggcatctcttgaacccgagaggtggaggttgcagtgggctgagattgcgccactgcgctccagcatgggcaacagagtgagactccatctcaaaagaagaaaaaaaaaagaaagttattatttgagcataatgaaaaagagaacaaaaattagggacaactttcccttccaactttccagaattttcaaccggtacaaaccataaagttttataactgcaagtgtctgaatgcctggcccacagtcactcagcagggctgcagcagagtcatgacttgaacccaggcttcctgaccttttgttccatgttctccttgcatcgtttacatgtcagtgtctgactccgcttaacaaaatagtggaaaaatactttgcacagtatttttgaagccccaaattcaaataaaaggcataaagaagtgaaaaattgtagttattttatgaattctcaagtaaaccactgttgtttgaccagaaattgtttattttcaaaacaataaagattcacctaaaacatattctgtttcatgaaggaaatgtgacaacctattcattacagtcagttaccaatatagagagctgttcccaaatgtttagaattagctggactgtctactgtagacacagaatttattttttaaaaaactctctttccgagagtttcagtgctttcagagcactgccttttgtttctttgcctgacgttggtgttttgccaagtgctggtatttggaggtttgatggacagcattcgaagtgaggcatcagtcttccttaatttgttcaaagcctctttatgcagcagctaatccttcctaattatatttctaggaaggatgttcttaactcagacgggaagaagacatagacattttgacattaggatgcacttcactccaagaaaagaaatttgaaaggaaacactctcccaattcccattccttaccccctgggcacaagcaaccattttcccctgccccatttatgaagctcttttctctccctctccattcctctttcattcctgtggctcctatttatctcctggcttaatgaagctattttgaaggagctaaaaaaaattcagaaaaaaccatttccgtgtagtgaggcaggcatttcacaccttaattgctttaacgtcttgaaaggtgaaaggtgacctgtgagtctaaacagttggaaaatttagtgtgcatatttgaaatgctttacataaagttgaaacacttcacagtctccttgattaatttctttgttgccgtgctgctttgtattaatttaatttagtgacttttatgtgaaagtaaatatgtaagtcagtggcattatgtttattagattattttcctttaatattttaagcagactaaatgcggcttctgtcaaatgagtctttaataaataaattgctgtctgtgaagtcttagtggctttgaatggtcttatgaagtgtgatcttatcaccttatgaagcaattttgtgtttcttagttttttttagtgaggttgaacattttccacatttttataagtccttcatattttttatgtggataactaacatcttcacacccttttctgttacatgtgcttataattttctttaatttctaagagctcttttcatattaaagattgtttttatcaaatatttaagaattctccaagggaaggtacttttatgcaaaaaatattattagtactctggttttttttatgctcaaatttggaagaaacgtcttaaattggattgtaaaaaatccccccttgtccatgaggacaagaatacaatctgttactcattgactgggtaatttatttcagaattctttggtcttctgagaggcttattgacttacacagacataaatcgtaatatactactgaaccatctataactttccaagttctctgtgcatttctaactggttgcgttatctctggttcaccatagtgaagatagaatctcagtcctcctggcccccagaacacagattctcaatagttgattcattcattccatcagcagatatttactgagtgccatccacataccaactactgttctaggtactccaattggagggatcaggctaatgtgtctgcaaaatactgaataacatagcataatacctaataagctgctaaactatgtggtgcatagtataaattctaatggcgagtaaggaagggggagattggcaggggctggaggactggactaaaggaacattgaccagagttggaaggacttggaaaagtgaaggagagtctggcctttaaataaataacaggtggacgatagggtgggaatgattctcctgttggggaattgatctctttgtggggattgaagaatagcaggaaatgagattgagtgggcaggtccaattatggaaagccttgacagtcagacagaggagctctgtgtagggctccgaggaatatgaagatggctctgatagtcactgaagaagtgtcaggctcaccctggaaagccaggtcaggtggggtgctaagagagtgtgagggaaggcctgggaggctggctgctgggcagatgagagagagggaggcctagaggagctggccctgtggagtgtctgtcttgcacagggacttgagaggagagggatctgattccctttaaaacaggaaggattcagactgccagtcaagaaaataattcctttggattcgggttaaggaattatgtgtagtctaatgttgatctctctctctacctatgttaaatggaatgatatgtaatcttatcctctttaggaacaggaaagtaggggatatcattgaaggcttcctgttccttattacactctatccctagactcaaattcatcaacccataatcaaaaccagatttgatttccttctgtgttgatcaaactaacacatcatgctctgtagaataatcaaggtcttttttcctgtttcaaatgttcaagagttttctacctttatctttgttggctttatagctttgccataactactttttgttatctctacccctatcgatatcaacttccgtgtatcttctctgtgtttttcttgctacactaggagtgatccactcacctatattcctcctcctttaggtgacagaagtcctacatcttgattatcctgtattggtgaactggaaaggaaccttgggtaatcacacacagatgtataataaccaacaggttgttaggctctaaatgtcttcctagctggactgcattctcattagttattatttaaaataatataaaataagtaacagtatgacacaaaaattgcatatgtatttgatactattaataaagcagtttttgtttcagacttatattcatttaatttagctattaaggtctaaagttgctaggaaagtttttgtgatttgctttgtgaagtagtgtagtaacatgctgcttgataaaaataatggtaattgcctttcacagaatcagaaatgcttttcatacctagtgaggaaatgctatacttcttttaaaaaacttacatatccatatcagctttatgttcagattaatttaggatgttcataaaaaacaaggatttgatcaagctcagctttatgttcaaataatttaggatgttcatgaaaaacaaggatttgatcaagctccattaggaagtctttgacaagaaaccaaaagaaatgattgggactttcaatttcacatgtatttgttgaatatttactgtgtgccaggcagtgtgctagcagccaaactaaatagtctttagtttcaatgaataattgataactggaatgtttcttccatcatttctagtgtaagtggttttttttttcatttttagtagagagctatattttcataggacaaaacatgtaatactgtcccctctgttgatattaagtcagatattttatctgttcagtcaaagcccagttctggtgttaatgggcctggatttaattaattaaaggattaacttactgtatcattacctgtgtgcaccaggcacccttctgaattgcagacagcatgtaggaagatctaactaaactttaaccttacaagtacaaaccacttctaggtgttctcaggtgtgaacaatcagatgcaagcgggaaagagatcagaaacactgacaataataatgcatgaaataatagctcctgtagagttttagaagaaagggttgagctgactatggtgggggaaaaaagggacttttttttttttttaatgtgtgtgatgttctacagaaacagcaatctgaaagctaactggctgcagctggatggactttcttttgtatggagacgctgcctctagtgtttaggaaaaaatgcacactagaaaatagtgcaacattatggtgccatctgtcttgaaaatgaattattttttattgtctgctttatagtagttcccagacaaaacttgaaaaaacttcaactagctttggtgctattttgcgtatggacagtttcagcaggcagaagcctttaaagttgtatttcaaagcgcctcaggagttatcgatgtgatgtgatgagactgtttgccatataagcctctcaagaggccacagccctaaccccctccccggctccctgggggacaggagagcagatggagtcgtgtttgcatcattcaccgtcctaattgggtttgtgactggctgttagggcatctttctctcagatggcattttcttctttaattcaaagtttcactttctccttagcagcgttctggattgtttttgagggaatgatggcatggatacgcaaatctacagagttagaagaaagagacgagacttgaaggattgttgttctaaaaaaaaaaaaaaggctaaaatgcatttatttctcagacttctttagaataagtgcaaatgaaaaagaatactgaaaacattttcagaacccatgaaaacacttgtcggtattaatataattaaggtatttaagtttaaatgtttaaagctgatctttgaggtgttttagctgggcttctacttgaaattttgtagtgtgaatgtatatcaactatttataaactagctgaagggagttaagctattaatgtttggattttaaaatctataaggatcagaaaatgggttttgtattccatatcatctagaatgatgacaggcctggaagcataggacagagctggcacattttcaaaggaattcttccctggtctggatactataatgagcacaactgcattttggtggatttattatatacagtacacaacatatataaccatttggaagttgggtttgctttctggttagaggtgcactggttatagctgattatgtatagggtttgaaatagcatctggttaaaaatttgaggggctgacatttcctctcagagactggtgaaaatgaataaatacgcaatatggaaatatccatgccaatcaattagtagaagggtttaaataaaaaaaaaaggatgcaatttgaacatttacgattatgccagtgggcagcaggtggcaagctttgcttttcaatgttcttcagttttatttttataccgcagaatgccaaaatttgaagaggggggtttaactccactggaatatgtcatttcttggcagtgcaacctcgaaccaccttctttgctcattgtgcataattgcctttctttggatgccgtagccgacccttggttccccttgttgccgatggataggaattaattcatatgagcaatgttctattctcttgtgattttagcaacacgttgctaatggagaaaataaattagaaacaaatgagtttcttaaagcagtccttgtatgatttataagagattttcttgtgtagttttacttagttctaaatgacacataaattgcttttaatttaaaaaattctaactggctatataccttgatatggagatgagaagtaagcaaaactgcgtagagttccatgaaagtgttttgaaaaattagagaggaaaaacacattttgagaccagaatagaagaccattatcttttcataggctaaactgtgtagtcaggatttgaattttaaatccggaaaagagagcaagcttgaaatgggagtgatggtgaggtggacaccaaattattttatagtctactgtatttcttcatactttctagataaaaaattctttttgggttgttttatgcattgtgagaaattcggaagaatggagaagaatgcaaaagcatatcaaatcactgtaaacatttaatagtctacaaatatttaacacttgctgtgtactcaattttttgtaggccgtttgttagaattgagttcacatggggtataattctacgttcacgacttgacattctcaacctcagttcagcattttttctttttagaaaagagatcgttcataatgattataatttacaacacacatattttaaaggatagtaataaaaaaacccaaactgttgtacccactacgtagctgaagaaataaaaacactgttgtcattatcttagaggctcttacgtggtccttgttaattcctttatccttttttcccagaaaataatttatatcagttatttcctgcttttctttatagtgttaccacatttttaggtatatctggatactgtgctgtttagtttttgacttttaaacaaatgtcatattgtttgtattcttctgagacttgcttttcttgctcaaggtgtttttgacattcttctgtaacagtggctctcaaactggagcatgaatcagaatcgccggtggagggcttgctagataaaatacggcttgttgggccccacctcagagtttccgatttggtgggtctggggaggggtggagaatttgggtggctgacaaactcgcaggtggtgccaatgctgaatgctgctggaggggtctgcactttgagaaccactgattaaagctggggattcttttactttttacagtagcccattatgtcagtatactacaatttatcatttctactgataatgaacactgggttgtttttagtgttttgctgttacaacagggtcatgatgaacgtttttttttttctttttttgagacggagtctcactctgtcacccaggctggagtgcagtggggcaatctcagctcactgcaacctccgcctcctgggttcaagctattctcctgccttagcctcccaagtagctgggattacaggtgtgtgccaccatgtctggctaagttttgtatttttagtagagacggggtttcaccatgttggccagtctggtcttgtactcctgacctcagttgatccacccaccttgtcttcccaaagtgctgggattacaggcgtgagacactgtgcccagcctcgtgatgaacatttttctacaagtcttctgttgcatagtttaaaaagcttttttagcatgcaatagaaaaatatcaaaatgcttccctcatattaagggtaggtgttgtttcatgaaacttttgtttttggaacacacactgctatgtaaaatggctttcttacagtgaactcgtcaaaaaatgcttaaaagcctcttgtccagagtagttacattgatcatgctttctttataaaatgggatccatttctatctcattgctatatttttctagattttcttctaaaagctttttctttcacatttcctgtaatgtacctggaaatgatttttgagtatgtgtgattttttttccatatggctaacttattgtcttagcactatttattgactaattctccccctgtccctctcataaaaaaaattataaaaaactaccatatcatatatgtttcattcaagtttctaaatatgtaagtctgtttctccatcctctatcctactgtgttggtcttttgagtatccttaagtcagtgccatgctactgaaagtgctgcaattgtgtagtaagtcttggaaggtgtaataatcatctgtgtctcttgtgctgggttctggctgatttcttctagtttattaatctgctattctgttatacccactgtcatcttttcaagtgttatttattttttaatctctgaaagttctatttgactcttttcaaatttccttagtgtatgttgtcttattatttagtcatatttttgacctctttctacatattaaatatacattgtgtatcttatagttgcagtcttaataatctacagttgttactggactgatttggcacttttatttttcctctgattctggcttgtttccttgttcattttgtgatttctgattgtgagtattcattggaattttatttctagaattcctgaagatatagtttttattttatttatttttttgagaaaaggcctcactctgtcgctcaggctagagtgccgtggcatgaccatggctcactgcagccttgacctgctgggcttaagcaattctcccacctcagccacccaagtaactggagttacaggtgtgtgccaccatagccagctaatttttaaaattttttggagagatgaggtgtcattatgttgcctaggttggtcttcaactcccgaactcaagcagtccccctgccttggcctcccaaggtgctgggcttacagggcatgagccaccgcacctagccaagatcctgttttaaggaggattcctacagaggagagcacttgtgtctgcttttaacaagtctcctagtggggtactacccattcaggttgcttttaattaaatgttggggttattattgttttgatcactcagatactttttaatttgaatgccaaaccaacataaaggcgaacttgtgggttaggaattctcacctgagatttatgctgttgcttgttttcgtgtttacccaaagcccaaactaagacagatgcgactcctcctgttctctcagcagtgcagtgtttggttttttggtttcccctgcagaaagttttaacacgagggtttctgatctaatcttttaccttatgcagcaccaagctttgtctctgtgccccatgaagcatgttaaaacctgtaatctaggcatccagaaatggcagatgcccctccagggaaaattcctgttctggagccaactcatttccctggattcatgctctctggtcgttcctggcctgtgaagatttctcttactttcttgacatctcagccatattttatattttgtccagcaatcttagttgttttatcctggcaaattttctctggacatcttatcctctgttttgccagaattagagatcctagttaatttattttaaagagttcgagttctgagaagtagaaaatatttggaggctagaccataaagtttcctgtgctgcaaggaacccatagcactgttgaatgactatacgcttgagtctttggaaagactcagatgttcttttccttgtcatttatgacatgagaagtcttaggaaaatgtctttttttttgccagagcctcatctaaccagtggccagtgagcctgggagatgtgtaggatcctctggggctgcttctcgcatctctgcctctgggtgcctgcctctgggcacctgcctgggacatctgcgctcagggctctgcctccagttcccgccctttgtctttttgtccccagcctagttgtgaaatctcatctcctggttcttcattttgctcagtagtttcatttgggcagtctctagctctcacaaacatgtactcgaagagtactgattagtgtgttcagaggttaaattggcctttgtgtgttataatcccactcttctctttgagggtttgatgagagaaaattgaagttctgttcattatcattctaggaagagtaaatggatagtaatttaggggtaggaaaggggcaaatgcatagttgttgcttttactccagtagcatctgacaggagaaaaaaaaaacaccaaaacccataattgttctttcggagagagaaaccccacctgtatatattttttaagctgtaaatactcctgaatgaattttggtagctttggtagctataaggggaaacagtattgtatccatcttgagtgtccttcttacctcttatactacatttatcatctttaattctgctttagactcatcccttgcagtggccacctgtaacttggcagcctgcagggcattgccaaatatatcgagacaccaagtaaaatatcttttgtaaccaaaattaaaatcaactatatttttggctgaccagttctaatcccagacttgtctaaatcattgagaaattatatgttgtgtttgtggggggccataataatataatcatagtcaattaaattaaattgagggagtgaatggaattaaacatttttttttaccctgtatttctttttcaggaatctgagttggaatttgataaccatcagtttattataacagggtcagtactggagtgataatgggttcggaaaggcaggttctgggcaagggaaagctgataatggttgcttacggttgaggttttagatgacgaagcttggttttgtgtgtgatttagattgggactgcaccaaaatgaggaaggagagtaggtgtaaaatctcgggagtgcaggggaggaatcaaggagcagccagaaaagagagatcgaatgggaccggttttggaatctgggagtggttggggaaggctaggtagagtagggcatggaggcccatagagatttcattccttggtatggaagaaaaatgagcaagagttacttgaagggtaagcagtggtttgagatcctgggtcttgattatgggaggcagtaatcagtagttagtgagatcctgaaagcaggagagggctgctcagagagaattcacagggcatccaactgtgagtgtagacccagatgcttggagcagtgggtatgagaaactcaagctcctgagagcgctgtctgccaacacacatgacgattagcagacccttcctggtggttaaggagctcacaggtcagtggaagacatacctgcattctgcgcatatgtgtacatgcatagaataatatttctttgtaataaaggtaatgagaggagctttgcagcaggtgatctgggagttccaagaagagggatgtgccttttcctactccacagaacctaaactcatttcaaagcccttggtaaacacgttcatctactgcctcctcaaccacatatgtcactgctctccaatccacgcctcactgtctcttccctcttcctgctccttttctgctccacactttgtgttcctgcctgtcatatcctcccttgaatggtaatgtcaggtattttgcatgcattacttgtgacaggagacattcagatgattgaactatttactggacagcacaggcatagagcagttggaacagagccggctgcagtgcagggtcacttgcttttctggaggttattcccttagtgcttgtgctgtgtggcggggaggtctgagggaggtttggtgggatgataatgacacctgggagactcaggatagcagctctttaccatttgctatggaagaagtctgacaattttacaatggtcacactgtgctggtacctaccagctgactgtcagactgcctcacaactaccccaccgttaataccttccttttatagatctggaaaattagttttctttagaagagtcaagtaacctgccaaaatgacagctagtaagtgagaattagacttgaacccaagcctgtgtgacctcaaagaatgattaagaggtctctaccaccataccacatagcccaccgagtagagtcttgtgttgctcactgtcttgtctgggtcaggcctctttattatttgtttatttattttttctagctagatggctatctaaagatacagactgtgtcttttctttttctttctttttttttcttttttgagacggagtctcgctgtgtcgcccaggctggagtgcagtggcatgatctcggctcactgcaacctccgccgcctgggttcaagcgattcttctgcctcagcctcccaagtagctgggactacaggtgcccgccaccatgcccagctaatttttgtatttcagtagagatagggtttcaccatattggccaggctgttctcgaactcctgaccttgtgatccacctgcctctgcatcccaaagtgctgggattataggcgtgagccaccgtgcctggcccagactgtgtcttttctgtattcccagtgcctaatctggaatggagcacatgataaatagcattcattcctttatttattctgcaaactcttaatgaacacctgctatgtgtcaacctttgtattagggcataaacagataaataaggcaggatagtcacccttaaataacccacagtttactggaagtctcagtctctccctctgtctctctcttgctcacacacatatataattataatgataaagatatgtaccagatgcatctagttgcatttatttgaagaggtgaggtagctgagagtgataatggtatgtgtatcctttacaggatactaccaaactgtttgctatagtgactataccattttgtttccttaccagccgtgtatgaaagttttagttgctccacatcctcatcagcacttagtattgtcagttttttctttgtgccattctaataggtgtatagtcgtagctcattgggcttttaatgtgaatttttctagtgatcaatcttttcacatgcttttgagtatctttgcatatgcgtacttgccatccatagatcttctttggtgaagtggacctttagcccatgtttttaattgtgctatttattttcttacttgttgatatgactaacttttaacagaactttcttttcaggaatttgttaattaggtttcaagtacatttgatataaacagtttataaaatgcttcaaacaacatgctctaggagtggttgccagggaaaactaaaatggactttgatcccgactggggcaagagtgatgaagatgaggttttttctgtgcttttcctcagtgtgattttgaaacaggaggacagagcaaagggagagaaataggagccaaaaagctcaggagggactttgatcttcagtctaaaagggaaaacagggattcttttggttgccagtggaagctggaaggattagacatgccaaagggatggtttactctgatgagaaaagcaactggacaacaacagcaaaaaacactgcaaggcccaattcccatccttttcagcccaaaattggaggaggccagaccaatgggaggtttctgtcactgaagatgaggtcacattattttgtcatccagactgatctaagcagatacttttaggaaaggtaagaatgccttgatctatgcctagatatttacaataggcggcaatttttgacatttatgttgttacgctaataaattggtattttttaaaaaaatatttggctgattatgtaaaaactgttttgggaaggagtctatataaagctaaaacactccctgcctcctgtctctgacttgcaggccttgtgccattgggaaaaaaaacagccaggcctatggtttaaggccttctgggcatctgactacctgcaccccagcactgtctacacagtttgtgtacatgagtatttttatggggaatggttacagagctcttctcagcctcagggaggcctataatccccaaacggctgtgaaccgctgttctagagggtgagattggcaaattcactacagtgatggcacagcaaatgttccatgtctcagcttgaaaacattatggcaggaagtcctgcgtcagatgaaattaggtatacattaaagtagtgggattgagcccagagccttttcaactcttgtatataacagctttgattctcttcctgacataatgagtctataataattggtcaagaattttttttttttacttattaaaagaaccacctcagataatatgttcctgattatgtaactataattataaaaaatcgtatattattgtgtttaataaaaaccaaaatttataggctgggtctaatatatgcatcttgccatgctatattttggagaagacagtagagtgtaagctatgatctttttgagaagacaggagccacgtgcgcagaccatgaagtccagaggagggtggtggagggagagagtgtttcaggctagaatggccggttttagctgtggatggaaaggtagtatttgatggaccaagaggagaggaaatctgtaagcaattgctcagaggaggaggaagtagaagaaggaatttggctgagcatgttttacatgaagtattcctattaggggagtagccataagtgagggtgagaatgcaacacaggtgaaataacattttgggaaatttatctggtggtggaggaccaggcggtggaggaccaggcatagagaagggaagagactaaaatgagagacggtgtttaaatagttaatgcaatcacatagtcatgaagagggagggcttaagcaaaaaggaagggatagctaggagagcccttgtagagggtggagaaggcaggctgtgccctattcaaggaaagggaggcagtgggtcaggtgattccactgactcttagactctatattcacagtatagatttctgttcgttttttttttttcttcaaaagcctttaaaaatgttcaaaaggaaagcatttagaccttttatgaaatagagttgttaaaggaaaaagtatttttttttttaattatactttaagttctgggatacatgtgcagaacatggcaggtatacacatgccatggtggtttgctgcacccatcaacctgtcatctacattaggtatttctcctaatgctatccctcccctagccccctacccactgacaggccctggtgtgtgatgttcccctccctgtgtccatgtgttctcattgttcaactcccacttacgagtgagaacatgtggtgtttggttttctgttcctgtgttagtttgctgagaatgatggtttctagcttcagccatgtccctgcaaaggacatgaactcatccttttttatggctgcatagcattccatggtgtatatgtgccacattttctttatccagtctatcattgatgagcatttgggttgattccaagtccttgctattgtgaacagtgctgcaataaacacgtgtgcatgtgtctttatagtagaatgatttataatcctttgggtatatacccagtaatgggattgctgggtcaaatggtaattctggttctagatccttgaggaattgtcacactgtcttccacaatcgtttaactaatttacattcccaccaacagtgtaaaaatgttcctatttctccacatcctctccagcacctgttgtttcctgagtttttaatgattgccattctaactgggatgagatggtatctcattgtggttttgatttgcatttctctaatggccagtgacgatgagctttttttcatgtgtgttggccgcatgaatgtcttctttagagaagtgtctgttcatatcctttgcccactttttgatggggttgtttggtttttttttcatgtaaatttgtttaagttctttgtaaattctggatattagcccttgtcagatggatagactgcaaaatttttctcccattctgtaggttgcctgttcactctgatgatagtttcttttgctgtgcagaagctctttagtttaattagatcccatttgtcaattttggcttctgttgccattgcttttggtgttttagtcacgaagtctttgcccatgcctatgtcctgaatggtattgcctaggttttcttctagggtttttatggttttaggtcttacatttaagtctttagtccatcttgagttaatttttgtataaggtgtaaggaaggggtccagtttccgttttctgcgtatggctagccagttttcccaacactatttattaaatagggaatcctttccccatgcttgtttttgtcagatttgtcaaagatcagatggttgtagatatgtggcattatttctgagacttttgttctgtgccattggtctgtatgtctgttttggtaccagtacaatgctgttttggttactgtagccttgtagtatagtttgaagtcaggtagcatgatgcctccagctttgttctttttgcttaggattgtcttgactatgtgggctcttttttgtttccatatgaaatttaaagtagttttttctaattctgtgaagaaagtcaatggtagcttgatggggatagcattgaatctataaattactttgggcagtatggccattttcacaatactgattcttcctatccatgagcatggaatgttttttccatttgtttgtgtcctgtcttatttccttgagcagcggtttgtagttctccttgaagaggtccttcacatcccttgtaagttgtattcctaggtattttattccctttgtagcaattttgaatgggagttcactcatgatttggctctctgtctgtctattattggtgtatagggatgcttgtgatttttgcacatcgaatttgtttcctgagaatttgctgaagttgcttatcagcttaaggagattttgggctgagacgatggggttttctaaatatacaatcatgtcatctgcaaatggagacaatttgacttctctcgtcctatttgaataccctttctttctttctcttgcctgatttcactggccagaacttccaatactatgttgaataggagtgatgagagagggcattcttgtcttgtgatggttttcaaagggaatgcttccagtttttgcccattcagtatgatattggctgtgggtttgtcataaatagctcttattatttggagatattttccatcaatacttagtttattgagagtttttagcatgaagaggtgttgaattttgtggaaggccttttctgcatctattgagataattatgtggtttttgtcgttggttctgtttatgtgatggattacgtttattgatttgcatatgttgaaccagccttgcctcccggggatgaagccgacttgatcgtggtggataagctttttgatgtgctgctggattcagtttgccagtattttatggaggatttttgcattgatgttcatcagggatattggcctgaaattttcttttttgtgtgtctctggcaggttttggtatcaggatgatgctggcctcataaaatgagttagggaggtgtccctctttttctactgtttggaatagtttcagaaggaatggtaccagctcctttttgtacctctggtagaatttagctgtgaatctgtctggtcctggacgttttttggttggtaggctattaattaccgcctcaatttcagaacttgttattggtctattcagggatttgacttcttcctggtttagtcttgggagggtgtatgtgtccaggaattcatatttcttctagattttctagtttatttgcatagaggaagtcaaatagtattctctgatggtagtttgtatttctttgggatcattggtgatatcccttttatcattttttattgtgtctatttgattcttctctcttttcttctttattagtgtggttagttgtatatctattttattaatcttttccaaaaaccagctcctggattcattgattttttgaagggttttttgtgtctctatctccttcagttctgctctgatcttaagttatttcttgtcttctgctagcttttgaatgtgtttgctcttgcttctccaattcttttaattgtgatgttagggtgttgattttagatctttcctgctttctcttgtgggcatttagtgctataaatttccctgtacacactgctttaaatgtgtcccagagattctggtacgttgtgtctttgttctcattggtttcaaagaacttacttctttctgccttaatttcgttatgtacccggtagtcaattcaggagcaggttgttcagtttccatgtagttgtgcggttttgagtgagtttcttaatcctgagttctaatttgattgcactgtggcctgagagactgtttgttatgatttctgttcttttgcatttgctgaggagtgttttacctccagttatgtggtcagttttagaataagtgcaatgtggtgctgagaagattgtatattctgttgatttggggtggagagttctgtagacgtctgttagatctgcttggtccagagctgagttcaagtcctgaatgtccttgttaattttctgtctcgttgatctgactaatattgacagtggggtgttaaagtctcccactattattgtgtgagagtctaagtctcttttaggtctctaagaacttgctttatgaatctgggtgctcctgtattgggtgcatatatatttaggttagttagctcttcttgttgcattgatccctttaccactatgtaatgcccttctttgtcttttttgatctttgttggcttaaagtctgttttatcagagactaggattgcaacctctgcttttttttttgttttctatttgcttggtaaatattcctccatccctttattttgagcctatgtgtgtctttgcatgtgagatggaaaaagtttttttttaaaccacaagggatgaaccttgcataaattaagagccgtagcattgttgcaggcattgtgttgttacctgacaccattttggagtggttgattcagagatctgttgtaaggataagaataaaacagacattcagaagcagaggaggatttcaggcagtgactggtcttcatggaaagagatgaagagcgcttatttagtacaaggagctgtgtgactgtaactgaacccattccttagagtactggctgagtgctagcaggaaagacatccagaaccttcagaggattctgggagtgcagtaaaaatccttcaaatttctcttggagaggaataatcctgttgtcttctaatagtagagaaaaacaggtgactggattagaagtggttattaaagttaaatgttgaccaggcacattgatgcctaatagcattgctttccacagcaaagtactcacactcagaggagcatgagacattccactaaggctgcaagaagaaaaaaaagaatagatgttgtacttatgtttacttctgtctaaaaatagaaatcaacctgtataatagtcgacatccagactgaccctggtccttcctgtggtccagatgccagaagatctgcagccttgctcacagctggacatttcgagggaagcgtgtgtgctccgttgacaggggctgactcttcagagaggattatctctacctgattaggtagacttacagatgataggatattaaatagccaaaaaatcttacagtatttaataatgagattgagaatgatgctgataatctctaataccacagatgctaatgagcagatatcttaaaggaactgttgaatgtgagttaagaatgttttttataaaagacaaacattttgaaattgctggccttctgcatgatatttagctatgagtggtcttgttgccctgcagataatttaaaagttaatactcataatctgtcctttcaaagtagaggtgatacattaacaatgaataagaaagtaacctttaaaaaaatctggtgatctggtgctacacagagagcacttgtaaaataaatgtacagaaatagttccattgtgacatgattttcattcctaaaaacaataggtgtgcgttacatgttaactcatatttgcatacttaaaaatattggaaacaaactaaaatcttccggagagtttaaaacccaataaaaatttgtcaaaatgtaacattttccaataagtttgtaagaccaatgaaatgacattggggaaaatggaaagttactaattttagccaaaaagcttttgagtagttagtgtatgagattgaaatatgagtgttatgactttgtaagtacatttcttccatttgcatcaatgtgtctttttcaaatatctcttttgagctaggccggacactaaaactaaatattaacatatactggacttaaaatgagacctctgaattgccatatcagtaagtgttaaaccaagattaaaaaaatgaaacccattcaatcatgccgcagtcactaagaaacatttttagtgataaaaagggttaataaaggaaaactacttaaaaaaatttaaatttcatttttatctcagccttccaaatttctatttttgagtatgttttgtgatgtacatattgtatagacagtgtagttttagaatatatactcaatcagaagtgttaacagcaaagctagaaggaactttgagattctctaatcctggtatagaacatgcatataatttgtaaataatgtatattttggaggttaggcttttttttttctttttttttgttttgaatgagacagagtcttgctttgttgctcagcctggagtgcagtggtgtgatcacagctcactgcagcctgggactcctgggctcaagcgatcctcccacctcatcctcctgagtagctggaactataggtgtgggccactgcgcccagccaatttttacaaattttgtgtagagccagcatcttgctttgttgcctaggttggtctcgaactcccggcctcaagcgatcttcctgccttggcctcccaaagtgctgggattataggcgtaagcatttttttttttttcttttcttttcttttttttttttttccctagaacggtgtatgatccaaataggtggccattggtctacagacaaaaacctgctgagaaccttttaataaaatcatcctggtttctgaggggttgaggaatgttctgtttccaagcccaggactcttagaaactatctgtagcacattcaggtgacaatatgggttgagatgtatctataggacctaacaggtagaggaacttctattctttgagtagatgtcaaaaggtaaaaagtaggatcggaatctttctccatgtggagaaatttcagattccaagaaagagtacacacaactcacctgtacattagacaccaaaaaaatgctcaaattaatgaactattatggagtatttaaaaacatagagaactctgctttaaaaaaaataggagaggatccttaagtttaaagcaaagtagtacttcaaaacttcattaattttgaagtattactctgctacagatagtgtctaagagtcctgggcctggaaacagaacatttgggttcaggtttcctctttattccattctggctttatgatcctggcaaattattgaaactctcttttttttttttttgagaccgagtctcgctctgttgcccaggctggagtgtaatggcatgatctcggctgactgcaacctccgcctcccgggttcaagcgattctcctgcctcagcctcctgagtagctgggattacaggcgggcatcaccatgcccagctaatttttatatttttagtagagacagggtttcgccagactggtctcgaactcctgaccttgtgatccacccaccttggcctcccaaagtgctgggattataggtgtgagccaccgcgcccggcctgaaactcttgaggtttcctcagccagaaaatgagcatggtaattcttcacaccatgattgtgaagctccatgagttggggcagaaggaagtgctgtaaaaactatagtccccgcccgttgtggtggcttgtgcctgtgatcacagcgctttaggaggctgaaggaagagaatcatttgaggccaagagttcgagaccagcctggtcaatgtaggcagacccagtctctacaaaaaatacaaaaattggctgggtgtggtggtgtgtgcctgttgttctagctacttgggagactgaagtggggggattacttgagtccaggagtttgaggctgcatgagctgtgattatgccactttaactccaacctgggtttcagagcaagatcgtgtttctaaaataagaaaaaaaacacacacacacacaaaactgtagtcctctgcaatattactgagtgaggattgcccgagacttgagaggcagttaggcagcccccttcattctgactgtggtggtcctctcctaattgagactgagaattctctagatgtgcctgttaaatatttgcatggccccggagtgccattcagagctggattttgtttctgatggctcagttgcccttgaggctgctcttgggttcccagtgcttgtgttgccaagttgtgtgaagtgtgcagagctgctctgggtttgcagagctggcttcatgtgttgtggagagggccctgagatgttggtgactcattcaaagccactttatgtctgcttctacatcttgctcaatctgctaggcttactaccatctaagtcctagaaggcctatcaactctccccaggaaatgtagaacccaaagacataggcacatactttcatttcctttttaaatgaatacagtctctttaaaagttttatttgaataccgatccatggtttgcacaagccatttgaattttaaacagatgtgtgtgcaaagctgggagtcagcattgcatgtctcagtcaagttttatagtcattgacttttagggttacagcctggtctcatagctgtgccttgggtggaaaggctggtaaggacttcgatgtactttcctgtccagagttttgagactttagccaggactagggcagctttctgggtgtccagtggagggccacgtcattcgaccgttgctatgggaaaaacccatgagctctctcattccaaagtttaccgattgccaaatacttgggtgtgtggtatttggaaaaaatatttagtgatgcagtgattctttgaagaggtgtcctctaatgtttactttttaaaatggtaaaccaattttaatattgttcatacctagctaagactgaattagattatttaaacatatttaaacatcatctctgtaagtgaatgggaaaataggaaccagaccaaacccctattattgaacgctaagagaaatggatttttttaaaaaccgaaataattaaaatctagtgttacatgtgagtctagggactggatttactatttggcaactacatattttgttggcaataaacttattgtctaaaagaaaatgcgtagagccaagatagaggcccaagtaaagaagaaagtgtgatcctaagggaaattggtttattgaggagaatgtatcttcatatactatttgtaagttttctgtatggaggatttctcccttttcacccttgtatttatttaatcgtttagttgtagtaccttagcctcatttgttttattcttcaggttatattattattttcttgctcaaattgttccatctttagtcattgtaagctctttcaggttgactcccggatcaaaatatagtttttaaaacaggcttttttttttttgagatggagtctcactcttgtcacccaggctggagtgcagtggtgtgatctcggctcactgcaacctctgccttctgggtgtaagcgattctcttgcgtcagcctcccgagtaggattacaggtgcataccaccacacccagctaatttttgcatttttaatcgagacggggtttcactatgttggtcaggctcgtcttgaactcctgacctcaagtgatctgcctgcctcagcctcccaaagtgctggaattacaggcgtaagccaccgcgcctggcctaaaagatttcagtttttaagggcagttttaggttcacagcaaaattggagaggaaggtccagacttcctatataccctggcccctgcaacccctctccccgtcccataggcatagcttctcccattgtcaacatctaccagagtggtacatttgctacaaatgatgaacctacattgacacatcattattccccaaagtcctagggttcacccttggttttgtacattctgtgggtttggacaaatgtataatgacatctatctatcattatagtatcataatgagtattattgaaaggtgacagcgtgctggcagccctcgcagccctcgctcgctctcggtgcttcctcggcctcggcgcccagtctactagatgagtatttgccgtctgggtttccttgattagaggggcctggctattttgctgtatccggggatccatagtcggcaaaagccagtaattccaaggaacccccacaaactgttttaatgtcttagggcaaggataagccagtataggctttattcattccttgctgagggccctggtccctctggctaagattaggcctagatatttgacctgctgtaggcaaagcagggccttcgacctagacaccttgtacccttgattagctagaaagttcaagagatctagagtagcctgctggcacgaggcttccaaactggtagccaaaattaaatcatccacatattgaaggaccagagtgcctggacttgagaagtggcctagatcttgggccagtgcctgaccaaataacaggtgagggctatccctaaacccctggggcaagaccatccacataagttgggacgtgtgatctgtgggatcctcaaaggcaaagaggaactgggagtcagagtgcaggacaatacagaagaaggatcctcgaagtccagaactgtgaaccattctgtttcctctggtatttgagagaccagggtataggggttgggtacaactggatatagaggaattactgcctcactgatgagtctaagatcttgcactagtctccactgaccgttcggtttttgtactcctagaattggggtgttgcagggactgctgcatttccttactcagccttgagctttcaaatgtttaataatattctgtaatcctttatgagcttcaggccttaagggatattgcctttgataaggaaaaatggtgggatcttttaacctgatttggactgggcgggcattttttagccttccaaattgtccttccaatgcccagacttcagggttgattccctcctcaagtaggggacaacaaatgggtaacttgttccccatattcatgtagataatagctccagccttggctaatatatccctccctaataaggtgtgggacttacaggcataacaagaaaggcatgtgaaaagagcaaagtctcccaattaaaactgaggaggtgtgagaaacacctggttacaggctgtcccaggattccttgggtggtaacggaccttgaggacagtcgtccaggacaggagattaacactgagaaggccgcaccagtgtccaggaggaagtcaatttcctggccctcagtagttaaatgtacccggggctcagtgagggtgatgacatgagccggtgtttgccccaggcaccctcagtcctgttgttggatcatctggttgggggcttctgacccagggaaccttcatcctctggagcagtgcaccttccagtgattgcctcggcatagtggacatggacgagggggcagctttttctcactggacagtcttttttaaggtgtcctagtaaaccacactgataacaagccccaccagatgattggcctgctccattttctgtcctctctgaaccaccaaggtttgtttgtctgagggccatgactaaggctgcagcctttctctgatctcgcttttccttttgggcctgttcctcttggtccttattatagaacaccgaggttgcaaggtttaacgatgcctctagattttgttcagggcccagggcttgcctttggagctttctcctgatatctgtggctgattgggtattaaacttatcttttagaatcaattgaccctcgagtgattcgggtgacaggggagtatgttttcttaaggcctcccatagccactcgaggaaggcagaagaattttcttcctttccctgagttatggtggacatcattgaataattcatgggctttttttctaattctccttagtccttctagaacacaggtcaacagatgtttacaactccagtccccatgatctgagtcaaggtcccagtggggatccatactggggatagcttgctgaccagtagggaatttgtccctttctttggctgtcattctatcatttacttgactaagataccaggtgtctccaaactcttgggctgcagctaaagccgcattcttttcgttaaaggccagggtttgatctaacagtagcatgacatctctccaagtgaggtcaaaggtttgccctagaccctgtaggacatctatgtacctatcaggatcatctgaaaacttccccaggtctgccttcatctgctttaaatcagagcaggagaaggggacatgtacctgggtagggccaaattcccctccccctacagcttgaaggggacataacccatagcccgtgggtttttgtggtcctttggagatttctttgcttatttccttctgggcaggggagatgagaggatgattatcattaataggaaggggagctatagggaggctaggatatgggggtaagctgagaggtcctcctgtgggatgtaacttgtaagctttgcatagttgtgtattctccctcaatgaaaagaaagcttggacataaggtatttcactccatttgccttccctcttacagaaaaagtcaagctgcaggatgatagtattgtaatttgtacttccctcaggtggccgtttttccccatcagagagagaatattggggccaagccgtagcgcagaaaaaaatgagccgcctctttttcagggtttgtgggtcgaattggtcccaatagcttaggatgcatttcaagggtgagcctgtgatgcctgagtgtttcccatctgaaagacaaaaccgcctgcagttttgttttgttttgtttgcatttatttgcttttggctttgtggctttcggttttctttggtaacagaatggcctggatgttaggcaaaatgccgccctgggcgatggtgactttgcccagcagcttgtttagttccctgttgttgcaaattgccagctggaggtgatgagggatgatgcgcgtcttcttcttgtcccttcgtggttgcaaaaatgtgtccagatttggcgggttcttggtctcactgacttcaagagtgaagccgcggaccctcgcagtgagtgttatagttcttaaaggtggcgtgtccggagtttgttccttctgatgttcagatgtgtttggagtttcttccttctgggtttgtggtctcgctggctcaggagtgaagatgcagaccttcgtggtgagtgttacagctcataaaggcagtgtggacccaaacagtgagcagcagcaagatttattgcaaagagcaaaagaacaaagcttccacagtgtggaaggggacccggacgggttgccactgctggctcaggcagcctccttttattctcttatccggccccacccacatcctgccgattggtccattttacagagagccagttggtctgttttacagagagccgattggtccgttttgacagggtgctgattggtgcgtttacaatccctgagctagacacaaaagttctccacgtccccactagattagctagatacagagtgtcgattggtatatttacaaaccatgagctagacacagagtgctgattggtgcatttacaaaccttgaactagagacagagtgctgattggtgtattcacaatcccttagctagacataatgatccaagtccccaccagattagctagatacagagtgccgattggtgcatccacaaatcctgagctagagacagggtgctaattggtgtgtttacaaaccttgagctagatacagagtgctcattggtgtatttacaatcccttactagacataaaggttctccaagtccccactagactcaggagcccagctggcttcacccagtgggtctcccactggggccgcaggtcgagctgcctgccagtcccgcgccatgcgcctgcactcctcagcccttgggcagtcgatgggactgggcgccgtggagcagggggcagctctcatcggggaggctcaggccgcacaggagcccacggtggggtgggggagactcaggcatggtgggctgcaggtaccgagccctgccccacagggaggcagctaaggcctggcgagaaatagagcacagagctggtgggccagcactgctgggggacctggcgcaccctctgcagctgctggcccaggtgctaagcccctcactgcccggggccggcacggctggccggcagctctgagtgcggggccgccaagcccacgctcaccgggaactctagctggcctgcaagcaccacgtgcagccccagttcccgcccatgcctctccctccacacctccccgcaagccgagggaggcggctccggcctcggccagcccagagaatggctcccatggtgcagcggcgggctgaagggctcctcaagcacggccagaatgggcgccaaggccgaggagacgccaagagcgagcgagggctgcgagggctgccagcacgctgtcacctctcaatatcactgtcttaaaaatcctctgtgctctacctcatcataaaagtaagaaacctaggagtgtttctctctttggtttccaattactttggcctgggataaactgggacttctcaattcattgcgggccatttaacagttaatgagaagcatttcatggtctttctaaaactcttgtagactaataatagctatgatgaagtatatagaaattcattaatatttataaaagtaataaacattgagtaatagaattatgttagcattaaaattcaattattaattacattattatttcaactaattttgcaaaagaccattgactataggttcttagaggctaaaagaaaattagaagtctaccaccccacctcctttgttttacagatgagaagctaaagcttccaatgtttaagtgatttgcctaatcgaagccaggaccaaaactcatctaataacgtctaaacgtagtaccttccactgaatcaaagagttgggtcttcctgttttccctttttctccccccttcttttcaagaattaatattctgaagtattttccagatatggaatcaccaatttataatgataaatatgcaagaagatcaagataaattttgtgtattatcttacatttgtgttttaaattgatagctgctatcaatggcatgttaaaaaatactttagtgaatttcatattttgatacagctttcagcacagatcagcaatttctctcaagttttttgattatacgtttgattccagaaattctgtttcactggtactaattcaatgtgtttactcttcttttgagaatggtaccttactataaatgtcgcaggagaaaaaacattgccatttaagctacagaagtgctgaatatgacctgcacgtgttgaaatggcagtgctgcgggagaggttggaaaatgtgtgatgctgtcttataattttagctcgggtttatgcaaatgtgggcatttatcttgttattttcacagccatacacatttactgccgcttgaagttatccttacaagtgatcttcattaaattaagtttgtcttacaggagcagaaggaaaaggatgatgtgaatttcacctttaaaaggcagcactaggcaatgcaacatttaagaagtgttttttgcctgtgcccataaaaagctataccactttgttgatggatttgctattttgtgtcctattaagtataaaatgtgaccatatattttggattccaaggtcttttctggtttgttgaacacattagtgcttatgatgatgatttaaattagttttaatgtacttgggtagtcaagcgtacagtgctttgaagccactaagggagaaaaagaagagatatttcagccttccccagtaatgagacccataaatcaaaagaacgaacatggaaacttcaagcaagcctagggatctaatttcaaacaccttaaaagagactccttttttggtttaggcttgccatgtccgtggtgcccagtggaagggctgagctgaaaaatttggataaaaaacagagaacctctataggattaaaacaatggagccagacgctctcagtgttagcctttggatttgagaggcttgtgtttaagaagtctgggcctgaagaggtggaaatacagggggtcagattcagttacagatacatacatgttcaaataccaaatacatgtcatttaagggaaccataagatgactttgcaagagggagacttttttccatgaaatagttatagtagacttttcaaactaactctgaagtgaaattttgagcataaaagcttttcagctgacaaagagaaatggcatgaatgtctgagaaaaaaaccagacacatccctaaaacaacagagaaatgccttctagactttagatacatctatggcaaataggaagacaagctatttctagacctctggcaagaagactggccttttactcagttcttaaagaaaatagctaagagaagtttggaataagaaatccaagttcttctacatgttgttggttcgggcaatgtcaaagatttttttcatagcttgtctcttggaggctgaccttggactgtgcacatggacctatttttaaactgtagactccatttcactcccacatattttacccttctactgttcaagtgctaaaaccagggattatttaagttagcttactctgttgcaggctgggatgagagtttaggattccaaaattgtgttagaagtgggttgagaggaaataaatgtggagaggctaaatgacagttgtgttatggatccttttccttttaatttccccctatttttaaaaaactcactggagtcctagaatacacacagataattgacgtatctctaggggtatttgcattcaaggtaagtttcttttgattttagtaacatgtggcttttgattattatggaggacaatttaagcccaaagtattattttgccatttaggtttgtatcttaatttgggctgtgctgaaatcatcttggggggtgtgtgtgtatgtatgtgtgtgtgtgtttgggggggatgtgtgtgtatgatatatgtgggtaggtgagatatggagggaggcagggagggaacttttaataccgttcgttgtactgaattttaaattcagatctgtgtgtgtgtgtgtgtgtgtgtgtgtgtaaagaaatgcatttgtcatggctaactgtggtctttaatagcaaagtgaccagagcatgaattattttcttattcaaagaaaaatgaggggatcagaagggccactggttttcaaacaaaaaatagtacaaggtttatgtttttaaaaaactcatgttatagtgattgaaattttcttgtttggcagccttttcaaaaattaaaaattatattactttttttttctgaaatagctcttgcaaacaattatatgaatcaaaactgaaaactaattgtaaccatgtatttgcttatatcagatcatagaccaataacaaggatgttttgcctggtactgaattgtagaaactggagttggtaggacacattcctttaactttgagggatgattatggataaggcaattgaagtatttatggaagataattcagtctatatttaggaaagacttcttttttctaaccaaatatggtgggttttaaaaatcttacatattacaagatggatggatgatactggtccatccattaatacaccctattttcttaatgcctttcagactaagatgcacacatcatgagtatatgtttacctataaacactttgtcatgcatgtcattaactagaggtcagtatttgcttatagtgttatttttaaggtaaaatttacagtgtactgaaatgtacaaatcttacatgcaccctttgaattttgagaaatgtgtacttatgtaatccaaaactctatcaaggtagaggacttggccagtatctaagttatctcatcagttttctcagtcctaccccagagacaaccactcttctgatttttttcaccatacttttcactattctagaaacttcatgtgagattatacaatgtgtacccttttgtagaaggctttttacttaccatactatttgtggaatgtgttaatactgtcgcgtgaataagcagttcattcctttttattgttaggtagtattccattgtataaatatatggcaatttgtttgtccagtcatctgttgatgaacacctgggttgtttctagtttggggctattataaataaagctgccatgatcattcttgtgagttttcctgtggacatatgctttcaattctgttgggtaagtacctaggagtagaatttctgtgtataaggtaggtatgtggttagctttataagaaactctcagatgttttttccaaagcggtttatcattttatctttctattaggagtggatgaaagttctggttgcaccacatctgggcttacagtatagaattgtcagtcttcttcatgttaatcattcttctgagtgtatagtggtatctcattatgtttttaatttgcatttccctgatgactaatgatatcgaatagcttttaatgtacatattaaccatctgtatattcccctttgtgaaatgtctattgaatatattgctcatttattaatcagcttttttttcttaatgagttggaattttttattagtatatatcctggatatcaatcttttatctctctgtctcatacacacacacacacacagcatttttttcctcttactgtgttagttttcttaacagtgtcttttggtgagcagtttttaattttgttgaggtctgattttgtatgattattgatttctgtgtgtcgctcaataaatctttgcctactctcaaattataaagatattttcctatgatttcttctagagctttgttgttttagcttctgtgtttaggtctaggattaactttgagttcacttgagtgtagtgtaaggtgagaatccaggatgcttcattttttttctttatactgatatctagttgttcaggatcatttgttgaaaagagtttcttttctccgttggaatgctttggcaccttttatcaaaaaatcagttgaccatatatatgtgagtctatttgggagtttccagctattctgttgatctgttgttgatccttatgctagtacagtaatcgcctctttatccatgagaggatatgttccaagacccccaatggatgcctgaaactgtggatagtacaaaaccctctatgctatgattttcgtatctgataaccaagatagctactaagtgacgaatgtgtgggtagtatgtgcagtgtggatatgctggaagaaggtgtgagtcatgtcccaggtgggacacagcaggacagatttcacactactcagaatttaaatcatgaattctttacttctggaatttaaaacttatgaattgtttaattctggaattttaaacttctgaattgtttatgtccatttaatgttatgagactgaaaccatgggtaactgaaacagcagaaagcaaaccacagataaggggggactcctgtcccacactgtcttgagtactgtagcttcaaaagtaagtcttcaaatcaagttgtgtaagccctcaattttgttctgcattttcaaaaccactttttgacatttgtaggctcttcatattgctgttcgaattatagaattagtttgtcagtttctttttttttttaagtctgatgtgattacaatttgcattgtcttgaatctggaacacctggtgaaaactattttcataataatacttagacattatttgctttcacactcattgtctcaggagtacagtggagttttccagagaatacataatgtgtgatcttgcagcagattgaatgcagaagcagataggcaatcaggctctcttcttttatggtaaacattaatggtatttgcaaaagtgtaaaacaatgcaaagcttaatacattttattttaggaaaaagaaaaattattttaacatttaatgggcttgttaattttaaatgaattaatattttaacattttttaattttaaattccttctctggtaaattttgatagctataaactacataaatattaaaagttttttgggatcctcagttgtttttgagagtttcaaggagtcctgagaatgaagggtttgaaaactgctgccatagctcaattttgggacaattgatgccttaacaatatttattttttcaatccatgaatatggtatatctctacatttatatatgttttatagttttcagtatagagatttctgaagatgttttgttaaatatatttctaagtattgtatattcttttttttttttctttttgagatggagtctcgctctgtcgctcaggctagagtgcaatggcatgaccttggctcactgcaacctctgcctcccaggttcaagtgactctcctgcctcagcctcctgagtagctgagactacaggcacccgccaccatgcctggctaatttttgtaattttagttgagacggggtttcaccatgttgggccaggctggtctcaaactcctgacctcatgatttacccgccttggcctcccaaagtgctaggattacaggcgtgagccactgcacccagcctctaagtattgtatattgtttacacttacataaatgtaatataactttaaattgagttttctgctaatatatagaaatacatttaatttatatttagtgaccttgcagcctccaaaatttcaaaattcacacattagtctggtaacctcaaactcatattgtcaagaactgtgaaaggtttgagattttatcttgcttgcaggctaaaaagttagcctcccacagtttcatggatgctgacagaagacaggagaatcctgggtaagagataaagaactttattactcatggcatagcaggcagcatgagcttcatgttcagattgggtctccacactccctaagcttcatggggtaatgcagagtagcccaggtcgatgttactcgtgtagtaggtttgtgtcgcagttgaggaaccctgagcttaggaaataccattctttaaaaggggctgctagccaactttgcctaatctttgtgccagatggagatgttattttcatttccctggatagcaaacaaatctttcctttgccacagaaggagatactatctgttttccaagactgtgtactatataaacattcttgaaaagacaggccagaagaaaagctgataaagatatgcagaaacacagaaggcacatgggtaattttttcccaacttgtattgttgggattttcttcttagtcatgtcatgtcaaatacagttagtattgtgtctttccagtatttatgcttctccccttttgctatattttactagccaggactgctagtgtaatgtagaacaggagtggtgacagtggtcatctttgccttttgttctaggttttagggtgaaagtatgttattttaccaatcagtataatacattaacaaaataatcattgtagaaacggggtctaaaatgaggaaattatcttatattactcatttgctgagtgtttccttttatcatgaaggcttgttgtatttgccagatgcattttctgtatgtagtgtgatcatcaataaaaatacgattattttttattcctttattctgtcagtatggttagttaaatcaattaagttttaaatgttaaaccaaccttgcattactaggataaattccacttgaggtgaggcatggtggttatacctgtaatcccagctttggaaggctgaggcaggaagatcacttgaggccattagtttgagaccatcctgggtaacacaatgagactccatctctacaaaaaataaaaatattagctgggtgtggtggtgcacgcctgtagcccaagctactcaggaggcagatgtcggaggattacttgagctcaggagtttgaggttacagtgatgatcatgtcactgctctacatcctgggtgacagagtaagaccttgtcaccctgtttctctacaggaaaaaaaaaaatcccactttgtcagggtgtattagcctttttctatattatgaattcgatttgtggaccctttttaaagaatttttccatatatgttgatgaggaatattggtctgtgagggtttggtatcatggttatgatggcctccaaaaacaggttgggaggtgtttcttcttcctgtatactttgaagagtttttataagatgggttttctatctttcttaaatatttgttagaattaactggtgaacatatggtcttggtcttttatttatgagaaagtttttgaaaaaattcacttcgctagatataggattatttatattttcactttcactctgtgtcgttctttttatcggtctgacagatgaaaataacctgttttaaataacagtgaggttaaatagtagtagtttatggctgtttgcatttttttcctcctattttccggccagttttctattagatcatgtatctttttcttgttgaactctttatataatactatgaactttctgatatctgtctatataccaacctataatcaatattttccctatttttcttttattctgtttatatgtatttgctatgcagaagattttaaattttatgtagtcttatctgttaattttttctatatggtttttggccctaacatcatacaattgtattgaatcacagccatactcacttgtttatatgttgtctatagctgctttcttcctgtaatggcagagttgagttgtgacggagactgcatgtagctctgtgatcacttttcactgctgcttggcaccccaaaaatcatagttaccacatttaattattttaaacttagaaattgtcagtgtttttagtggcatgtgtattaacttacagtgacttttttttattttttatcagtgtaaatccttgatgtcagaagagtagaaaagtagactctgaatgtcatactttaaaaggcatagtggagtatggattattttgttattaaattagatggcaaagcattgtgtttattatgtaatgagactgtaactgtgctaaaagaatatacggtatgctgacattaccagactaatcacttatcacaatattttcaactcacagaaatgctgtggtgaaaagttagaaaatttaaaatcaaatgtttcattatagcagaatttctttacacaaaaaagaacattcagctgcaaacaaggtaaatttgcaagtgactcctttgttatccaagccaggaaagccatttattgatggtgagttaattaaatcatgcttgattgcagcagctgaagaaatgtgttcagagaaaacaaaattgtttaagactcttctaagccttgagcactttgggaggctgagatgagaggattgcctgagtccaggagttcgagaccagcctgggcaaactagacagaacccatttctacaaaaaataaaacaatttaaaaaaagccaggcatggtggcatgcctgtagtcccagctactctagaggctgaggcaggaggattccttgagcccaggaggtccaggctgcagtgagctgtgatcatgccactgccctccaccctgggctacagaacgagaccctgtctgagggctaagatttatttttttctgaacaggataaattgactttagctactattgaagactgagtggctttggaaattagctttagctgcagagttgataatgaattcaacataaaactataaggcaaaacagtgcttatatgtgaaacttaatattgaagtaaagtcacttagatgccacctaacattgttttaatcactagtaatattaagatgctttatacacttcttatgctgtcaaaagtgaaaataagaaatgagatctctgtttgcataccagttgtagcagatacattttcttagctcaactaagtactgttgaccttccatatccatgagttctgcatctgtttttaaccagctttgaatcaaacatatctgggagaaacaaatggcatctgtactgaacattcacagacactttttgatcattattctctaaacaatacagtataacaactatttacatagcatttacattgtattaggtattatgagtaatctagagattatttaaaatatacaagaggatatgcatagattagaagcaaatactatgacattttatattagggactggaatatccacagtttttggaatctgagggaggtcctggaactaatctcccatggataccaggggacagctgtaccagcagtgcttttggaccacaatgcaagtagaaaggaaatttctataattcaaaatctatttaactgtgcagttgaagagcttccacttaactttaattgcaagtgaagaatctgaaatgtagcaacataccaaaaggaggatatcaacagaagaatataataaaaatttttaaatgccatccaagtaatgaatatgcttaaataaaatcatatgctcctggataacagtattttttccatacacaaataggtgtgtgaaaagacattttcagagatgaaatatgtaaaatctcattagagattagcattagcagagtaacatttgcgattctttttttgtggggtggggggagggtgtaaacatatgtttttatttctcttgaataaatgcccaggagtgcagttactaagtcatgtagtagttgcatgtttagtttttttttttaaacaataaacattatttttcgataatttttagattcacagccaaaatgaagggaaatagatatatagtccatatactccctgcccccaaatgtgcacagcttcttccattatctattaccactcccacaccagaggggtaatttgttataaatgatgaacctgcattgactcatcatcatcgtccagagtccatagtttatattgctgactcttgatgttgtacattctgtgggtttggaaaaatgaataatggcatgtatctgccattacagcatcctacagagtattttcactgctctaaaaatcctctatgctccacctattcattcttccttctcccctaatccttggcaaccactgatctttttattattttgataatatttgcagttgattttgatgataaggaatactaactttgagtcccaattaagcaaattgtcctccctctaccaaaagaatatcattcttcacattaggaggcttatatacaaataattatactttgttattaatattatgttttgaattttgtcaatgaaaaatgtgtgtgaaattgttttctctcattaagtaccctctatgataccctcaatattgccttttggcccacaactaaaatatatactatatgggtctttatggaaaaagtttgctaacccctgattcatatcaatgtttaactattctaaccatttagatcagagaatgaatgtttttgtgcctcaataaatgtcagtttcaaaaaccaacagcagtaaaggaaattttgtttggggctcaggatattttgctccggaagttaagcttacttaaagtttactcttgttctgaaattgtgttaagttgtctgggagagggttgagcacaatacatgactgttgattcctctctgtgtacttgttaggtatccctggtaccctgagatgatggccccactcaaagccagacttccgagagcctggactggggagaaagatgcccctggctctgtgcactgatgcctccctccccgccccactccattcatacccacaccctctccctctagtctgcacctcttcctcctgtgcatgggaatatctagtccctcagttcccaaatttctgcagatgaagcacccattcttgtcattcccacttatgatccattttgatctagaaggtagtgttgtctcctaggagggcaacaagcaagtctgagctgcctgccccagagtttttgctgtttgctaaggcatctctggggtgaacagagggcaggtcaatgttacctgctgaccttgaaacccttggtgtgtgtgcagcacagcctggaagttgtcagtcaagattattctcaagcctcatagactcaggttcctagtacagacatctgcatccagaccagttatctgctcacaaaacaaagttgaagagaacaagaatgaacatcatgcagttttgatttttgcctcttcattctccctttcccccattttcatccacaaatgcttactgtcttcaccattttgtgcaatattaatttctctgggttatttatagggagtgggtgggcacagtgcttatgacttagaatggaagacggtattccccgaagagctctcaacagctcacagtctgagggagaccctgtgggtacttggtctgttgatcctgttgaaaagtgagcatagcatgtgggaaagtgactcatggatgtgacttcaccattgccctccttttaaacttcttacagtgaaagcataacccagttctgacaaaggttttcagccagggctgggcctgcctttgactcagcgatgtgtcacattctctctgccggaaactctcattcttaacaccagtcatcatggtcctggcaacacactttttggagaggtgttggtatttggtggatttattttcttttccagctgcccacaaaaaaacaaactcagaaatatctatttgtttttcctttgaaaagtttgttggaatagtgtgtcatttctccatctggagccgttgttgctttgccaaggatagtttgcttagggccatggcaaggtgacggtggccctaagtgaagggtaaaataactggggcggcatgcccgtctgggatggcgaaacctctgagctgctgtcaggcggtgggtggctagccatggctggtggccacaggccatcacttcaactgtggctgggatttgcttaaagaagtcctttaagtttcttaagtaatgtctgcccagtcactcacctaagcggatacctctttactgttcggtgattttgtgccaagagaatgcctagacttgccagcccacattggaaacttcccagaagcccaagggccacacctaatttacaagaactggaacccctattccattctttgctgcttacagcttatgggagaggcatgttctaacgggcttctttccttctaatttgtagatcctgtgcaggcagctccttgaaggcagggctgtgcctttcttgtatgttttcttagagtgttgagctcagaggagaccccagtagagaaggcactgtggcgtgggggagtaacacctgtttagtagtcaggggaatagggtcaaaactccacgttggccacgggctatgagatcttggcccagtcagttcatttctctgggcatttcctcatcatccaattgctgggctgagtgattctctaaagcagtggttctcacccttgctagatgtatgagaaacacctgtggactttttattctttaatcatacatgatctggccacagccactcatagtgggttcagcaagtctgggtggagcttgcagagtaaagatttttccagagttctttatggccagggttgagggccactatgtgcagtccctgactagataagcaatgggaacaaagagtgagtcgttcaggccacttccaagcttactcacgtggctttgggtaggtcttggttcctcatggcttttggcggaaggcctcattcatacctcactacctgggcctctccataggacagctagcttgccttcctcacagtgaatgagaatgtggacaaagtagaagctacagtctttttgtaaacgcaatctcagaagtgatgtcccatcatgtttgtcatattttattcattagaaatgagtcccttgatctgccttatactctaggggagaggattctgcaagaatctggactaccaggcagtgggatcattgggtgccatcttagaggctgccttgcacagcatctaggaggtggctgcagaatggattttggagcaggaacagggggaagggaagcagggaatcagaagggtgtggtccacaagctaatggaaggaggatagaattcaagtataggctaggttatgatgtcgtaacaagtcataatctgaggggcttgaaataacaaagatttatttcttcctcatgcagatagtagttacaggctgttttgggctttgtgccatatcatcacacgtgggacatgttcatcacgggtcgtctggggattcttctttatgtcattttcactgtgggacctaagctgacaaagcagcttgaatgtggaaaaactccaactgtgcttcccccactatactctcacaaagcaaatctgacaccggatgtgtggggatttctgcccaccagcaagcaagcagtcagttctgcagtgcacaccaactgaatgtcctttaattgaattctgacactgtctacctggagacagcatcggatcccacaggttcagggctcagtcccacgagactgcccccgtttcagataccagttgcaagtctgagcctctggaacttctgaccaaccagtgtcaagttggggttcccatgatctgctgtttgggtttgactaatttgctagagcggctcacagaactcatggaaacacaggtttaccagtttattataaaggatattgcaaaggatacagacgaagaggtgcttagggagaggtttaggggaaggggcgcagatcttccatgtcctcccgggatgcaccaccctccaggcacctccacatgttcagctatctgaagctctctgaacccagtcctcttcggccttttatggagacttcattggataggcatgattgaagcatggagtggggaaacctaccaaggcctgtccagattctcagcctctctgtgcagcattccttcctccagggtctggggcagcacccctgaaacaggggccttaggacctgcaatcagacaaggaaggtcctcgcatttgttcacggtcagtttcaggacagaaaggcagggggatatctgagtatgtttttagtttctaaggccttccttggggagaaaaaagtgcaggtgaaaggaaggcagaaggtcagtgagagagagatttgttttttgaggactaaaagtgccccaacatgaggtgataaggactatgggagttacgagccagaaaccatggttgaaaaccggtatattaatatatatgtcatagtatcacgcaagtactctcagaaacattgctggttgccatggcagagggaaaaagttatggaaaagcatgtattagctcttaaaacttcagcctatgttatttccattcacgtttcattggccaaattatgtcttatggtctaccaccacttcagagggggcgaggatatgtactcctgtcatgtgtcccgagagtagaagtctggagatatttgattagcaccaatgacacccctggggggagtagtcagtagtgttgccctccacagagccgggcaacgtgaccactgaacatggtgtttcggttggcattcacgtggtcattgttaatcttaatcttggccagttcagtagttgtagaaaaatgatgtataacctgattgcatggtttgaggagtgaataggagatgagaaggtgcagagagctagaaggaaagaattgtagacattttttaccatgaaggaagtttgaattaccagcctttcctcattcttttgtatgtaatcacagaatgatgtcacagtgttttttttgtttttgtttttttattttaccatgtacatatcaacagatttttctttgactataaaggactctgtgctttgataataatccagaaatgaccagaggaagtttatcttgtgtgcactttcaatattgtatttaaataggaaatcacccctttttacagttttcatctcgagccaaacaaagtcaaggtattatgagaactgcaacgctttttgaagaaacctatcatacatttatttttcttagtttttctttcttcttccctttttaactggttttgaagtttggaaataattaaattttattcagtctccaaagttgctctgaaacatcagtttttcttctttctttcttttttttttggacagaatcttgctctgttgcctatcctggagggcagtgacacaatctcagctaactgtaacctccgcctcccaggttcaagcaattcttgtgcctcagcttcctgagtagctgggattacaggtgcctgtcaccatgcccggctaatttttgtatttttagtagagacagggtttcaccatgttggccaggctggtctcaaactcctgacctcaggtaacccacccgcctcggcctcccgaagtgctgggattgcaggtgtgagccactgtgagtttcccatttttgctgagttcagtattcaagcaggagatgtgaaactacttggcaaattgtaaggtgatatacaggtataagtcattttgccactttttccattagttttggttggccaagtagtagcattctgcacattttatttctgttgtgagctaatggtctgaagttgaagtgcagatcgtccgaaactgtataattgagatgttgattatatttggcttcacagaattctaaaaagtagatttaacgtatatgttgtcctgaactaaatataagctggcacttcattaacatttaagaattgatagaaaagagacgtagctgcaaaccggggctgatctgcccaaatgcagcagcaatgattattttgccaccattttcttctcatcagtctcccatctcttgtcatggcctttttcacttcttcctctagcagtttcaactgactcagttactttctctaggccctgtactagggtagagatactgaaagagctggtgatacctgccttaagaagggtcaaaaaaaggccgggcatggtggctcatgcctgtaaccccagcactttgggaggccaaggtgggtggatcacttgaggtcaagagttcgagaccagcctcgccaacgaaaaccctgtctctactaaaaatacaaaaattagggctgggcacagtggctcacgcctgtaattccagcactttgggaaggccgaggcaggcaaatcatgaggtcaggagatcgagaccatcctggctaacacggtgaaaccccgtctctactaaaaatacaaaaaattagccaggcatggtggcagtcgcctgtagtccctgctagtcgggaggctgaggcaggagaatggcgtgaaccgaggaggtggaggttgcagtcagccgagatcgcaccactgcactccatcctgggcaacagagcgagactccatctcaaaaaaaaaaaaaaaaaaaaaaaaaaagcacgttagatgggcatgatggcacctgcctgtaatcccagctacttgggaggctgaggcaggagaatcatttgaatctgggaggcggaggttgcagtgagctgagatcacaccactgcactccagcctgggtgacaaagtgagactccgtctcaaaaaacaaaacaaaacaaaacaaaaaatggataaaaaaaaaagatgttgtggtggtaaaatttcagataacagatagatggggctggagagagccaactgctgagcatctctaaaacctttcttagacacctgtaattctagctcctcaggaggctaactttatacacaatgacttaagatgtcaaggaaaaattagctttgattcaaatattgtgtatgatcctcacattgcaggttttcggtgacctgtggataattgaaagttgatacatgatttaaaaatattttttggggggcaacattttctaaaaggtaaaccttaggtatacattttgatttattactaacttgacattccaatatttaaacttcaaattttgaaatacaataaagttactcctattgtaatttaaaatatcttgagatagctgcaaaaaccatctatttgttggtcctatcaaagaaattgatattattcagctatgagagttatgctggaattatgtttgtaaaaaattccttcccactttcttggcaagatgcaagaatgatgggctgtaaaattgaaccgttaaaatggccttatgcgtgtttgaaccaacatctgattttgaagttacccaactgcctgttaccaatttacctactttactgggtgttatgtttttgtcaatgggggttattaaatttaatactctaagtaagtgatataatccacactttttagcacacgatgctattctgataaaagtcacttccaggtacttgtaagtgaaatgctttagcaggcaaattcttctaagggtgtttcttttcctaatcaatataaatgtgcttctttatttttctaggcattaggtcctcttttcaggctatgagatatatgttgttcagctattatttgcatgcaagagtagacaccaaaagtttctgatttcttagtaataaattaaacctctttgagctgttgaagttattattgcccatgtgcaacagtaaaaaggaatattaaggtatgtttggagttgtatgtgacaaccaaaatgagtgattgaggtataagtctcaaatcattgaggtttattgagcaggatcgggagctcaccagggaaaaatgtgacttacggaagaatctgtgactggttttttccaaagaggttcataggaggtttagtatttatacattttccttaaaaaagaaggtagggtatggcaatggggcaattgattatgtacttgtgagactttagttagatctacattttatgtgagagaaagtgaccatttgaagaagaagagaagagaggaaggagaggtctcaaggagaggtgaaggaaggattaatctcatcttgtctttgttctgtacctgggaagacaagctagtagtcttttggaaatgctggtttctgtttagcccttagggaagaaaacctaatgactgttagcgagggagggggtatcatgaattatgtcctaatttcccatccttttttttttttgagatggagtttcactcttgtcacccaggctggagtgcagtggcgtgatctcagctcactgcaacctctgcctcccgggttcaagtgattctactacctcagcctcccaagtagctgggattacaggcccgcaccaccacgccgagctagtttttgtatttttagtagagacagggtttcaccatgttggccaggatggtctcaatctcttgacctcgtgatccacccgtctcggcctcccaaagtactgggattacaggcatgagccaccgcgcccagaccctaatgtctcatctttttatggctgtgacttcaacttccaagagttctgtggcattcctttggccaagagggcatctgttcagtgaggcgaggggcttagaattttatttttatttctcatatgtgttttgactgtaagtggttaggaaagatgaattttcgtctctcctcctctgccagttgagatatacttctagggctagagaggtgatattgctgttttatagggaagacaagtcgtgaattctaaaagaggacactgtcagatgtgatagtgtaagagggccacacggctatggagaatgttccatataagcttcacacactgacaacctgggcagtgctatgctaatcaatgggaaggttgttgtattgctgctttaaaattatttccttgagtccagctataactgggattccaaggaattactaagggggatacaaagctttctccatttactgatttgcttttggaaaagcgtataagtccgttcttgccctgctataaataaataccagagactgggtaatttacaaagaaaagatatttaattggctcagggttctgcaggctgtacaggaagcacggcagcatctgcttctggggaggcctcaggagcttttactcgtggcagaaggcaaagtcagagcaagcatcttcacatggccagagcaggaggaagagagaggggggtgaggtgtcacatacttttaaacaaccagatcttgtgaaaactctgtcacaagacagcaccaaggggatggtgataaatcatttatgaagagtccacccccatgatccaggcacccccgaaccggccccacctccaatattggggattataattcgacgtgagatttgggtggggacacagatccaaaccgtatcaaaacgcattgttgttttttacttttatttacaaaccaagcccaaaactctcaaacattatattgttaaagaaaaatcctgttgaaattgtaataacaaaaattgtgttcgcttttgaacaagattacttttgcaacatcttggtgggtgtaaacattgaggtttaggcaaacaaaaggtcggcagcttgggtatcagtccactgaaagcaggatccgaacaggaggggaagtggtgaagcgggtgaactcacccttgtagattttgaggttgagtggcttacagcatgttcattcaggaagagaggccagtatgcagttgcaattgcttgcagcctggaggaaggtcacatctagatgcataaattttggagacaatttatttgtcactgatgcctttggagacggttgagacccttcattaatcatgaaatgtgataactgctgttgtaacagcatgaacttggtgttaatcacagagccaatattattaagtgatgttaagtgttgggaacacaaccagtattttctcttaaggaaatgggaaggctgtgtctctgacctcacaaataaatattctggagggtggagttgacagaattttagtgaagcaggtatccagttagcacaggcccacagtgccaaccaactatgaattttgaagcagttagaccttacctaaaattagctgtgctgttaaaagagtgaataataatgctaataatgtgaccagaaccactgatattaaagccaagcttatcttgattacctgtgtttttactgtgtgagaggaataattgtgggaataattatcaggaaaaagtttggggaacagtaaacattgtttatatggacgattatgtttaattcaaataagaagcatacaataggagtatttataatccaggcagattttatagtcacagtttaaccacaggtaagcttgagttaattttaatgaaattctttaatgtatatttgtctttaaaagtagaaatttaagagtggcatatcactaagctggagtctatattacatagtcagctcaataaggtgattacctttgccctcctgtgttattgggatagaataatttttcttttcttctcttctcttctgttttcttttcttttcttttctttttttttttttttgagacagagtctcgctctgttgccaggctggagtgcagtggcacgatctcggctcactgcaagctccgcctccctgcttcaagcgattctcctacctcagcctcccgagtagctgggattacaggcgcacaccaccacgcccagctaatttttgtattgttagtagagacggggtttcaccatgttggccaatatggtaatatttctttttatcctgttaattttattttctttgtattgccattcatatattccgaccagtgttgtaatactgtttatttaacaatattaatgaaacactttgcatcaggcacaggagatccaaagatgaataaatgaaggtcttagtcctcaaggatgaaacattctaatggagaaaacaaatgaataaggcagaatcgcaggacaggacagtacgtgctgtgatggagagtatcacagtgaaatgggaacacacacatggggatggaagaagctttctggatgtttccagctgtattgcactaaaacaacaccagcagatgggatatagcaattcatttattcaaactgatcatagagcttaaagagctaggcaatttggagaattaatacagaattaatattaggaaatccaatgttaatagaaagggtgtgtgtgagattagtggtggttattcaggcatttccatttttaccatatgataagatctgaaccttctgaaacttgtagtaatagaaggacccatttttccttctgtgaaggacccatttttctaaataaccagttgcaccctgctttctgtggcactgcagacttctcccagttctggtcctgcaccctctaaaggtgacaaggctgtcctggactgatggagccacctggggccatcagcctcccacctcctttctggcttcttaggaaacctgtctgtttttcttctgtttacacacttgcaacacagttaagtttccaacagattgccttttcttttcatatgtacatacgttcttcttaatccatatgcttctttactccttttgacttgctattctttctttctctgtgttccaaatgtagactaaaaaactttaactatgactagcagcaatgaaaagaatgtaaatgatattactgtgttaagaaggcagagaccacttttttgttttgttttgttttgtttttttgagacagagtccccctctgtcacccaggctggagtgcagtggtatgatctcggctcactgcaacctctgcctcccgagttcaagtgattctgctgcctcagcctcttgagtagctgggcttacaggtgtgtgccaccatgcctggctaatttttctatgtttagttgagatgggggtttcaccatgttggccaggctggtctcaaactcctgacctcaagtgatctgcctgccttggcttcccaaagtgctgagattacgggcatgagccaccacgcccatcccagaccacatgttttaaactagaaccaatgtccccatttgtttaagcccttgaaaaggccctggagtcctgcttaaatcttctatgtctttatctgtttgtctgttgtctacttaagtctaatgttcttctttttataatatctgtgttcaagataaagagaatctaatatttctatttgtcaaatctttaaaaaagtatgcattcatattattgtatattatattgtattttatagatagcactgtctctgtgaaagactgttctatttcaaataactgacatagcaatctttgaaagcagtttttttctttactgatttgttcatgtatttaatttttcccatttattccctgaatagttactgaggcactgtgtactgggatctcagctgaaaaagttatactggatgcacttaaagattttgttctgggataaatcttgcacatacatacactttcttcatgtactttcaatacacacatcaatgtatagtatatatcatgcgtatatacacacacatatatgcatatatggtagaggagaaagagtattttccttacccattgcaaggttcgtggctgaggcatctataataaaagacaggttaataagagaaaagcgtatagatttatttaatataagtttcatttgacatgggagctttcagaagtgaagacccaaagaaacagggaaacctctatattttatgcttagattagatgaagagtgaacttttgtgtggaagtatgattggacaaagggggtatgatctaatagtaatatactggggggaacttagcaaagcccctttgttcagttcttcttggtgtctcagtgtctttgaggatcagaatgtttctttcctctgggtatagggaggatgcctctggaatgaagattttaggaccggcttcaggggagaagggccagggaaggtgagagtgaccttcctgcttctgctgtttttttaaatgtcaaggtgccatattttggggtagcctgtcctaaactccatcaatacctatacacagatatacatatacacacatgtgcccacatgtatggacacacacgagcatacacacatgcacacacacatatgtaaagtggtatttgatctaggaattgaaggatgggtcagagtaattgggtagaaatgtgagaagggcagtagttgtggagggaattccgtgctcaatccatcagggtaggaaatctcgggctctgtaatgttgaaaggacctggatttgttagcacgttggttctaaacaggggagtagtaagagagaaggctgaaaaggtagtgctgtggtttaaatgtttgtcttctcccaaactcatggtgctgatattgtttggctgtgtccccacccaaatctcaccttgaattgcagtccccatagtccccatatgtcgtgggagggacccggtgggaggtaattgaatcatgggggcggttaccctcatgcttttcttatgatactgagttctcacaccatctgatggttttataaagggcttttcccctctgtgctcggtacttctcttcctgctgccatgtgaagaaggatgtttttgcttccccttccgccaccacgattgttaagtttcctgaggcctccccagccatgcggaacttgagtcaattaaactttttttcttttataaattacccagtcttgggtatgtctgtattagcagcatgagaacagactaatacaattgccactgcagcagtcttaagaggtgggatctttaagaggtgattaggccgtgagggtttcgtcctcatgaatggattaatgacactattgcaggagtgggttcctcttagaagaataagctcagcccccttttctctccctcttgccctctctttgcttttctgccatgagattgttgcagcaaaaaggcccttaccacatgtcagccccttgatcttggacttctcagcctccagaactgtgagccagtcaatttctgctcattataaattacctagtctgtagtattgttatagcagcacaaacagactaggacaggtagcatagtggggatgaatttcagtccacaaagttaaccgtggctaaagtatgactcacttttttttttttttttttttttttttttttttttgagaaggagtctcgctctgttgcccaggccagagtgcaggtgcgatctcggctcactgcaagctccgcctgcctcagcctcctgagtagctgggactacaggtgtccaccagcacgcctggctaattgttttatatttttagtagagatggggtttcaccacgttagccaggatggtctcaatctcctgacctcgtgatccgcctgccacagcctcccaaagtgccgggattacaggcgtgaaccaccacgctcagcctactcactttttgatcataactccgtttatatttcaggctcatttctgaccatgctgtaggaggcatctctttattcttcttttgaggtcatctcctctctgccttgtgtcctggtcctgggatcttgcctttgccggtcactgggtgggcatctggtcctcactgggtgggcatctggtcctcactggtggctaatgcaaggtactcctgagacagaaaacctcccagttctccaggcccttgggctctttgctgtgtgggaagctttgtgaggctgctgcctgccaagctccaccacaaaccacccttcccttgttggggtcttgtcccttccccagcagctctgcttgtgaacccagaaacccatctcttctccgtcctgcttgctgcaggtctctttctagtctggtggaacttggtagttctggtagcaggttacttgctctacacatgagaaccatttcccatctgtgcttaggcttagtcaggatcatttgtaggctagttctgctgctttcaggtcatacccgtctctcaagatcaatgaacataaggacctgttcctatcttgattgaggaggaaagaaggggaatgtaccagaaagaaaaaaaaattagatcatttctcaaaaaatgtgtcctccacaggatggatctcagttgaggcgggtcttagacatcaaaattgaggagtccaggcttcactgggaaggtaacaggaagccttgagtgaccctgagctggggagtgacatgtgatgagggttgtgtttctcctgtgtggcaatgggaggcaaacaggagaggggggaatctggattcagggagaccccaggggaggctcctagcatggtccctgcaggggtgatttctggtgctgcagtaggtccttaacttagagaacaatggttagtacagctcgtgccctgtggacctcacccaaggctttagttcatggaactcccaacaggaagccatattaccaaactcttacttatatgttaccttaaggcagagctgttctcattgcagaatgttaccatttgaatgggaagctctagaggtcgagaaacgatcagtgactgaaaaaggaagttacagaaggttattcacgaagggaacattctttcatttcatgaccacctgacgcactgtcaaattgaggaagccagcattcctaatgggttttttgacctggaaggacattggatactctgaaagaggaagctactctaataaggttggggcccccagactggtaataactggttaacttggggagaccttgccgagtgttaattaaatttgcattacaggtggaggaatctgatgtctggaaatactttcccattccatttaaagggtaagctgcagatctctaaggctctctttgtgacttttaagaaaatagcagacaaagaaggcttttgtgggataaaaaaaacacggaaagtttcttgctgaaacttgatgagtctgcatttgcagcacatacatgtatcagatttttttgtgtgtgcccagataggcatttttgcttttaaattttcagctgagtctgattacctaattagttcagattggccctttcttggggagacagggaggaaagaggctttgaagttgtgaaagggaccatgaagcagacagggttctgggggttgggaaggtgctgctggtgggaggcgtcctggaggcttctgtctttatcctcattgcgtctgtagcagttcatgcagaggaactcttagggatcccgggtgatagcagtcactgggctttagggaactctgttggagagcctgcaggcaagtggatcaaaaaatcaaactgttgagaggggtgtaacatacaaagcaaggttacatcccttacagtccgtctccttaccacatcccactctctggaaaccaccattgacaagagtttcctgtttattcttataaaaaactcctgtgcgcaaacaggcacacattgcttttaaacacacatgatttgtttgttctcattattcagattgtaccacctgacacccttgactctgctgttcccttttgccagtcagtccagctcggtccgtcccacagctgcggggtagagtccaccatgatccagtttgtttcaccaggtttctgtgagaaacagctggatgtttttggtttccagcctttgggggttgaatgataaccctcatcccccaaaaagatatgtccacatcttaatcctcgaacctgtgaatgagatcttattggaaaattaaggatctagagatgagatcatcctgatgtaaccatgtgggttctaaatccagtggcaagtgcccttagaagacacagaagagaagacacagggagaggagatcttgtgaggatagaggtagagattggagtaatgcagccacaagccgagaaatggctggagcccctagaagctggaagaggcaagggatgattctcttttagagctgccagagggagtgtggctctgctggtccctggatttcagacttctggtctccatacccgagagagaatacatttctgttgttttaagccacctagtttatggcaatttgttagagcagccctgggaagttaatacactgcccaaactctgatctaatgaacatttttcttattatgagaaataatggacaccttctctggacacatctgggcacatctgctcaagtttaccttcaggacaggtttccagaagtagaattttggttctaggtcctgaaatattttccccttcagatgtatttcatatcacatgcatccttgccttaggaataataatgcaagtaacagtagcaattactgtgtgttgagtgctttttgtgtgtcaagcattgtacctacattatcttattcatcctgacaataaccctatgacacatttattattatcctctttttatggatgcaacactgagatttagagtattgaagtcacttgcataagatcatatgcttacataagaggcaggggggccaggattcaacccaccctctaactccaaattctgtgttcttagctatgttgctgggttgggaagataaaccacattttagactttttggccctgtgttgtatggatgtggtttggcatgttctggccactgggtgtggtgggttctgggaggtgacagactcagttataattacaggaagaagtctggtctggcaggcagcatgtggaatcaatccatggtgcattgggagtctggtgaaatagcaccatgcagatggtccatcttggcgtaatgggatcccaacaggtggactgaacatccaggagttagaacatcagtgataatcacaaagctacagttattgttagctcttactacatgtcaggcattgctctaagtgctgtatgtgtattcacccactgtgaagtaggtaccgcattagcatggaagggaaccatcagtaagtcatgggacgcaactgcttggcattcaggtacagatcagctcctgagtgaggagacagcaagaacaaggctgaaaatggaggtaccaggtaagttcaagaaagagacctcagctcaggctaccgggtgggtacccagttaatagagttgcaagatgggaatacatctcaggagagaggcagaagtttagttaccggaacaggggtccttcatcagaggtcagcgtagcatgacttaacaccaattccagaatccatttggtgcctgctctaaggagtgtagcagcagcaggcccaggaggggaaataatggagcttgccattgacttcctcaggcttatgaccttgtggttatggcgacatacatgagacccgagactgcggtgaataagtccttgatactagtgtgtcgtgttctcatttatttctttattgcaactagtgaacacagggttcagctgtaagacttctgggcagcaccgcacggtaggctttctataagcttagtgatgtaatcctttaactatttttatctttaatacaattgttatctctactggctttgttggcaagttttaattcacaaggagcattaagaagcgtgatttctgttggctcagtaaagtgattttcacttccttgtctcgttgggccacctgccatctcttaacttttggcaaaggaaaataaactaacacattgtctttttatttatatatttatttattttttttggtggaagaatatccccatcttgtggatatttgcattgtgttttagcttccgtggttataaatacagattcacccagtgtgggcacttgatcacagagattattcttagagtcttctttggtgtccaatttcaccagcatttcggattctggacacagaagcaccaggctgtccctcctttatgcttttttttttttttttttttttttggagaaagggtctttctctgtcacctaggctggagtgcagtggcatgatcatggctcctgggctccagtgatcttcccacctcagcctcacgagtatctgggactacagttagtgcctggctactttaaaaaaatgttctgtagaggtgtgctctcactctgtctcccaggctaatcttgaactcctggcctcaaggaattcttctgcctccacctcccaaagtgttgggattacaggcatgagtcactgcacctagcctcacttatgttctatttacctttaccactgttgcactttcagcattttcaaagtcctctcaaaataatggtttcctttgcttctccaaacagacttaagtaataggttatacattctactttaagatgagagaattactttgttttaagatgggggaatttattgtgtaacagagaataaatcagtcttagacctgaggccagaaatctctgattttcttgacttcagatcacttaccactcccaccctctgtcctgcccccagcttcaatcatggaagaaacagaatgtaaatgatagctgtgtctcaaaccatctttcagaaagctgaccagaaatataagtcacattgtttataaagtgccgatggagtttatccaagcagaatttgctttcctttaattatttgttaagtgcatttctcgagttttcggaaatggaaatgagtttactttatgagccataccatcatgttctaattactattttaagaagttaaagacctccaaaaattggatttgacttaaacatacaatgtatggtgtcagagtaaagattagggcttggactgatgttgtctggtacacaggaaaaaattctattacgtatagttaaaatgaatttttaaaaatttggtgctgaaatagtaaacttcagtctttaggcattcactttggtaaaattcctggaaagcaccaggcatgtcaagtgctataatacaaagttttacaaatagggatttgaagtgattgcttttatggcatggaataatgccaaagaagtctcttgttaaatatggacagtgagccgggcgcggtggctcacgcctgtaatcccagcactttgggaggccaaggcgggtggatcacgaggttggaagttcgagaccagcttggccaacatggcgaaaccccatttctactaaagatacaaaaattagctaggcatggtggcgcgtgcctgtaatcccagctactctggaggctgaggcaggagaatcacttgaacccgggaggcggaggttgcggtgagccgagatcatgccactgcacttcagccttggcgacagggcgagactccatctcaaaaaaagaaaaaaaaaaggaccagtgtgttcttggagacagagtcttgaagtagaaaatgcttaggcacattcttgatttgcacatgctgacgcctgcatgtgttccgctctgtttggaaatgtatccctagactgtaagcttcatgagggtaaggtcttagtccatcttgtttttactggatcccttggcttagaacagtgtacagtagggacttaatatatatttgttgagtgaattaatgaacaggtacataaaggtagcaagaaatgaatgtagatctttattagtgacaaatgagtgaaactaaaattcaaaaattggggacttgtatgctatttgatcatggtcaagatgacaagaatatatcatttaaaatattatataatttaaaagtagttgtgcattgaaaatgcgtgacaggctgggtacaggggctcatgcttgtaatcccagcactttgggaggccgaggcgggcagatcacttgagatcaggagtttgagaccagcctggccaacatgttgaaaccctgtgtctactaaaaatacaaaaattagccaggtgtggtggcaggtgcctgtaatcccagctactcgggaggctgaggcaggagaatcgcttgaacccgggaggtaaaggttgcagtgagccaagatcgcaccactgcactccagcctgggtgatagagtaagactcagtctcaaaaaaaaaaaaaaaaagaaaaaaagaaaaagaaaagaagaaaagaaaatgtatgacaaagtgggaaaagcttggattttttcatagtggggacaaaatatgagattggagatgacatacctagcagagtccctggcacataaaagcagcatagaacatttattttccgttctcattagtgccttttagatcaaattgagaaggaaacactagagtcagcgatacttgagtagggtgatattgccctccacgtgacatgtggcaatgtctggagacatcattagttgtcatggcttgggggagggtcctactggcatctagtgggcagaggccaccaatgctgccaatgcatcctgcagtgcacaagatagccccctacaacagagaattacctggcactaagtgccaatagtgttgaggctgagaaaccctgtcctagtcactcataaagctatattaaaatattgagccagataaaaattgtgtcattatacacatctcatgttgaatcagatattactaactaaagtctattaatatgtagcacataagtgaattttcttatttctttatgctatggttcctgacgtaaattacttttgtttttaaaaactgatgatttctgtcaatatcagggacacttttcaccaatatgtttatatatttttaaaaagataacatttgcttttcaaacagtgcagtaaacgtataccaaatgaagcattgctgagctgagcaagccctattacttgataaagttacaacagccacacaagaatggaacaacttgtctatagtttgatcaaaatacacctgattaaaatacatttgatgagtttgctgatatttattgaaatgaaacctagttgatgttacgtgttttatatacatttaacccgcattttagacctactagacttttacatttaaaaagagtttctgttttctctggaagaatattattaatttctgcagcagaagagagttggaaaattagggtaattccactgtttcatttgctctgtctttcagacatggtgaaatgtttcatatttgagtaattggacggagtgggaaagactttgaagatattctttgtgtttattatcattggcttgaaagttggccctttttcctggacatttcatggcacatcagtaactcacttggtgggatcacaggtgttgcctttggtggactgatattctcataatggggatctgatgtatggtatgccgaatctgtcttcgcgcttgtgacattgctcttaactcttgagtgctatctcaagtgtagtttcttgtgaaaattgatgacatttactgaatgccgagtgtgtgttgggcacagtactaaatgctgttcgtgaattacccatttcattctcatcacaatgtcatgaggtagctactattatggttcccattttagagatagggaaacaggcttggaaagtttaagtgatttgtccgtggttgtgtaactagggggtagggaggctagaataggtcacgttaccctgttgatgatctttgctgtcttcaaaggaggggttgaggcggtggggtgcttttagtgagatagcatacagagagaattctgaccttaactctaaagtccaactataataaaatagcaatgaaatataactcaacgccatttcatatagctctgcaaggagagggaaggcacttgctggtacagttgggtttaaaaggattaccttgttgagtcagttttccctccccttggctagcagttggggcagaatgtggaaatacagatttgcagtaatgcatgacctgagaggatgctgcttgagtcaggcttggcttccatagtgtgcacagacttcttcatgccccatgctgctctaattgtacttaagaaccatctaggaatgctatgcctctgggtagcagcacttttgtggagcctccctgtccatgtccagaaagctgtatgaatggaggtttgcctggtacttaatgtgtgtctacgtgtgtgtatgtatgtgtgtgcatgcaatgtatgtttgcatgactctcattggtggtcgtggggagtgtgtcatctcctcccatggacacttcctatatttctggtagcctctggtcctgtggggctgtaagtagttaattgttcctagttctctctggtctatgagcagcttaagcatagatattgtgttaatactagtagtaacagagaccctttgagttctggtctctctctgttttaatgatgaagcaactaagccaaagatgggtaaatagtgcctgaggatactcagcccatgagtagaagagctgaggttcctacgtaaggcggtccaaggtcaacatctgtactctcttcactattctctgttctctcttttatctttgtatccttggcacatggtagttaatcagtaagtcttagctgaataaatgctgcttatgaacacttctaggtggaaattaagcattgcttttaccagagtataatgctgaattgtaatatactcaaggatggtggcaagaatcccctgtacttggtgccgaatcctctgactaatcgcccgaaggaagttctgtgttctcagagcatctgtcctatttgtgtctcttgggtctggatttcccagtctttagtccagtttcataatctgcctcctgagctcttccagggaaactttctgagcttttcttggtgctgtttggagttccactttcagagtgaattttcattctgatgttccctgattggggcctcccctgttgccctgggagggagtcctcacattacccccagctcaagagagagcactggccaggcgtggggcacctctagctgtgtgactgtggagagtagcctttttacatcttgagtttttcatctacaaattgtgagggaaattacctactacaaattgtagtagtaggtaatcttgttctatagttctttgccgttaaaaaaattatggacccctttaacaatctgccaaaaacacaccttgtgctgtgcgtgcacgtgcgcatgcacacacacacacacgcgcacacacacacacacacagtttgtcacagaattccaaggcacccagagaccctgctcactcagatcccgtccctttactagttatccatatgtaaaggatctgttctttattgagttctgtctgtctttgacagtctgtggcatgccatgataaagttctttttaaaataccaagtttattgaaaagatagtcttgtgttagaacttgtaaaactcacaaacctttcagcctgggctttgaagcaaaaaaggaaggtttagaattacaatatagactcccatcaaataggtgttgacaactccagacattaagccttctgggttattcctcactccctgccttctgatttttatcccattctctcatcatctgtattatatacaaacaatgggatgaatgttttttcttggaaggaataaatactggaaggatgtttcataggtggaatttttagtcttagagagaacatcagtaatttatcttcagttttagtttaaatggaaggagtatttgaggagctcctggatcccacagaagaacttgaaatcctctctccccattgctctcgaactctgcatacagcagctgcctccaaaaagtccccatttccatgaccctaaattctcaaattcttctgaccacctctcttccccaccctcccaacctacctggacctattttctgctagtatattttgttctttattatacaaatcccacctgccctcaaggaactgattcatagacctgcactccttccttttagggggaatgtttcagtcacttatagtttcataaattcctttcatttctgtcacaggtggaggggagggaacccagggagtaagagaccaccccacagagcatccactctattagaagaccatgtggcacccacacgaactccagcagacattttctgaagtggaacgtgtctttcaacaaactagcattttgttcataacattctaagcagtccctggtatatttgaatgaagcttttgtttcacttacatgtattttcaaggggaaataagtgagtaaaataaaatatttgatttacagcggttaagatggttaaatgcaaacgtctttggcttgcccctctttcccctccatattgttttcccctgctctccctcctattcagtgagatagcctgttgttcacggattctaatgggattttatttaccgcctggtggaaacagttgaaaaaaaattacacaattggaacaattcaagcattttgaaacattctcttggcagtttttttttcttttttttggcaactaggatacgcctgctcaaaacatttttaatgttttaccttcatgggctccgcatttgccagtgtaaatgtttccaaattgttctcttgatttcattcttaagaccctaggcaatgaatataacatatgtatatatgtacgcacatgtgtatatacatatatgagtgtatatataaagagaaattactcttgttctttggtttaaaaataacaatgatttcttgcaaagagaaatcataattgtgaagctacagttatcagaagccagctaattgaattccactgagaactattagagtcatatacagtaatgatgatgatgattatcatcatcatcatcatcatctcaaaacttgccttggcattcataagaaatctcatgatagcaatatattttagaaatgtggacataactagttctttttattttctttttaacatttcaacaaagtgggacttagaactcagcatctcctgggtcctacataagtaatttaatgtgaaacttaaagatgtaaaaagagagtttaacaggataaatgggttctggcaatacaaggtagtgggttagtaatgtaagttaatgatatataactttcaataaagcttttagagtttttcatatttgcagactatttacaatttttttattaatagttctgcaaaacaacttgtttggaataaatttattttgtatctcttcttcaatgacataagaaggttaaattagcccaatcatgcaaaacagtgagagagtcaaaatttaggggatttctgtttcagtttccttcttcccttaagatttttgtctctgatacttttttaaaaaaattttaaatttttgctgtatctaggagacctaatgtaagatattggaacaagcagttgtctctagacttgtttctgccattgttgacatttacttaattttttgatgttgcataagttatttaatttcttttgcaatcagtttcctcacctgtagaatgaggagactggactaggtgatttcctaagtcccttttagctgtctgaacactgcttttcatcggtgaagttacaactggcctccttcaagaatgtagagtactagaccattatcacatgagttacagataaggtctggggaattacataaagtcatttactgtaattggcttgcagtactctgtgagtaccacataataatgctattttattattcagtgtgttagaggttacagattccccagttgccagagatgtgatgaatccccttggccttggcaaacagactgctttcatgagttgcactgcacatggttataaacccaatggctttctgagctaatgtgcaaggtaatgccatcttccaaatgaaaaaaaagttgcatttacccattcctctaacgagaatatatttctcctcactttaaaaataactccattaccaaatgcaaatatgcataatgagatggaattatttccaaatttatacactatatagtttttctagtgtaagtaaactgttgctatgaaaccaaaaactaagaactttactgccccttttgtagtctaattacttaaaaatgaacaaagaatggttttattctgtgctttttttaaagcaagaaaatatatatcagtatataacaatagtgatcttgaataaaggaaatgtgtttttaagatatagatggggcaaatttttcttatcagactaatggcactacagatgacaattacaaactctgaacaaaatataaagtgaactatttgaaggcatttgagagcaataaaaagcagactgaaattggagggaagttaactaaagaaagaagggacccccaaacatctatatataaactcttcccaaatttcttggctgatcctggggagactccaaagttcctagtgaaaagcaacagctggaaagctgaaagaactgagctattgcacactatagaggaaagataatttggagtttgaatctagccaagtaactgcctgggcaacaaaataattaacattatttagagtaagatagagagtctccgcaaaataatattcatgaaatactgtacctaataataaccatgagaagaagaggaaatttgactcatagagaagagataaaacaatcagtagaaaacagctctaagatgactgaagatgttggaattagtgcacaagacttaaaaagcatatatatataaatatgcccaaggacttaaaatatgatcttaatgaaacaaaagatgggggaatttttaatagaaaaatagaaaacattaaaaaacaggtggaagtttgaaagggtaagtggccttgaagatagatcaatattaattatttaatctagaaaacaaagagaaaaattattaaagaaaaatgaataaaatctcagtgctgttggagtaatgtcatgtaatttaacatatatgtaattgtagtctcagaaggtaagaagagagcaaatgtaacaagaaaaatgtttaaagagatagtattagacagtcttgcagattaggtgaaaaacataaatttagagatcaaagaagctcagtaaaccccaggcaagattaataaaaaggaaaccacacctgggcactgcataataaaacaactgaaaaccaaagataaaggaaaatcttgagagcagccagagtcataagacatattacatagattggaacaatagtacaaatgatcacttctcatcaggtacaaagtaggtcataaaatggtggaatgacatttttaaagtgctagaaaataaactatctatactcagaattctgtatccaaagaaaaatcctccaaaaatgaaggtgaaataagatattttcataaaaatgaaaatggagacaatttgttgtagtacatctctacagcaagaatttctgaaggaatttctttaggcttaaggagaaggacactggatgggaactcaatataatagagtggtgtggggtttattacaaacatagatgtaatatatgtaaaaatgtaagatttttgcaacaaatgctattgggatctcaagaattgtgagttctgccaacctattatcctgacaagaacgacaacaggatcattggtggcaattttaatggtgctttgtagttttcagagtttttaaagtgtatgttggtttattcttagagtcattctcacaggattatttgggagaggaatttagcagatgatgttgtgaaaatccacttgtaagagaatggaaaggaattggtggtgatgggtgtaggtagatcacatatgagagtgacagaaagtagctgagcacaggaaagtgcatgattttagttctagctactcagaaggctgaggcaggaggataacttgaggccaggagttcaaggccagcctaggcaacgtagtgagaccctcatctctttaaaacaaatcaaaactaaaaaaagagaaagtgatagcaggtggtggtggtggttttctatctgagaagtcctgctctgataacttggtgactcttatagggtagaaggagtggggatggaagggagaggaagatactgataaacccaatcctagtagaaacaatggctctagtaattttttctatagaatcatatatgcctacaggttctatagaatcatatttgcctatagattctgtaatcaaaactttcttgaaggagtcttgatgttaaaaattattctgctttaatgtatccaccgtggtctctaaacttttaaattgtgtatgtttatcagctaaaatgtttcaatattaccctatatatgcatcttttaaggcaacatattaataatataaagcatcctaaaaatagttcaagtggatgaaataacataactacagataaaataaaagtcaatatgtaaagttctagtatttttctcttgtatcccagcattgtattttgtactgtttgggtatggtgcctagtttgaagacccctgcagtgacaatcaagcgggatcattggagttattttgtttctgatcatctgtttatgcatttatgtatgaaatacacatatcattttacgccactggaataccatgtttttaaaaaaatcatagacattgttaaaattcaactttattttgttttttagcttttcccactttataatggtaccactctccttcacaaataagtagtattaataatgtggtggataacctgtgtttttcttctgtctatataattatctttaacttttttagtgcttaataaacaataaggatatagtatgttaatgtttctacaccttgattttctcacttaaaatacagcatagaagttcctccctagcattgacaggattcatttttagtggttatatagcactccattttgtaaatgtgctgatttattgaatgaatcttctgttaatgaatatttagtttctggtagtttttctttttgctgttataaacagtcatttaataaccatgttaaatatatatccttacatactagactattatttcttaaagaatgtgattagtaggtcaatgagtacatcagtttttgatttaactttttacagattggtttccaaagtctgttacaattcttgtttctattagggattccagagtatacttctcccccgactttatatccccatgacaatagttcttttaagaaaaattatttgctaattaattagcaaggtgagtgcaaatgtaatctcattatgattgccttttcctcagtactggtgcgggtgggcattgtttcatatatcacagtcatttagatttatttagtgaattgcttattcatgtcctttgtccattttcctattgggctttgttttatttgcattgaatcaccaatttgtcttgttatcactttgtgggaaacttctgtatcttatgccctaatttttcatgtgcattgcagatatttttcaaatgtattatttaactattaactttatggtgtctttttatatataaatgatttttttctgagacagagtctcactctgttgcccaggctaagtgcagtggtgcgatctcggctcactgcaacttctgcctcctgagttctagtgattcccctgcctcagcctcctgagcagcttggactacaggcgcatgccaccacacccagtgaattttgtattttttttttttaagtagagacggtgtttcacctgttggccaggctggtctcgaactcctgacctcaggtaatccgcccaccttggccttccaaagtgctgagattacaggtgtgagccaccgcgcctggcccacaaatgatttttactttataaagtcaatatattttttccgaaagtcaaacttgcattatttgcttagaaattccaatgcaaagtagggcaactagcctcagagcaaggctctcctggtatatatgggaactgtagaggcactaccttcaccatgttctctgaacagacctaccaagttgaggcttaaattgggtacatacccaactgaagtttggctatgagtcctgttgttctagtataagaagatttacttgttcagattttgcagcttctcatataattttgtacttgtgctccagacatattgaaataagccatatatttttttctccagatatattggctttaggggaaaaaaaccctccaacattttcagcagtgttagaggatcttgcaggtcctgtagggcagtagatattttgtttcagctggatcaagccctaaaaggggattggaacagatgtttgaatttggttaaatgctttcaatatttattacttaggtgacctagtttagcagcaattgtaatagaaaaaaaacaaggccatttgagaaaaacagagtttcttgcattcaccttaaaaattgaaagaattttccctttttatttagtttattttatttagcttgaatgtgggaaaataaaaccctgagagattctcttcctaatttgaacagatatctacttgtatattacatttaaaaaattttcccgtatgaaatatttttttggtgtgactggagaacagttttggagctacagttcttgatgtgctagttgaactctgaaagctggaggactatagagatatctcatagagtcctgtacttcataaatgaagagactgagacttagaggaatttggtaacatttgagttagggctctcagagattcagcggcacgggcagatggatgatttgagtttcccagatcctgtgtagtactgtttattcttcccctgtgttgagcaccatgtgccacgtggatgcctgtcctggagaagtaggtgcttgggtcctcctacccattggatttatccttgactctgtgggtgcctctcatagtgctttagtgtcaggaaggtgctggctagtaagagggaaaattgtgaacgaacagcttctctgacatcttcccactaccttttccattcttctaggcttaaaggtcacaagggggaatagataaaattagcatccgaaaccaaaatccatgactgtctcttgcttccattagggtgcgaggtggagagttcaataaaacaatcatgtaaatcaaccactacagcaatgcagtgggagaataatctggggagtgagcaaaattaggcaggagagttctcccaggtaagtggataaaggttatgtctgacatctggcaaactggatgttaattcctcacaatgcgataagaggagcatcactggagagcataacgtgttccggctacagagactgacagctcatgctgtggttcatgggaacagctaagtgaagagtgcgagagtgcaggaggagtaaaaatgaagttgataacatgtgggatagaagtatatacctagctgctactccagaattggcatctcaaatggttacctaaaaggggataaagacatatttgaaattggctgagatgaacaagacttgacactgtgtcatccagaaatatgaaggatgggggcagggggggcaagaaacccagcttctttttccctcattcactgtggtacctgactttttttttttcaaggaatctagggtataattgccttttttatgtagttttaaaaaatttttgtaaagtatatgtaatgtaaaacttgccatcttaaccattttcattgtacagttcatggaagtacatgcaccgtgctgtgcaaccatcactactttctgtttccagaacttttcatcaccccaaggagaaactctacctattaaacagtaattctctctctctctcccccaacccctggtgataacctctactctattttctgtctataaatctgcctatttcagagacctcatagaagtggaatcaaatcatacagcatttgtccttttatgtctgtcttatttcacttagcatgatgttttcaaggttcatctgtgttgtagcctgtgttagagtttcatttctttttaggattagataatattccattgcatggacaaaccacattttgtttgttctttgtcccaggacatttgggttgtaggttctgcctttttgctgttatgaataatgctgcagtgaacagtggaacataagtatgtttgagaccctgctttcagtgcttaggagaagaattgccaaattatatggtaattctgtgcttaatagctttttgaagagctgcaaaactgatttttcacagtgcttgtagggctaggttccttgactcttacaaactcattaggtattaaggagtgtgaacagctgaccctaggattgctgaatggggctttgcaaattctgagctcattgtttacaaataacttcaaaaaaaattttaagtgaagcttatatttaatgaaactttagaaagtaagctttgcttttttcttaagtatacacttaggcagtctttgaatagaaatctaatattatcagagggatgaaattctgtttttgttttgtcgttattggaagaggagtgaaagaattgaatatcaggtattgtgctagatattttcacccatcataaaaagaaatcactcatccttatcgtttctgcattaactttgtgaggcgatgttattacccttatatcactatgaaggagttgaggtaattcttcccttccttcccatgataagtggtagagctcaggtttggttcttagaattcagttaaaaagtctcgtgattggcatttccccaataggctaggagccttaattactcaactgtttacattttgaatttttttttggattgtattagttaggttttctctggcccttgttagtttagataaataggagatggctacaatttctttttaatttggttttagataagctctcctcagtaaccaaatgtagtagctcgttttttgagaaactcaggagtttagttattaacaatatctctttcaatggttgcttgttaaataacttactcagttcaaggttttgatgatttcggtgtactgtgcttttcagaatttttgaacacagttacctcatcctttgcagataggatatctgctttttttagcacgtagctttgacaattaaacatagaagagaagaggatatgtcttgtgtccaggcaacttgagtatagggccacctctctggcctaatggggcatccagaggacacatttggaggttgtgcagttttgatctcctccttctccagggtcgaaatttctgtgtgcctggcctcatcatctctgtaaacctgtctgtcattggctcttcattcatatctgttgtaatagtttggtgatagtagcccacgtttagagcgctagttttcaaccatggaactattgatatattgggccaggtactttttctgttggggtggggggctgttctgtgcattataggatacttagtgtcatccctggctttttcccagtagatgccaggctgccatctccaagtcttgacacttaaaaatgtctccagacattgccaagtgtccctgagaagcaaatacagcccctggttaagaaccactggtaaaggaagatttggaattacttggttgtgttgatcatgtttcttaatgaccattactaaaaatcgcttattttctatattttttccctcaaatatctaccttctttcattttaatttctcaatcccttttgtctctttcatctcatttagtcgaagacaatttttattggtctttctcttatattttcatttctcccattttcctgactttgtgtttgctcctttcattttacttttgctgtgtttttctggcatactctggttttcccatattctttactggcagtctgtatatgctgtttgtatgcactgtccgtatgcacagtctgtatgctgaatgcacagtctatatgttgtatgcactgtctgtaagctgtacgcattgtctgtatgcagtctgtatgctgtatgcactgtctgtatgcacaatctgtaatgctctgtatgcactgtctgtatgctgtatgcactgtgtatgcacagtctgtatgctgtattcattgtcggcatagtctgtatgctgtatgcactgtctgtatgcacagtctctatgttgtatacacagtctgtatgctgtatgcattgtctgtatgcatagtctgtatgttgtatgcactgtctgtatgcataatctgtatgctgtatgcactgtttgtatgcagattctctatgctgtgtgcactgtctgtatgcacaatctctatgttgtatacacagtctgtatgcatagtctgtatgctgtatgcactgtctgtatgcagtctctatgttgtatatatagtctgctgtatgcgctgtctgtatgcagtctctatgttgtatacagtctgtatgctgtatgcactgtatgcacagtctctatgttgtatacacagtctttatgccgtatgcattgtctgtatgcatagcctgtatgccgtatacattgtctgtacgcatagtctgtatgctgtatgcattgtctgtatgcatagtttgtatgctgtatgcaccatgtgtgtagtctgtatgctgtttgcattgtctgcatgtgcttccctttagtctcttcatcagcagcctgttacctcctaattctgttttggtctgataggtaattccatatggatggggtcatggaccataaatccttgtctccgtttacgtgtgtgtgtgtgtgtgtgtgtgtgtgtgtgtgtgtgtgtgagtgttatgctgccatgtggcatcttcctaatggtttgcttattctttgccattccctatgtgcatattgcccttgagcactctccagggggaagagattttctgcatcaaatcatagctgacactttaatttacttgaatgcccatcctgcttgttgagtagcattcacccatccttctcaacaacttgaaggcaggcagggtgcaattgatcacttgaattttgtggagaagaactggccctggcagcctgaaggtgacccctgcactttcctcctgaatccctgtttcctcttctgctttttcttactcctgattataaaactaaggaccctcaacacaggggaacgggttagattgtgttggactggacttctgtgggaaactttttgtggcctattgggggttcctttctgtgaggtccaaagcccttttcttaactggaaagggccttgtgttctgccagatcctcccaccctctctgcaggtcaaataatggatttagtagaaatatggaaaagtttagtctgtctgtgcgccaaaaattgccactaggaaggcagcagtgtaaacagtgtgtgactaattctttcttttaaggaaagcagttttatgcgattgtttccctgctgctaacaaagatacagaggtttcctcagattcaagtctttagatggccagccacaccccagcctctggcctgtttctcttgttctttcttttctgtgtgtcactagtatctccccatcacataatatgcagtcatattttggctcctaccattcctaacaccacgctattgatttctctggcccttgttggtttagattagtgaccttcaaccaaacccagcggcctttcctaatttcttattcctttggttttctgcagtaatttgcaggtggtcctctcctgcttcctcctagaaactttcttccacttaccatttttgaactgactcgatccttgtttttctcctcttctgactttttggcctcctatattctctttatgtccctaccattaagtgtgagtatcctccaagactgtgtggctccctgttgtttttcctgaaacatttttgcatttgaagatgttggcctctcctagaatgtcactattcctaaactcagaggcttttccctaacctctccttagagatccaccctgcatttctgtttctaaactaacataatcattcttgccctctcgagaatagagtggccctttcttctgacagacatgactcagcacgcctcattgcacttacttttcccctcggctttgaaccaaaaatatccttccagtgggcttgaaaccttcaagttgctggaatccttccctggctgtccccacccctttgctgatttgatcctcaagtcctgttagttcttcttatagttacctccattatggccccttctcgatttattcactttagatgttttctaaaatgtcttgctctagtagatgaagacttagcttatttacttcaccccctgtccaccagccttcctcccaaagtcatcataggcacactgggaaatactgagggttcacatccagaccatcccaagaaagtgagtatcccagtaaagcaagtcacatgaatattttggtttccaagtacatgtaaaagttatgtttacactataccttagtctattaagtgtgtaatagcattatgtctaaaaaacaatgtacattaattgtttaaaaattaatttcaatttttaaattaaaatgtaaaaataccttactgctcgaaaatgctaatgatcatctgagacttcaaatcatatgtgatcttctgctttttttttttttgagacagagtctcactctgttgcccaggctggagtgcattggcatgatcttggctcattgcaacctccacctcctgggttgaagtgattctcgtgcctcaagctcccaagtagctggggttacagatggcaccacacctggctaatttttgtatttttagtaaagatggggttttatcatgttggctaggctggtcttgaacttgcgacctcaggtgatccacccgcttcggcctcgcaaagtgctgggactacagacttgagcccagccccataatctttttgctggtagagagtcttgccttgatgttggtgtctgctgagtgatcaaggtggtgggtgctgaaggttggggtgactttggcagttttgtaaaataagacaacaatgaagtttgccacatcaattgacttttcctttcatgaaagatttctctgtggcatgcagtgctgtttgatagcattttacgcacaatagaactgcttccaaaatgaaagtcagtcctctcaaatcctgctgctgctttatcaactaagtttatgtaatattagaaatccctggttgtcatttcaacaatgttcacagcatcttcagtaggagcagattccatctcaagaaaccatgtttctttgctcatctgtaagaagcagttcttcatcccttcaagtctgatcatgagattatagcagtccagtcacttcttcaggctccacttgtaactttcattctcttgctgctatttccaccacatctgcagtgacttccactgaagtcttgaacttttgacctttgggtcatccatgagagttggaatcatcttcttacaaattcttattaatgttgatatttggacctcctcccatgaatcacaaatgttctaatggcatatagaatggcaaatcctttccagatgttttccaatttactttgcccagatccatcagaggaatcactatctatggcagctggagccttaagcaatgcatttcttagataggaagacttgaaagtcaaaatcactgctttatttatgggctacagaatggatgttgtgttagcaggcaccaaaaaagttaacttttttatacatctcattcagagctcttgggtgaccaggtggattgtcaatgagcagtactattttgaaaggaaatctttttcttttttttttttccctgaaaagtaggtcttaacagtagggttaaaatatttagtaaaccatgctgcaaacgcatgtgctgtcatccaggctatgttgttgtagagcacaggcagagtagatttagcataattctcaagagccctaggatttttggaatggtaaatgagcattggcttcaacttaaagtcatcagccaccaacgaaagtcagcctgtcctttgaagctttgaagtcaggcattgacttcttctcccttgcttgagttggggaaaacagttgtcttcatatataggctttcaattgagataacactgttcagccctacttctcattttcaccctttactttacttggcttaagtattccgaacctttgtgtggtcccctgtgacaactgcttcctctgtgtctgtactctttcagagtgactcctgaccagtgtacttgaactaccgggttgtaacccattagagaactcatgaagtcatgaaatacatgtagtggcttaagattatatgaaaagaatagcttagaagagaacacgtcagggtgccctgcacatcgtaagggtaaacactgtcttgtaaaatttgttttagttataccaaaacacagacatatatgtagatatgtattcgatctccatgtaaaatgtactttttactgtgggttgaggtgaaagaagttagaaaaatattttttaagaccatggcttgcttcaccctgttacaacagtcagggtttctcggtgcactttgaatctctttacagatttgttgaaatgtctcttgtgtgtttattaatggatgatatgaaacatatttattaagctgtgtagaacaggtctggatcaatcagaagggatgctggagcagagaccctgagttctccagctttgtcaaatgttaactctttataggattgaggagatgtcttagggggcccagtggatgggacagggagatccaccagtggaggggcactttgggcattgggatagtagctcttcatcagtacagagtatttaaatattttaaaccaccagtgtggctgtacgattgcataacagctagatatgaaccctggatttatatctttttaatttcttacctgtaactttaagggtatctttggaggaaggggaaatatatgggtgcccccgccaaccactttgaaccagaatccctgcagtttgtaatctaattttctcttcaaaagtttagtcccccactttgaaaaattacggttacattgctgtgactaatttgatgttcactggtgatagtaaagcttttttttctgagaggagggaagggaggaggaaatcccaatttaaatggagagagactttttcctgaaatactcggggtaacagaaggaaaggaagaagtaaagaggatatgtatttgtaagactgcaacgtggtctgaagtggaaataactgtgaataatgaaattagaggaaacagtggacaccaaccacgaaggagaaagtgaggaagagagtgtaggatagtgatttcatataatgcttgtaggatgagtaatgggacagtttcctctacttgcctcagcaggggtcctgtccgtggccttgcttctgtctctggggggctgtggggcagaggggcatcagcctgtggggtacctgtgcacgcacctcatggggggaagcgggagaaggtaagggagtgggggcagctgtgtgtagctccatatttgcaatgtgtttgtaacttgaggaatatgtagacagtggtggcacttaactactgatttccttaagttagtgatggctgagggctgttaacttaagttctagacctagtacagcttggttttacctagtttattacatttctgttacattcagggaaaaagggcccgtccacatgtatgctttcagctcgtttcttgtcctccgcttcctcaattcagaggggggacaagagacaacctcaagtagaaggcaaaccccatactcttacttttctggctgtggttggggcacgaattaggtgcagtagcccaaggtctcctggaaaactgggttttcctttcctgaataggagctagcctgtacatctctcagcgggtcagagtagcatggtgacagggtggcagcatggccggagggcaaattgcttccgagatgcggaggattcctctttccaagaggctgatagaagagacttgtggttcttatcagtcactaccagatgtgtccagctgtttcacttgctgctctatcccaaccaaacacacttaatgtcaaaacaacacttacatcatcaaaacaaaagtgttcacaatgttaagcctcaggcttttagtaatttagtcattagtctggtgacaaagggagtgcccttgtgtggtattgcatctgggaaaatccaggcccaaaatagattttccaggctttcctgagaccacagggtttaaaggggtagacccagattactgactaagagggaagcagcctaattctagcctcttctattcctttatctctcatgaatgccttttcccacagaatagctcatttaccagctccaatgagaatgaatctgatagagtgagactattcaagtttcttttactgcttttgatatgagacattgtacggtggtgttttgggtggcttgacaatttgccttttgcactgactgccatggcgtcatttcttccccttgttcagatagtcagtccctccttaggatcggtattttgggtcagattacattagagagcatgttcccttctaaaagctcagcttgctgcaaaactgcactgtcctaacaatttcagtagcaattttgcatattctggaattagttggtatatcttctttatatttttcattcctcttcctcagggaataactgaatctgggcagaggcttattttaaaatatgaattagatgcagtggaagagaattgtcacagaaaacaagggttgggccaggagggttagcacatagtaatcatgttcagaagttcccagaagtcttgactcgtgctattaaaaagataatgagagtataattataaaacatttaactcaaatagtacaatttatattattatgagacacagcataaaaaattgtttccctaaagcggcatcgtaatttatatttcaaaaggaaattaacattattatgtttttagtttgcatttgttcagatttttacagccacttttttctcagctcagtgtcgcagagattctgcagtacagattaggtaactgaggcttaaagagattaaccagctaacctttagcattaggcagcgttagaaggtcccactgtatcatacagctttaattgtttatgattgcttttgcttaactaatacaacatggggatttcttgcataattcccttcctgtactttcttcgctatttccccccttcccatttccagtgctgcacgcttactaaatatatacctgtctgtgtaaacatctttgtctttattccctttttagagatggggtctcactcttgtcatccaggccggagtacagtggtgcagtcatagttcactccagcctcaaactcctgggctcaagcgatcctcccatctcagcctcctgagtagctaggactacagtcatgcaccatcattttcttaaatataaatgccatgtttttgtgtgaaggcttatggcagttgtgctctgaatcctctgataaagttacctgtgatgacctatttatcatcacgcttcttaactagacaggcaggatctttttcgtgaaggacgcttctgagcgtaagccatcatttacctccttctatgtcatgagtggtcagcgacagtatttgaaggaaaaaaaatgagccttgcttggaattgatgctcctttctacatttaactcgttgcttaccctttccttattagctgacttttaaaagcccattatttaattccttctctttattttgtttcttcccagagtgactcctctttcttcccagagtgtggtgattcaccatggccagacccaggaatacgtgctcaagcccaagtactttccagcccagaaggggatttcaggagagcagtccactgaaggttctttccctttaagatatgtgcaggatcaagttgcggcaccttttcagcgtgagtatagtcttatcaaccattttcccaagttatggtatcagagattggaaacactttgttcagtgtagacggctttaatgtgtcacagtaaataaaattcaagagtcattaaaaaatccacattggttcctgaagcaaccagacagcagaaatttagcatggtttccttattctgaggaaaagcagtttttcctgggttttggaaatgaatccgaagtgacctgcctgtcattctgtttctgcaatatggcttcatgtctaagacatatttgctctaactttgggtccagtcatatgtctgacatgtttacattgatgcaatattttctttagtaagctagccaggactcatgccttgtgaaacgtctgaaatgtcctgcatagctctctgaggttctcctacagtggatatttttacattataagactcacctagtttttagtgtatcaagcagctggcgtggcagatttctctgaatttgtaaagcgctattgtatcagtggccagcttggttaatatctcgctatgtgggaagctcaaggacaaggcctggctcaaagggtggggaatgtgatgatttgtggtttaggtattacagagtgtctgccggcagcatctggagaaaacgttctggagtaaggcgcagcccatccaaaggcgagagctagacacacgctctcgttccagcagcttcctgccctgtcacatgttgactgattgcctgcaccataggtaatgaaagagaatgccagttgtgaggtgggaaaaggaccatctttcaccactgggaatagtatgaagagttgagatacagtttttactactgtttggcactagtgaagtccacatttgttgtggctttggttccctacacccactccacctccccgtttctgtactgaatctaaagtgattgactcttccctcagaattggtcatttaacaaaaagagtatctaacagcaggtttgtccatccactttttgtcttttgagaaagtcctgctcagtgaccggtggctagaccccagaacaatagtttggtatggtttattgggatgttgaggaaagtgagccctggggatcttagggaagaatacagaaaccatttagatcattaggaaaaaatcacttccaagtcatttgcaaaagaatagatgcatctatttgattcttaaaaatcctttgatattcgtacttaaagagccgtttctcttaagtgaatatttcttgagtatatgtgtaatatttttctaatactaattttaaaaattaaggaaaagatgtacttcttatttccttggggttttatacagatgacaatttttttaaaagatctcccaaatcagagtgtgatgggaagagagattttaaagtttatgattatactgataagagaagagaattctgaattatctggaggtatcaggaaaagatggttagagaacactggtattaagactagagactagactgtggttttgatttgttttctgtgatttgttattggaatgaaaattcccactgtgtgtgtatttccaccctcgtgtgtatatatgtattttaaactctcaaatcttggttgaactgtgttctgaaagatgaaattatatcttagaagaatgtgaagataagtttcttatctgttctgtccatatctttcccgctcatcctgtttaaatatattttctacatagtaaggagctagtaaaagaatgtagactaatatacattatcacagtggtggtgttctctgctcaaaccccctaaaagatggctgttgttcagaaagaagctcaggaattaactgaaagagttacgcatgtaggaaagacaagaagggagatgtggctatttttgctgaggccagagctctactgagagctggagggctagttggaaagtttttaaaagagataatttggcaggaccatgaaggatactgaaatggcaaaatggagtaagaaccacaaaagatgattaaaactggaaaggaggtacaggtagtaggagggacctaaacatactgtctctgcatactcctgttctgtggtaggtaaaagaggaggctccaaagaagccttacatggaacagaaaggaaggaacagttagtcagagaagtctgaggaaaagcagaagcttttatagcatcttcatttttatatttacagaagagatcaaatgcaaacattaattttttattgtgctgaaagatttgaaggtcaaacagaagctgatagctctgattctttagaaaaatagaagatactaagatcatttgagcatgatgtatcttggagtgaaattgaagaagtgaggtatgtcattgtagtccactgccattacttttgagaagctatgggaactagagaagcggttgaaaactagaggttggcaataacaagtgttatcttctccctttaaaagtgattaaaaagggggtctacagtaatgaccagttggtatgtttaatattgatatattacaagagcaataataataatgcataccttgagctctaagcactgtgcaactcttagctcataataggagacagtagtctacaagcccaagggaataaggatttgctctcgacacttggtaagagaaaaagaacaattgttttgaataagcaggaaagagatgaggatggaggtgatggatttagtagagtaaaatacattaatgtgtcaaacgcagcactctccagataaaacattgtagatagagagaaactaaccaagttgctagtgaggtgctttcttttgggagggatgactattttatgggattttcccacagttttgataatacaattcaccatccctgtccaatgtgtacacactacttttcctaatttgattctgtatatttaccagtcttcttagtcactttctaggtaacttgacatcctatgttgggtgttctctggtcattggtaaaggatatctcttttttttcccagcttcttttcaaagttcatccgtgttgtagcatgtatcagtatcttattcctttttatggctgagtaatactcccacattgtatagagatatgtatctcagtttgtttatccattcatcagttgatggacatttggggttgttcccactctcttggctattatgaataatggagtgcagtggcatgatctcagctcaccacaacctctgcctcccaggctcaagtgattctcctgcctcagccttctgggtagctgggattacaggtgtgtgccactactgcccagctagtttttgtatttttagtagagatagggtttcaccatgttggccaggctagtctcgaactcctgacctcaagtgatccgcccactttggccttgccaagtgctgggattacaggtgtgagccaccatgcccagccggtaaaggatatctctagtgataaattaataacttgtggtgttctgctttatttgttggccttaaaagaatttaatttgcatccgtatcatctagagtagggattggcaaacttttagggagtactttagactttgttagccaataggcaaatcaaggatcttaggtagatatttatatagctatttaacatgtatctattaaacgtgtaaatatccttcttacctctcaggttgtagatcaggtggctggatttggctcatgggctatagtttgccaattcttgatctagagactcacagtctctcaatccactgaaaacatctagatatcggacctgattgtttggtgcctggaacgtgacaaaagcagcccaagaggccctgcttctagcagctgtccttcattctcagtgtccccaccaacccaccctccagagcatgacaattctcggatacatttccacttagtttgaaggcacccagaaaagcatgaactaccaggaagctgcttgtgttagataagtctagtttcttttaattttagaataatgggccacacagcaattgggaaaggaatgggatgttactcctggttgcttatagaaaaccttttgatattggtggaaatatttttatgggatgaagcagtcccagccatatcacaacacagtatcacattaagatactgcatgagtttctcaaaaaagttaaatatagagttatcatataacccagcaattccacacctagctatatatccaaaagaattgaaaacatatgtttgcacaaaaacttgtacatgaatgttcatagcaacattatttgtaatagccaagagagtgggaacaaccccaaatgtccatcaactgatgaagggataaacaaacagatatatacacacacacacacacacacacacacacacacacacgtatacacaaatatatatacacacatatatgtacacacacacacacatatatatacacacacacacacaatgtaggagtattactcagccataaaaaggaataagattgatacatgctacaacatggatgaactgtgaaaacaagccaagtgaaagattccagacacaaaagaatccagactacatgctatatgagtccatttctataagatgtccagagtaggcaaatccacagacacggaaagaagattagcggttgccagggacaggggagagtgggaatagggaatagttatttataggtaagaggtttcttttggggtgatgaaaatgttctggaattaggtggtcatgctggttgcacaacctgaaaacactaaaaataaaaaaactgaattatacacttaagggtgaattctgtggcatgtgaatcatatctcaatttaaaataacaaatatttatgaaaaattattgccaagtaggtagttatgagactcagtttcagctccaaggaattgagctcataagctctcagaagtctagggatggtgtggggtaggggtgggggtctgctttatacagtgttttcattggtgacttgtaggaaagaattcagcatgtaaaccaaattctattgtgtttagtttagtaattttttttaacccagaggaagaaaatggaaatgacataacatttggaagaccatcttataaaaatggtcagtcaagattagaatagcacatgttcaggagcaaacccaagtaactcagacaaaaagagattagtttgacataacctgctagaaaaagtccttgagggtataataagtgtctacatcatactatgtgctgacgtagtaaaaatgatatggaatgctttataatattaaagccagcaaataatattttaagtacagtctatggtggaaagaggtgtatttatcatcagggttataagacaccaaaggacttactaagatagattgtagagctacttataaaggagatctttaggatgagcagcaatggccatgtaactgacatggttccctagacgactggtttccagactgtgcaaagaagaactaaaagattagcgaagctccaatttaagcatttgcctccttagtccctttttctactacataactttaatatttggaacgatttagaaatctgaacttctctaaattggatttctcattgctaattccagttgtcgttctctcaagatgggcttaggttttaaataggttacttatatttcaaagtcatctaaagttttagttctttaaattcaacaaggcagaaattttacgttttaggcatggcagatgtcatgttttatacagtaacttcttaaaggtctttaaacagatatagctctggctcttaaaaaaatgtaccaatttatctcctgatgtgctaacgtgggggagaaagagagagagaaatgactggcatttgcaaacacataatactgttaaattgcaaaaaaagaaaagtaaggacaagcccactgtttacttaaagtgtaaacaatttcaggaaaggcagatgtcatgttttatatggtaacttcttaaaaatctttaaacagatataactcaggctcttaaaaaaattgtctagttgtcatctgatgtactaacatgggggagagagagagagaaatgactggcatttccaaacacacagtaccattaaattgcaaaaaaaaaaaaggaaaggaaaagtgaggtcaagcccactttttacttaaagtgttaaacctaaccttttttgtttaaataagcaaccgtagaagtgaagaagcacgcacagggtccctattaagtgacttctgacagaagaaaatgtaattcccacctgcagtggcaccacaggagacatcttagccctgagttctggtctgtgctgccctctctcagtctttgcaacaggctggggcagcttgactcccagccatcaatcacgggctgactgaaatctggcacctccatttgcagatagaacagctccccaggtctcctgagctctggtctgagacagatgtagagtctgttgttttcatagtagcagctttgtggcctgaactcctgaatcccagttctggcctgatcgcagtccatagttccacactaagagaagtacggctgctttggacacacgaggcctcttctttctaacttttattaatactatggttgaatgtcttgcttgtagcgttagccttcaggcttcagttcaggctgacatcgagaagcacggcaagtcacggaaacatctcagggtttgatggtaaatgcttatgtctccccttgaaaaaggaagttcacatgtctggagcgaagagtctttacggttgcagtctgataccacaaagaggttacccgtaagattgtctgggtcttcctggttgccctgagtgagagagcagagtgctttggcagagacttacaagagacattcaagatttttgctctgtcaaaacaaagctgaatgttaggagataggcaatatttaacacggacaggtctgcttatgccagccacttcagggaggtgggcaagaacgttgcttaaaggctctggatgcctagtgccagttacagaatgctcatgggaggtgtccctggcgtagttgagagcacccattatgggatggatgctgcaaaagacgggaaaatccttggggtggcaactggataaaggcagatatagtaagtgtagatgaggggaattggagcaacattcttacacatgggatgaattgcaatctggagatcttcagaggaggagccatttgaaaatgctgttgaggaagagtctggtcctgagaactgttgtggccttaatgtcgatgttgaagtttaggatatggatggtatcacactcatgtgaagagagaacagaagcagcagcaggagaaatccagggtttgggcagctctgctcctctgagacatcctcgctgataggtcctgacagattgggagccttacagggcagagctttgcagatggaccaagtgggtccatgggagagaagacttccagagaacatgtttgcagcattgaaagccctccctacatggagactacctttaacttgtgtgcaaaaaaaaaaaaacaaaaaaaaaacaacaaaaaaaactgtctttgggattggcttacaccaacccagtgggtactaaaaggcagtggaagttggaccagccatgaatgaccttacaagagctgatgaaaaccagcaaaaactgcttaagcatttaagaggaatattaggtgtgaaaacaaactgttttaaagaaggaataatgataaagctttgtgctttttccttgcaaaatcagcgagttccttaagctccttgtcccatgctcaattctgtatgggaatcgggaaccttgagccagtttcccaactgtatgatcatgtggatgttagtactaaagattcctgaaagaaaggcgtctgcttttcaatgatttctggcaaagtttttggtttgaaagcctagacagtaaaactacattataaccatgtacagactgacacctgagaaggcattctggtgaatgtggatgaacagggttctgctgagctggtatccttgggaatccagatttcattcaaggacaggatatgatctattgcaaagaaaagttcatgagcagtcttgccatgcacgttatcctgggttagggcgtggaggggaggatggtatatctgagagctatttgataacattccagttcagggaagccgtacgaacatgattattctctttgccccctgataggccacacgaagtttaagatagctgtgaaacagtagatatggattggttataaatatttccaagaaacttacccagcaatatgaaaacagcaaagaagaaaaaccttctagggtgaaggatcatgtagtttaaattcctcgatgagcagccttcactaccagataaaggttttagttataagggcccaagagtttataagaaacaagcaaattcaaggacatttctgggtgttgagactgattttaagaaatcaatactgtatggctccagaatattctggagtcagactgattttttttttccctagggaaaggtaatacaaatgaatttattgtttgcatgtggggaaactgtaaagcaaagaaaaagaaaagagatggtgcctcctcagccttaggatacctttgccagaaattgagggttttagttgattttacttctggattgggaaagaattttgaggaaattaatcattattagaacagaaatggtagctttgattcaaaataaaataggcccacgcaaaatactgctcatgagatgtttcccagggacttaaagtagaatgctttgtcttctcatgaattagattccttatagaagagtccccttaatgttgaaaatgactgcattggagtaagtccatccccactttgacataaggatccataaatacctttctttctttcttttatttttgagatggagtctcgcactgtcacccaggctggagtggagtggtgcgatcttggcttactgcaagctccgcctcccgggttcatgccattcttctgcctcagcttcccgagtaggctgggactacaggcgcctgccaccacgcctggctaatttttttgtatttttagtagaggcggggtttcaccatattagccaggatggtcttgatctcccgacctcgtgatcctcccgccttggcctcccaaagtgctgggattatagacgagagcactgcgcctggcctgtaaatacctttcttatattttatatgtgacatttcttaaaaagggctttgtgttattttctgtgattttagttctgcattgtttgtttttgaatatctcctgaatattaaccctactctggctgccctaatttcttttcattcccatacaaaggaagtagaagttaatacatgactggagaacaactttctttcctaagaggtagttgcagtatggttatattaattcttctgacaagcaaactttaaatcaagaaatacgtacatgtatatatgtatgatggctgtgtgtatatatacacacatatattcaatcaagtatatatgtgtgtatttttttaacttttaggtttaggggtacatgtgaaagtttgttacataggtaaacacgtgtcacggggtttcgttgtacagattatttcatcacccaggtattaagcccagtaccgtagttatcttttctgcccttctccctccttttaccctcccacttaaagtagaccccagggtctgttgttcccttctttgtgttcataagttcttatcatttagctcccacttacaagtgtgagaacatgtggtattcggttttctgttcctgcatagtttgctaaggataatagcctccagctccatatatgtttctgcagaagacatgatctcattcttttttatggctgcatagtatttcatggcatatatgtaccatattttctttatccagtctgttattgatgagcatttagggtgattccatgtctttgctatcgtgaatagtgctgcaatgaacattcattcacgtgcatgtgtctttaaggtagaacgatttatattcctctgggtatatatccagtaatgggattgctgggttgaatggtagttctgcttttagctctttgaggaattgccaaactgctttccacaatgattgaactaatttatactcccaccagcagtgttgtatgtgtattttttaaagtaatttttttcgcaattaaacatcatctttattaagcaaagtactatgctattaaaagactacaaaacttcattagtacgtggttgactactcagacttacatgcagtttcttaatatttagcatggtatgcaagtcaggaaaaataattcccaaatctctccctgagtaaatataattcgcatggagctaactttggtgattatcatcgttatttctcattagatccactttctgaccacttaaatacattttcctttagttctgttggaaaactttctaattagtctgattttcttcagtggaaataaattttgtaaagtcttttttttttttttttttttttttagtttcttacattatccatacaggaagatccattaagaaaaagtcttgtagcccaaactgcacttcacaagtttgcttttccaaggttctagctttttttcttactgaatgaaaatattttaaatatgcagtgttttgtgaaaaacatcataattacttgtaagtccttgtatcctataaacagatttagaaagctttggcgagagaaagaaaagcatccggagagcaggtgaaagggcggtggtcgttcctgtgttgatggtatctgggcttcttgtgtgggattgagtgctcttccctaacgaggcctggaagcacaggcacccaccagctgggctccttgtttaaccaacaccccttaatggctacaggtgcatctcatgagtgcaactgcttcactcagatccagcagaaaccaagagctcttcctcccacgctttcagcttacattccatggaggagctggctggagcgcgcatctgctttactttagaaggttacggcgtaatcctcccccaaacaaaatcttttgatttatatttttgcctttattcgtcagtcaaaaatactgtactgaccttttgtgattcggttaggtacatgctttctggtccaaagagtttttttttgttgttgttttggttttggtaactgtagaaatttaatgaaaagcactttcgttagtctttataggagagagaaggtggtggatatagttttgttaagaatgattctctcaccaatttgactttctcccctaacattttattcatccgagaataaataataaacatggtaaatcgtataatatatgcatagttctttctagttcttccccccaccctgcccccctccacacacacatcttgtcatggcttcctgtgggtatagtggattttgcgtgtccccttgactctgggcttggccatgtgacttgctttgaccaatcgagtgtgggtggaacgagtctatgggttcggagcgggagcttcgttcgagaggaattgcgtatttcctctcttccttcttctaccatgaaaaaggcaatgcctctggtctgctgacctgccaactcccttgaaatgtgttgtttttcctagattaccatttcagcagggcagatttactttttaaaacaatctggacaaatcaatcattagtcttagaacagatgataactattgtaatcagacaggttaccttttggtaaaagtgatactatgggtgacctcaccttctggccacagtggactggaaagcgggtgggcagttgactcaaaaccaatctgaggctggccagctgcctgtaaggtggcctggcagaggcactttcccaaacagggatgatgttgacgaaattagattaatcagaatctctcttaaggaattcctaagttagaattgaacagtaagtatctggaacagacgtataataccaaaaagaaacagaagtagccaatcctaccacgttaatgttgggtacaagaatgaagttcaacagcatttctgaaggggagtagggatggggcagcatatagtggggttgctacaagtgctgtggattctgaacatcttttcagttactgaactgtgtcttagcctccatgaggtttggcttatatggccagctggttctgcgttctgggttctcttgagacgtctatctccttcttgctgtacacaaccgcagttgaacatcctgttgcttgagataatgtgcacccccttgttttgtaggcaagagacctcagctaatacaagttctatttctactctgctctctaacagctgcatgtcctgattacacaaagcaccaaagcttgacttctagagagggaaaacccagctgctcaacttttcctcactctctttatagcttttcctcactccctttatagctcttagtcctgtccacattccctctttccacatagaaagaggagtgggtgggtcagttccatcagttccctgagacccctgcaacacttggagaattgttctgcctggcctgcgggttactaggacctgatggtattgctgtattcatgtctaagcttccactggaatttttaacagaaacattctcaggtctgggggattcttgcccacatggaatggagaatgttcaccttcagtcagtgagtgtggattgggaaaccttttcagtaagattcctggaatcctatcatgcctcctgttcattcatcttttttttttttggtatgggttttctggcaaccacaatgcagtatgtgtgtaagtacatagcaggcatgctctgccatgtcttgaacatggaaatctagcaaaattagatgcctctctttgaaagggtttttcaaagactattaatggagaaagtgattcatggtgtttcttgtcagagatcccagtttccaaaccacatcttaatataccttaagaacatatactctgagcaagaaaatacaaacagatgtgctgaaggcattgtgaattgtattcttgttatcaaagatcaggtagttaggaaatttggacataggcttctttgtcccagcaaagacatgaggtaagttccaccctcctcctcctcatctatttagcactttctgcatgccaaccatggtactaagcactttatatgcattaattaagtatgttacattataatacttgtatattacttgattactacttaaaatgcattccttaagttaggaaccaaaaattgaatttaaaattacagaaatcaatcttattcattgaaaaaaagtaccactttagctctttgtgtaagttatctttaggcaagtgcaaagtcaagatttgactatattttagatattttaaaattgtattatattttagacttttaacacaataacatgttttaaaaatttgttatgtgactatagagctgctaacaagaggtgtttagcttaacaaaaattactcaaatgcggccaggtacggtggctcacgcctgtaatccaggcactttaggaggccaaggcgggcagatcacttcaggtcaggagttcaagaccagcctggctgacatggtgaaacccccgtctctactaaaaatacaaaaattagccgggcatggtgctacatgtctgtaatcccagctacttgggaggctgaggcaggagaatcacttgaacccagaaggcggaggttgcagtgagccaagattgtgccactgcactccagcttgggtgatagaacaagactccgtctcaaaaaaaaaaaaattattcaaatgcagagtaaacctttctaatcagtgggttcctacagctggttgatgttcattatgatacctgtcaaacaaagtcaaacaatcaggttgtatgtggaaattatggtggaaccaaagtccacagtagaatcttgctttattctagagtctttaataatagttatgatctgaaagcaaacatcttaagatgagaattttcctagatttagaagtggttatagattttgctgtgtagtatatcatggtttaaatgtcactactggtttgagcttttctaacagttgctccagttaaaactgaccatgtgtaagtattttttctttgatttgcatagagttttacagcctataaattatatccatacaaattatttcacatggcccctgccacagtcttgtgaggtagataggttggatggcgttattctgagtgtgtttttaggcgctctggatttcaacatcctaaagggtagaacctgtgggtggttttgtattctttccctttgaacttcttattatcagtttctttgtcttccagataaagatcttaagacttgttctgtaggagtgttgtgagaatgaagtgagatgaagtctatataagatatctcgcatactgcagaacacatcacataggtgctcaatctatgcttgtttctctctccctcatcctaatttcccaagcgtatagcattcacattcctaagtgtcatatatttttcatagtaatgctcattacaagtgtaggagaggcattggggcgtatcgaggaaagaaagaacaagggcttgcattaaaatcccagcttcactgttccctagcagaatgaccgtggtcaagcttctggtgaacatctctggtttccttgctggcagaatggatatgactgcagcttacatgattgtcatgtgtatttgctctctgcagcctagtaggcactcagtccttgtctctcgagtctgccattcatgtatacggtgcttttgtgcatttagtatcgtccataatttctgttgttctcagaatttgggccaaaaaaaagcagaagggaagaagaacatgttatgtgtgtgtatgtttatgttagttatcagttgctgcataaaaaattactccaaactggccgggcacggtggctcacgcttgtaatcccaggactttgggaggctgaggcgggtggatcacgaggtcaggacttcgagaccagcctggccaatgtagtgaaaccccatctctactaaaaatacaaaaattagctgggcgtggtgcaggtgcctgtagtcccagctgctcgggaggctgaggcaggagaatcagttgaacccgggaggtggaggttgcagtgagccgagatggtgctactgcactccagcctgggcaacagagcaagactccgtctcaaaaaaaaaaaaaaaattactccaaactgtagtgatttaaagccacaaacattaccttagagtttctgtggttcaggaatttagagggacctcagttggttggttctggctcagtttctttcatgaaattgcaaccagggtatcagtaagagctgcagttatctgaaggcttgactgggcctagaagatactttcaaggtggttcactcatgtgactgttggcaggagatttcagttctttgccccatgagtgagtgtctccttagactgcttgagtattcccgtagcatgggagttggcttccccgagagtgagtgatccaacagagacagaccacgacagaagccacagtgtcttttatgatgtagtctctgaagttgcaaagcatcattccatttttttctgttatttatttattttttagaaacagggtcttgctatattgccagggttagtctcgatctcctgaactcaagcaatcctccccctcagcctcccaaagtgcagggattacaggcattagccaccatatctggtttgttcttagacaagattcacaaaaaccagcccatgtccaaggggagattagacttttagatttcacctcttaaagatagaagtatcagggaatttgtggacatattttaaaaccatcacagtgttcaacagaaggggcactcttttgatgagagtcaaaggaaatgaggaagctgaaaatgggcaacctaaaaagaattagctgacagctggaaaacttagagtgtacaactatacatcagtaatttttttattggcaactaattgtttttcaattttatttatcacataatattggagcatagctagctatatatgatgattttgggaaaaggatattgaggctgaaatctttcctaatgatgagatctattgagtttggccgtagtcccatagggggagtagttggggccattggatgcagtcatttaaaaactgagccagagagaagtttgtattggaaaaaaaaaatgaagtaaatgacagaatcagtattctgcaagcttggattctctgagactctaattttaaattaatttagagattttaaaatgccaattttctatacaactaagtgcttcaacagatttttgtctccattgaatccatgaaacttgagagttgttttggccattgcaaaaatgttcatatctttgacttccttggtgcttcttaaaatataatgcattcaagttataattttatttttgtttgctctggatttttattgcttgtgtgaaagaattggaatcccttagaggcacatcaagacatctacttctggcctggcagctccagtgactcagaatgtgtgttcagagcccaggaggttttggttttcttctctgccttgtcttttgactctttttttttcttttatgcagaatttaaatttcgtgaagtgtaataagtcatttccttcactatgtctgcctcggtgtcggaagaaaattcccaagccctctttatgaagatggtagaagcctgaggcattcaactcctttaaagttttgtgacttccagctatcagttgtttgagtaaaagtcatttctctgcctttcacattgtctgcccttcctgttgctttcccttcccattgtccatcttcccatggattctcagcctcagttcataccaggcctcttcatttccaacccccgtattccattcccatgacactcccctcttaccacattctctcttccagtcctaaaaagagaatcaccaggtgggacatttgttatagatagaaaaggaggataagaatatagactattttctttggcctgactgaggccaaaggaaggtgggaaaagtggagaaatatccatagacgtgtctgcaaagagtcaagagacaatggagggttgaaacatttggttgtgcctaggtcagtgaaaatcatggagggaaggagtattttagttgagtcaaaagggtggaatgtggggaagaagaggaaaaggtttttagggaaaggaaactgcatgagtgaggtgtctgagtggggacctgtggacagcgtggcttggctcaggccctggctttacatggagatgtggtgggaggcgaggctaggttggacctaggtaggaaaggggcttactttcccttaagggagtttgattttgtcagaaatatttgtcataacaatgatataggatcctaattttcaaagtgtgtggtagagataatttgggaccctcgagaggaatggccccctgtttagcttgtgagtaagccatcaaatgtgttccttggtaaacaaatagcccagtagatatctatcatttagtcagacatgcttctccacatacagataggtgttatttatagaaatggtcaaatgcctccatttacttgctctttgaaagacaacaaatgtggggataaataaaacctaactgtgttccaaaattaagggacagaaaatttgagtcatgtgaagcatatgtaacccactgtggttataaagagcctatgcaaattaggcagattgcatgcgtagtagagatggaagacaggtaagtgtgttgattgctctgctccttattctgtttacagagagcagtgaagtcagtcttcttgtcagttgcacatctgcacatccgggtcctccagccacatggccatggtgtggaatttaaagctgtgctgctgcgaagactggcatagaatctttgagggaggtagctatttttcatttctgaaaaaatgtatcttttaaatggctttcccccttgggagacagactcttagagtaacatcttgaactgtgatgcccttcactctctctagttcccaaaaacccagggcaaactcattgaaccctcaacaagtatggctcccatgattgtcaggattctagattgtggctgtggattacattctcaattcagaattaggagattgggtacattgagctcttgctccccctttcttttttcctcctttttatgaacggattcaagacctttcttcttggaggatgtgtttcttcaactctcagtcacagcatttcaaatactactatcccttctggatggggcaatgctggtaggttctcttaacattcagaattaggaacagagaagggattgccagatgtgttctagatgagggatttccagatgtgttctagacaggtgagttttaaaagtcattttgaaagagacacctggaacagcctggaacagagacacctggaaggagacacctggaacagcctggtatggttctggagccaatgatggggaaaaaaaagtacagttggtaataaaagtggagaacgagcaaaaacaaatccatggctttttgacatgttcatggtctgtccttttttgtaaaatatttttctttaacattatagatcctgaaggggttcaactgtccaggcatacttcttcagtttagggatgcggaacacccagaaaagttcaggacaggctccggactgcagtccagggcagaggcgacagcacttgctgtcggcattccagtaaccagaggcagcaacagggcacacacctcagttctagtggacccagaaccacaccagactgtcccacggtgtctctttcaaaaattaaatatcttacacagattttatctataaagttagaagtttccatcatgtgtcaagatgattcttgcataatatgttgtgaaattttagtagcaagtaattttctgtttttcttttcaaaagtacttgagaaattgctatttcctattgcttattcagttattctctttaacatatttaattaaaaatggttttacttttaaaaaatattattggctattttttcgggtaaatttttaggggaaaaatgtcttttgtaaagatggcaaggtttccaacccgtaatgacttatgctttttcttgatctgagacttagatttctatcactgttgtagcaattgtttctctctgcctctttctttagttactcctgcctcagtaactcaagagatggagctgaaagattactctggattcttacctgtggaactgcccacatcagtactagtgatctcatctgagtttccttcttggagggttttccaggactggggctgcctggtgaagtaatagatttgatattaatttttatttacatagcacctttcttgaggaacacagagcagtctatgggcattattttaatagtccaggaggagttaagcaagcctggagagctgaacaataaagtcctgttattctaagcattatttaatatttttatgatttgtccttcaaagaattcttggccttcgggtaagcgatggactgcaagtgggagaatgaactgttagctcagtctctctcacaccctgaagagtgtacacgtgacttgtgtattgaatcagcctgtaggtctctttaaaccgggtggtggctttaaaccacagagaggttgcttcttcccagaggatattgcctgtgctggttggtccccattgtttaagttggatgcacgctaatgtgctgttgcggcattctggacgaatgctgaggagactgtatttgttcatgacatctgatgtgagtcttgaacttgttacatttatttctctgcttttggtcacatcttggtctgatgaccaaacaaggcaactgtgcccttttctagactgatgtctgtttgtcaagcacagttttcacatttttatatttttctctattgttaacaaccccgaagcagaaatgaaagctttttatcacgggaggaggggtatcggcttcacttccatcccattcaccattcactctgaatatctgtggtttgttttaaaccgagtgccagtgcctcttcttggaggtataaatttgcacagggtctggcagacgctgcagacaggatgttgactcttgagtgtcttgactgactaggaggcccaatggcggtgctgcatggctccaggcaatctgtgcctctagccaaggcctccaaaacccaaagttttaaagtgcttgcttaagattttgggggctgattcacctaaagggatctaaaaattgcattttttttcctccaaaggaccaagcacagaagttgtgccagtggtttccctgttaactcctgactggcctgatttttgcttctcagacttataattcctaatcacctggtaggtgccactcgggatggtcttctgcctctggttagtcctgagcttgttttctcactggtgcagcaggaccttagaccaaaatgacctccagcatcctgtgagtcttggatctctgtgggatccgacagtcacccttgccccatgcttcgggttactttgtctattccacaattattgggtgcctactctctgcaaggcatcaggagtccttgaatattaccttattcaagacatgcaaagaagatgcttctgatagaccaaatggcttttgcgggagagcttgtgtctactgttagtgaattcctactaaattcttgaaaggtgagtggtattgccttcagcgtgtcacatgtgaggaatttgaagctcagagcatggatctctgtttgatgaactttaaaacttaaactttttacactataccctaaatatgtgggaatgattttcaaggagtagagatgggagaacatattttctaatccatccagcatttatggagatcctgttagagctctggataataatctagtgtcaaaagcagtagtgcattttcactaccaattttgagaagattggcatgaaaacctaaagctaattataatgaagaagtaagtgcttcatggagatgggaggacccgcttagaatacaagtgtctgttttagaattagattactttatagcagaatgcttgtaaaacacaagcatttttatttttatatgaaataaaatatagcttctgcttccaagaagatgtgaacattgtaaaaatcagaattaagtcatatgaaactgtctctgccttttgaaaatccagatgattccaagccaaaagaaatttttttttggcaaagaaatataagaagtttttaataacaataggcccggagaatctccagtgcttataaagtgactactgtagctgggaggtgaaatgggaataatgattaagtgcttgctttctttggatgtctcagtttgcctaagtgagcataatttaggtgactgtgtgagcatctgtgtggcagctgctggtgctacaagttaatgccagagaagacaaaatagttggcacacggattctaatttcatgattgtaccaggagccagaaaaaggaggagtttatattcttttgaagtgggaaaatgttgtctctttttttcttgggtttcacacacttgaacacacaaagtatcctcaagatatttgtaagcattttccgacaacttagattataagctgatttgtttgtgctactgtgaaaaagcaaatcaaactaggtgaattttctctgctggtgaaatcaggattctgttgttttttttgaatttctaaggtagactcccagataactttaaaatgtcctgtaagcatttaaaggaggggttactgaagtgtttaagtaaagtttgattggaacacagccatgcccactcatttacatattgtttttgacaggctgctttccagctaagcgggtccacagagttgaataggaatagagtccttttcgcctacaatcctaatatagttacaatttggccctttgtagaaaaagtttgctagccctcgatttaaagtattgactgatagtagcatcctattggatgtcattttgcaaggtgccagaaggtctgcttggccactaggacatcttgccatttcagacaacatgtcttgatcctccagggttagaaccaccggtgaaggagaaactgtcctggaaaaccatttgaaaagaatggagggctttctcctccagaggaataatttttcttcttctaagtgagatgaccaacccagctgatgggttcaagtcctaattttagctttctttgattaagtggcatttatctcaaagataacttatttgaagggctgtcatgtggaagaggcattagattgtgaggccatggggaaccaaattaggattaatgtgtgcaagttactgtgaggccagatttcagctcaataaaaaatagtacttgctgggaactgccataactatcatgtgcttttgtgggtaatgagctgcccgtcactagagattttcaagtaaaggttacacgaccacttgatacgtggaatgcaaacagtggatgagagatggttgcgttagaaaacctctggggccccattccaaccctgaaattggaatggcttctttggttaaagttctttgtttccaagctcagcttatgaccacagttttaatttgttgagggtcttatagaggcatcttgggatgattttctgaaaatataatattagccaaaccaaagcagtataaagagagacaagcttttctggtgggcaaagatggtataaaaaaggctggcccagagcctctctcccctttggccactccagtcatggagtggcgtcagaagggcactgcttcttgacggccttaaagcctgacagatgactggctgtcttcagctactgctaccatctttgctttctgcctagtctcctggaaagaggaaggacctggctaggggcctatcgcagatgtagcaatcaaaacagtgtgtgtcttgcaatttgccagagagttcaggttgcgatccagcagtgaagggcaggtctgggtgaagcagaactgcacagagacagtgcagttctgccgtcatagcacaaaagcagccatagacagtacagaaatgaatgagggtggctgtgttccagtaaagctttatttacaaaagcaggcagcaagctggattgggtccctgaactgtagcttgctgacctctgatagagacgttgaaagttagaagtgtgtagaaaatgccagtttcaattctctcaagttttggaaaaactgaactgaactggactgaaatggcatgtccggagtcacaccgtggttgagctgggattgtaaaccaggatatacttttagtctagggcttattttgtgataccacatagcctcggctgtgtggtcaggtgatagcatttcgtttttaagagaaggccacgctaatgaaagaaagctccatccccagtggctactccaggtggtctatgaatagagacagtgagagcccaagggtgttatttttagggaggcaaccatttatccctgtgacctggcttacccctttaaagatgggccccgttcacaggaaaacaaaatatatgttgcctaaattcttatggagaaatagtgccctggagttgtgaaaaagaaatgggctcccgcagctgcgtcacagcatttgatcacttcagccgagagtgccaggagatttgagacagatgttttcagacatgccgcatgcctaaaacatttccaggggtcgggctgcaaatagtgacttaataagtggagaaacagggaaagtatgcaagttgaggacacaagagtttattcaccgctaggtgcacggccaacccctttgcattacatctgcctgtcagggttggctctttaatctgtcgtgccctcggtattgctctttgtctgcccgtgaataaagtgcagcattgtggttagtaatcccactccagtgactcgacttcaaatgtggttttggagtgcatcccagagttctgtttgctaagcttcctactcctgtttcagagacaccactgaatacagagcagcgagcactgaaggcttccctctttccttaaacctgtcgggttgtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtgggtgagttcctccacggtccctaactgtccttactgagtcgagttttatgagattgtagcatttagacaccccctccattcacactgctgtctgcttcaatgggtgtctgtctatgagtacgagtatgtttctttcatgggatcttttaaattgcttttggaataatttttaacctgattcttggtttcttaggggaatggcaactagaatattttcccttattgcttagcatttacacagccatgtggtaatgggaatatatatagtagaagagaagagagtaggttttagatttagaccctaaggcatgacttgtgctgataagcttcaaattttatcagcccagtgataagtggaatttgtcttagatttgactcatgtaataaattttggaaggtggtgatgaaatttgaagtttttacttcaaaaatagccaagctctaaaacaaaactccgaggattgtcaaaaacctgtacttggttgtagaaaaggatacagagttgcatcttttgccacgtttctgctccgtctcacaagactgaatataaattgatatataacgtggatttggggaagacagactggtagattactctcagtactccttttttacgtggatttggggaagacagactggtagattactctcagtactcctttaagttaatttaaatatgaagtagtagttgctgtctgcaagaaagccttgttggttcattttgaatttttgttttttacttttttgcaaatggagaaaggattgtggtccacggaatgctgtcatgttgccatgttgtcatgcaatacagtatttttgtcgcagaaaaatgtcttttattattttttgaccaattatggtttgccatgtgtactcaaataatcgcagacacccacgttactttctgagttactcacaagaataacccaaatgtcagacagataataacactggctagatctggtctttttatggaatattgctgtttagtcttggaagtgtgtgtctgggggggtggtaggagaaggggtgtctgtgtcaaactgatttacatcaagacaaaataaagggacagcttgaagttcttattagatctttgattattctgctgttttattgtgactcccaatccttaggaggtcaaagcatatttttgatcgtctgtacttggaaaaaatatgtgcccatagatacgatttaaaagggcattgtgagtttcctggctatgataggggtactctgggcatagtttttaaaagaatttagccattaggtgccaaatggcacattatgctttgcagggcagggagccaagtctaatgggaagtgaactgatgatcaggaaactggattctggtcccggtcctgccactaactagctaatccgtagggcatgccagttaatatttctgggcctcagtttttctcattcataaaataaatgggattgtatttaatgacctctaaaatttagtccatctctaagatcatatgactttttatcagcaataagtaatactattttctggcttaaaaaaatttttttttttggagggccacagacaaggaggggaaaagaaaaggcaattccagtagactatcatgagtctgatggcttttcaccactttatctttcttggttgccttccttactcactgctcctttccctccttgtgtttattgtaaatctttacagtagcaatgacaaaataatcaaatgggtggtaattttttggcttccagtgtattcattttgaaactaaatattttgaaggctttgagaaacagaggaagtctacttgttgaaacacaccacacactttccttgctggcactgaaccagatgtttaggaacagaatatacatagcctactcaaaatgcaaaatgaagcaaaattatttacaaaagcatttcaaaagcagaactccactctccatataggatcggcagagcagtttaattttttgaaaagtagaggatggggtgagaaggacccatagtaataaatagtttcacattggaaattgtgggaaacatttcatttatattctgagctatttccctctcctgtttaacgttttatttcaaatattggatagtttgagggacaatttttatgatatttctttctttaagaatggtaattttatagaacttatagactgtgatcctttgaaaatacagaaaaattcaaaaacgtttatgcatatatctttttgggactttactggtttagtgtaattttattatttgcaaaaagtgattttctgatttttttcttctctctttgtacttgtttatagaatactaaatcttttgacaaaaaagacctatttggaaaatagtttaaaatttgggaaaaattcaaaatttactgtcacttgtcagctactccctttgatctctaatatttgttggtacttaaaggtgagggctggcaaactctttttgtaaagggccagatagtataaaatatgttttagactttgtgggccatacagtttctgttacagctactcaaccctgccatcatcgtgtgaaagcagccagagacaatatgaacaagaataggtgtggctgtgttacaaaaacatttgttgggctgaatttggcttgagtgccattctctaaggagtcaacataatccagggaaaattatatggacttcataattagttttgataatcagaataacagaaataatttccaacatttgcatggtgatttacagtttttgtttgtttgtttgtttgtttgtttgtttgaggatgtggaacagacatgatcatcaccattttttcaatacggaaacttaggttcagagtgttaattaagtgagcttgctttagtttcttggcaagtcagttagctatgcctagaacctagatatccttatgccatctgttttcttacctacctggagtctgcccatgatgtataagagggacaaggtgaaggacctcatggagttgtgtcttgtgggaaggctggctgggataacagagagagagaaagcaactgagagtccagcataccggggctgaatcctggggtaacattggctctatgtgctctttgggcccagctcacctcctccacacagtgcaggtcctaatagatatgtggaggttgttcttttacaggcttgtgggataattccttccttccttcatgctgcttctgtgttggtcttctggtctgtgatgagggtgagtctgggctttccaggtgtgaaaggcagcaggtattttcgcatgactattgagcatgcagtctctgttcttgagtattcagtgggagaaataataagtataacttctgcttaatgcaactctaaaagtgaggcccaaatgaatatggtatccaaaggaagcactctgagattctagaagagcccatttttatggatagtgattttgatatggtttaacagaatagttactttaaatggtacttcctatgaagcaggtttctaatgataatgactttttttttttttgagctcagccttgctgtttgccccacccctgcctttttaaaaatggaaacctatcccttgttgggtgggctgcaggttcaccgttgttgttttaaaggattcttaacattttatagggctaaaatgcagatgaccttctgggatttttaaattgtttataaagccttaagttcctctgacaagaagaacatataaattcgtgtcacaactagaatatttcaaacacagtaatactgtcacttggtataacttatttgtggagacattgaaaagcagtcatgatggtcaaaataacacatttggtttatgtgaatctaaagactcatgttctattagcaccaattgaataattataaaaaacattggaccatttaaaaagtatgttctcttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctccatctcctgacctcgtgatccgcccgcctcggcctcccaaagtgctgggattacaggcgtgagccaccgcgcccggctaaaaagtatgttctcatacattatttcatttgatgcttactgcctcttcggcatatggtactatccataattggcaaatatgagccctgttgctttactggcttcattaaaggtggtttcagccaggttttcttatcctagagtcacaatacctctggctctcccatgttgcctcctatgaccatatattaagtgactatgtataaaacatggtagtagattttctaagataagcaaatcataaagctgccttctaacagcttatactttgaggaagagatgaagggtatatgtaaataaccctaaattaaggtagagagctgctagcaggcgcccagagaagggaaataccacttctagctgagggaggatgcttagagagaaaagagatggcatgcagcttttatgtttagttcaccttgctgtccctgcctagaaagcgtgttgtatcatggtgaggggctgagtagataaatgcagatggcctgattgtggactgaagggagacgtggaacttgaaacattggtaagttccaaagtaaagatgcatgggggagtagagggaagagagaagcaaagttgacatgggaaagaagaatttacccccctagaattgggcatggagatgtgaaagcagaggtggtttctgggaattgggaatagtttcacttaaatgtgggacacatgaaaggtaataatggtagatgacaggttgggaaggcagattggtgcaaggctgtggaacaccttgaatttcaagcttaggcatttggattttactctttgagaatttactaaagttctctgaaagaagttgatacttgtcattttgaagaagagagaagtgctttcagttttttagctaggaaactcatgttttaagaggctaaataagtttctgaatgaatgacaacctctggcatcctgtagctgttctggggcttgtctgatgctctgcactgaaaatcgccttggagatttcacaaaaccgacctaatactgtggtgctgggatgaagagcagaagcagttcgtgctgctaagctgactgtgtaggttctcctcacaaggagggaagaaaattttctctcgttaaggcattaaataatctgacataactgcttaagaggggcaagcatatggagttttttctggaaacttagttcagtcactgagtttctcatcctttgccattcgtcattgtttggactccttaatgtttgtctcacacagaaaccaatgaaaatgccatcgtgtctccctttcactggagaatgtattttcccattaatacattgtgcaggtatatctcaggttttaaaagatgtttcaatacaatagtaaaagaaagtggttgcttttcctccaggcaatttagaatgcctaagaacttatcaaagaaaccacttccacatacatttagctatatcaaagaattttattttctaatactgaataaatgtcataatgtagagcattttccttttatttatttattttattaattaattaatttttttttttttttgagatagagttttgctcttgttgcccaggctggagtgcagtgccgccatctcagctcactgcaacctccgccttccgggttcaagtgattctcctgcctcggcctctcgagtagctgggattacaggcacctgccaccatgcccggctaattttttgtattttcagtagagacggggtttcactatgttggccaggctggtcttgaactcctgaccccaagtgatccacccacctcagcctcccaaagggattacaggcgtaagccaccacgcccggtcttttcctttttattttatttaagctgtagaccacctttaaaaggctagtattaggaacagttattcatttaacgtgcatttattgagcacatactatgtgccaggtatgggggttcaggcaatagcagtgcactaaataaaagtccttgccctcctccggcattacaaaaacagtgtggctacaacgtggatgaacctcaaagatgctaagtcaaataaaccagtcacaaaaaaccaaatacagtatgagtccatttatatgagatgcctaaagtagtcaagttcaaagagaaagtagaatggtggttgccaggggtcacccgggtggaatggggagttgtttaatgggtatagagtttcaattttgcaaaatgaaaaagttctggagatttgatacagaataatgtgaacgtacttagcactcctgaaccacagcacttaagaatagtaaagatggtacatattacatgtattttaccacaattataaaaacacattttaaaaatatagtatatgtgtacactactgtcaaatagatattaccaaaaatatactgtaagaaacgtatatgaactaatgtcaggaagtgatagacactctgagggaaaacaaagctgagaagggggatggagaatggggagtgttggtggaaggcgtggttgctattttagagagctcagggaatgcagggctgtctgatgagataacattggagcagggacctgatgaagtggtgatgagtgttgtgaggaaacatcgcttacattgtcatcagactctgaccctgctttttattttgtctaaaccgtggagcaccccccaaaaaggctgacatttggagcattcttccagacttttcctatctcccatcttgagtttgggttcatcgacctgctttgtatcagggaatcaaattaatatctgcagataaagagccttatacacagaggaaagaggcaaccaattcttgttctttgggtgaaaaaaaggatacagtcctggaattcttgcaggagtcttggtgatttataataaaaagtaaaggtcttagatttaaaaaaggttatcaagaaagtagtgtcacctttcttcagcattcttttttttagacggagtctaactctgtctcccaggctggagtgcagtggcgggatctcggctcactgcaagctccgcctcccgggttcacgccattctcatgcctcagcctcccgagcagctgggatcacaggcgcccaccaccacgcccggctaattttttttttgtattttcagtagagatggggtttcactgtgttagccaggatggtctcgatctcctgatctcgtgatccgcccgcctcggcctcccaaagtgcttggattacaggcgtgagccaccttgccgcacggccctttcttcagcattcttttatggagggcagatcacatgagtttggtatggagcttgcttttaattaagggaaataaaattggttcttgcttgtgagtggtgtagagggtgcgtggtggtggtgggcagagggcaggaggaccctgggtagacgaaggggtgcgtggaaaggtgattccatgggttacttggaacaagaagggcaataggttgaccttaagagccagaatcaggagggaataaggtccttttggttgaagaggaagacaactgaggcagagaagggcagtggggcggggggcagagtggttgtataagaacatatgtctgtagccaggacagttttttaaaaattaagcttaactaaaagaggggtccgtggtttgccagatctgtgagaaaggcacatgtgatagattgctccttttaagccattcctggcctgtatcttgggagtggatggggctccttgaaagggttgtgctaggccagcctggaataaataacctttcaaaattccttggggtctgtaacacaatgtcacaaagtgtgtattctttcctaggctgtcggcttgagcatacggagtgatctttggaaaagtctaaactgcttagcatagcatgcagggccctgctgcctggctccacggcattcactttggccctgccccttcttccaccccaatcctctacttctgccaaactgagcctccagggataccaaaggtccccaagtgctccggggtgtcttgtgctcctgtgtctctgtgcacactgctctctctgcctggagggtacatttccctacccattctgcttgggcaatcacccacttctttttcaagactcagccaagtgacgatcatgctacagagcctcatttcccttatttgttgacttgcctgtttcttccactacactctaaactgattgggaacaaagacttgtccactccatcttggcacctccagtgccagcacagtgcctcgctttggagatgctgaatgcatttttgttgacaataaattgtttatgcggctgcctgggctgtgaggtgtacacagaatttacctgatacagcttcatcattagttctcaggcaagtaaaatcacagaagtaaaataattaactgagaagactatgttagagtttaggggcataggaaataggatattccactgaccacaagatgcatgaaaaaggacaccctggtagcaatttacatggagctttaagtttttaacactgacttcactgtactttctactcatgggcaaagtgcaattagatttccatacctttagtacagctgttcctgctgcacagaattcctgctcccgctcttgcatccatgtaaatactgacagtcttttacggaagaaccttaagttccatttcaaacagttctgcctgtgctgttttttgttgttttttttttttttctttcctattatacctctagtcattactatgtcatttgacacttggttgtctagcttcaggtatattgactggctccaggacccggggttggtaatctcacctctctcattcttgacttccctgcatgtaaaacaaatcatatgatatcctaaccttccttggagggctattctgaggctcacaagaagtggcagactgaaggtgcatatggactccttggattgactggaagacctttgtctctttctgaagatgacaagtccttttcttaattctcaaactccatctcgtgtgctgtggggtagaggcgttgagagagagtgtgcttatgtctcctggagcttggtgctccctgtgcaccccagagacagtggttgctttatttactgatcctaacagcacaatagcatcaagaaggatatagaaggacaatttctttaccccttcactttggtgctccggtaggagcgcacagaaggttctgtacttgtttacacttaagcttgctgtgggtaggttagaccttgcacaaaaataatatcaggcttcaatatcatatggccaagacaatattgtagcaccatgtcctctctgccttggatcgtgcttcttcttgagttcacttgcttacacaggaagctgttgcatgttgccaagccttctggcaagggtaaaagcatttaaacagtgtaatacattttggaaccaaaagctgtggtcaggaggaaaagtaatcatcttgagtagatgggggcatctccagtgatgtatgattataacatttgatcctactttgtgctattcagtttgctgttggttgtgtaacttacctctgggctcctaggttagagtaaatttaaggaagctggacttaaaatagatatttgtaatcacatttatgcgatgcagtatatatacctgcaccatttattggcatatgagttgatctcaattttgcatctgtagtataaaagtcaagtatttgtaccaacttttaactatcaagaggtgtgtatatgggtgtatgtaaatatgtatttccaggtggagaaagaataattaatttgtctattgttggaaagcttcctggaactaacatcacaaatgatgtgaaaatgtttttgaggtcagccacatagtcatcttcatgctaagcagtccaggaaaataaaataactaccaaatggagaaggataaagttagtgagcattttaagattcattctccaaatttatatcataaagaaagaaaataagaagagtcagatgcccttccattgccaatttaatgtgatactgtcattgatatacttattaaaacttgattttctatttagttgaagggtatgggcctaaggaatggtttactgttcaacctcattatcttgaatttagactcatgcaatacttactgaaagactggcatgactgagtgttggcttttcctaagatttggttggggagaaaaaaaaaaactttatgcaatactgagagatttcgttactctgagaccaaacttcattcagatgcccatcagcttcaataagaattggtctggattatggggactttataagttttcctagtgtagagattcagcccaattttcatcagattctccctagaagaggtaaaaggaaaacttgttgttagagtttactacagtgaggaaagcagaccactgcccttctcctggcaagttaggaagtatcctagagcattcttagctaaagtcttatttagcaagattagaatatgtcacttttcgccactgcattgtccttttctgaagaaaggatgatttatgagtcctctggatcttcttgtattaataacatcttgagccagctgttttattgggtgtacacagagggtaattagaaacatctgagaatcccatagcgtgcccagaaaaccatgacgctgtgtggaaatgaaaaaaaataacattaatgccaaaattgtgtacttggtaaatagatgaataagtattcaacaaaatttcctttgtattataccattttccaaaaagaagctaaagtctaaaggctgaaaatatccttttattgaaatacactcactgcagaaatcataaccttatttggtaaaagcctactgactctgctgttcatacagtaattatcatttcccttctgtcaaagtctatcatattttggaccattttgtgccagaagaagtatttcttctttttacctggcagttacttgaaaattttagacttctgaaggatctcatttaaggaaattaactcttaaaagcactaaaaggactaatagtgtccaatttacgtaatagtctatcctaaaaatcgggttgggatgtaggagtttgggctctatttcagctggttatttgaaatttgatctgctgcagtggtggctgagtttgaagtatttgtggatgcagcagcaacagccactaagttcttggggcttgatttaaatcaggcactgctcttcttactctcaagacaaaatctagacaagaaaacctaacaatttggtggtggcttgtgaatggttcctttcattttcattcacaaataacaagcccctatgagaagtcaatgttgagtcacacagacatagcccaggcagacatgggcagagcggagggtggaagcctccagtgtctttccagcctgtcttgctttgcatgtccctattcagtatgccatttttattctctttaattgttttgaatggattcctcattgatcacatgtattagtccattcttgcattgctgttaaaaactacctgagactgggtaggtttcaaagaagaggtttaaggaactcacagttccgcaagctgtacaggaagcatggttggggaggcctcaggaagcttacaatcatggtggaaggcaaaggggaagcaggcacatcttacatggttggagaaggaggagagagtgaaatgggagatgctacacacttttaaacaaccagatcttgtgagaactcattgtcacaagaacagcaagggaaagttcgcccccatgatccaatcacctcccaccaggcccctcctgggcccggggattacactggggattacaattttatatgagatttgggtgggaacacaaatccaaactatatcattacagagatgaagttgtagctaattgtgtgttttgctagaggttatcagtgacttaatgaagcccctggaaggagaagtggattcacctgtgtaaaaatgtttacagggtaggatataattagtaactcagaaatgtgacttcaaatgcctgccttcttcaatccctaaatcagagattctcagtactggtaatattatacaacagaatctaggaatgctcaaaaggtacagatgcccagcctgcaccccagggtctctaaatcagaatttctcagtgtgctttggatatgtgtattttgaaaacaaataatgtaggcaattgttatacttagctttggtggagaaccaatagtctaaaccagtgcttattaccctttaatgtccgtaggagtcattatggatcttattaaatgcagattctgattcagaatcagaattctgggtagagcctgagattctgcatttctaccacatgctctgaggatgctgtgctgcccacctgtggatcactctgtgagttgtaaaggtctaaactattattaatccactctgataaagctatgtcatcaattaatgatgtttattattgagctcttaaatgagcctgatactatattaggaaatgatttataaatgccaaaagagactcaaccatatcatcaaatatgttaacctttttcaaatctcctacctcaggtcctgctcctgtgagggctgaggtttcctcattctgcgaggcagcgtctcaggcagagtcctaccaggatggcttaagcctgtggaaaactcatgcatgattgccatatgaaatgccgggagggcaggctgccttcttaattcatcctaccatttcagctcactccagtctgccttgtcttcagaatttttcaggggatggtgagaaagtgtttttgttcacatgtcccctaaattccaagggatatgtgtcaagccctccaaagaattttcaccttttttgctccagtggaacagacttggtttctgcaagcacagccagcgtcccaggaagtgaaataacagatactgccttttgtcttcagctttgggatgtagcccaaatcccataacaggagttcaattccatagtctgcacaatatctcagcaaaacattaccagctgccaatagtgtggtggtcttatctgcaaggatgatactcttggtttactagtaataggacagatatttcgttgtctttccaggaaggtggaaggggagatatatttgcgtaggtccatccttattcttgttaagccctacttgggattgatgttaagcattttgacgatatttgaggataccatctttaatttgagacaagagaagctacacttgaattaattgaatgatatcaattagtttaaacctgtcatgtagccatcattctttctgataacatatgttctctatgctgataacatacgttctctatgctgaacttgcctacctgaattgtccagatttgacttatgaacatgatacttgagagtactttgagcacagagttgaattaatagaaaataacatagagtgaagatgaattcattcactggtatcacaaaattgcaactttcccttctgtgtgtcatcaaaacctcattacatttccttcacctcactctggcctctcctctttcccacatggtctactaatacctagcttctttctcttattccccatctccaattctcttatttcacttgcacccatcaggcatatccttagctgggtgctcacttagctcactctgttactctgaaatatttggttcacactcataatgcagaagtgaggtggaaaaactgtttgtctgtcaaatagttctcaactggggcagttttgcacccccacctaagagacacatttggcaatgccggcaaacatttttggttattcaaatttgggggtgctcttggcgtatagtgggtggaggccggggatgctgtgtgtgtcctacaacgtacaagagagctcccatgggctgggcgcggtggctcatgcctgtaatcccagcactttgggaggccgaggtaggcggatcacgaggtcaggagatcgagaccattctggctaacacagtgaaaccccgtctctactaaaatatagaaaaaattagctgggcgtggtggcaggcgcctgcagtcccagctactctggaggctgaggcaggagaatggcgtgaacccgggaggcggagcttgcagtgagccgagatcgtgccactgcactccagcctgggtgacagagcgagactccgtctcactcacaaaaaaacaaaaaaaaaaaaaaaaaaaaaaaaaaagagagggagctcccatggcaggtaataatttgggcccaaaatgtcattagcaacaaagttgagaaggcctgctccttagagcagccttctttccattgccattctttcctatcagacaacatcttagaccctgtttcctattttgtccaggtccttggaaaaccctccctcttaatctcaagattgttctgtagatgaaatctctagccttctgtcacaaatgtcttcctttgatgatggtgccagagcaaacccacagcttgcctttcagctgtccttgcacatgtgttgacctagtcaactggacccaggctcctagaggcttgatttacatttgataatttgtatgagatgatcacattggattttagagggtgcaaggattgagatggtttgggatgtgatgggccttcattctgaagattctctggaaactgaaacaagaaatgacaaatgggaaaccgtttagcacaggaggcattttttttgcacgtctcagaagtgatcgtataacagaaactgcttttcagcactgaccattgctactgtggatgctcatttgcaatgtgtctgagctatggctgttggaaaaggagggaattctgagtgtgtttatttgaacgatagcatcatcacactttcaaataaacataacaccttgggagggtatgggtttgttatttctaacccaaacatctttacacatgccctttgaaggatcattttgccaagtttgaaagaaaaaactattcaagcattaaaagtctgacatattatttaactcattgaaaaaagaaaaacctctttggggccaaaacactctaggtcagctggacaacaatgtgtatcacgtttttaaagcattcacttttggaccaagaaatggccctagggagcaagtaaaagacattgccctcacctgcatataaagtcatatagcagtcttccgttatgttttggtcatcttgcctgggagacttggaattttcacagttatttcttttgtgcttttttacttgaatgaaatgcctgttcttaattccctcggtgtgtaggggggttatattttattgcttatcttcatgagaccccccaaacccataatttacatgactgattttttccccaattgtatcattttttagttgtaaaatatacataacacaaaatttattatttaagctgtttttaaatgtatgttttaatggcattgagtatattcataattttgttcagccatcatcactatccatataataacttttcatcatctctaacagaaactatacccattaagtaaaaattccccattcctttctcccctagcctctggtcacccctgttctactttctgtctctatgaatttgagtattttagagacttactatttgtccttttgtgactagcttatttcacttactttgctttcttttcttttttcttttttctttttcttttttttttttttttttttttttttgagacagagtctcgctctgttgcccaggctggagtgcagtggcaacctccacctgggaggcggaggttggctcactgcaacctccacctcccaggttcaaacgattctcttgcctcagcctcccaagtagctgggattacaggcgtgcgccaccatgcctggctaatttttaaaaatgtttttagtagaggcacggtttcaccatgttggccaggctgggctcaaattcctgtcctcaagtgatccatctgcctcagcctcccaaagtgctgggattacaggcgtgaaccaccacacctggtctcacttactgtgttttcaaggttcattcatactgtagcatgttttctttttaaggctgaatgcagttccgttatttgcatacactaccttttgtttatgcattcatctgtcgatgtatatatttaggttgtttctacctttttgctattgaaaataatgttgctatgagccctgatgtataagtatctgtttgagttcctgctttgaattttttggtgcatatacctagaagtggaatttctgggtcaggtgataattctctgtttaacattttgaggagctgccaaactgttttccacagaggctgtgccattttatattcccaccagcagtgtgtgagggttccattttctctacatccttgacaacacttattttcccattcttttattgtgcttcagcttaccctttttttttgtattttattttatttttcttcccataggttattggggtacaggtggtatttggttgcacgagtaagttctttatggtgatttgtgagattttggtgcacccatcacccgagcagcatattctgtaccctatttgtagtctttcatcccttgccccactcccacccttccctctaagtctctaaagtccattgtattattcttatgcctttgtgtcctcatagcttagctcccacatatcagtgaaaacatacgatgtttggttttccattcctgcgtcacttcacatagaataatagtctccagtctcatctatgtggcaaatgccattaattccatcctttttatggctgagtagtattccattttgtgtgtgtgtgtgtgtgtgtgtgtgtgtgtgtgtgtgtgtgtgtgtgtgtgtgtatcacagtttctttatccactcgttgattgatggacatttggattggttccacaattttgcagttgtgacttgtgctgctataaacatgcgtgtgcaagttggaaaaacccttctagacatgggcttaggcaagaattttgtgactaagaacccgaaagcaaatgcaataaaaacaaagataaatagctgcaacttaattaaactaaagaacttttgcatggcaaaaggaacagtcagcagagtaaatagacaactcacagagtgggagaaaatcttcacactctatacatctgacaaaggactaatatccagaatctacaaggaactcaaaaaagcagtaagaaaaaaacaaacaatcccatcaaaaagttggctaaggacgtgaatggacaattctcaaaagatgatatacagatggccaacaaacatgaaaaagtactcagcatcactaatgatcagggaaatgcaaatcaaaactacagtgcgataccacctcacgcctgcaagaatgaccataattaaaaaatcaaaaaacagtagatgttggcgtggatgtggtgaacagggaacacttgtacactgctggtgggaatgcaaactagtatagccactatagaaaacagtgtggagattccttaaagaactaaaagtagaactaccatttgatccagcaatcccactactgggtatcaacccagaggaaaagaagtcattatacgaaaaaagatattttctcgttttttaataaagtaagagccatactagtgggtgtgaagtggtgtctcatagttttgatttgcattcccctaatgattgatgatgctggcctcttcgtgagcttattagccatttgtatatcttctttggagaaatgtctgttcaagtcctttgtccaattttgaattggtttgtcatagttgatttttcaagaaaaacctgggatttccatttaacaagctaaatacttaactacagcattatctctagctgataattgattgtgaatctttagggagacctgagttttaatagtggtgctgctacttggacaagactcaaatttttaagtcttaatttcttcctctctaaaaggaggagttcaggaagtagatgttcaagatcctttgcagccctaaaattctatcattttgttgaatatgaaacatatctacgcagagaatgctagagtgtaaatgagatgaggctctctttgtgatgttttactctgaaaatatttactgtgctttccaaggatgtacagtatgttcccctttgtacttttttgggctctgttttccactttgaatcaaaggatgattttgtacaactccagtgatacattgtgtggtgatgtgtcatcagcttgacaagtttcatcagaaaagttaaggcctgaaagatttcgaaaacttgtaagtgactctgtattttccttgcttggtttataaaatcaaagttcttagaagagtttggctagaaacagaatgactccttggtggcctgaaggaagcacagcttgtttggagcaggatgaaaggatggagtcaggttgggccaataaggctgcagaggacaagtttttagtttagtttttttaaaagaaaactgaaatgagagcctgcaagccttagaatgcgctggggtcctgctacaaatgataacaaatggatcattcacattaaaaatctgagccgcgaaggatctaaattgcctcactgtggggaaaaagtcaaaagccaactttaaacttaaggaaaatcatttttataataaacgaaaaggtagtttcctaatacatatttgaattcatttatctcttgccaattcctggtaaattctaagtgaattctgaatttatctagattaacagcatcttgaattttttcttcacatggaattaaagaaaaggccagacatgtgagcattctttagcagtcaaaatacagccttgagtggcacttgtgccagagatccacccggctccgtgtccccagagcggcatcattggcaccattttcctttaggaaactggggggtggaggaaaagttggggttttattcccccagccccctcctgcagggtccctgaaggtggtttatgttcctctacctcaggccacagcgctgtcaggaggcacttctctgtgccagttctttgcttttgcaaccccagggttcttgctgtgggtttcccagaactctgcctgtacctttgtcaagaatctctttattaaactgtattaaattttgcaccacttgaatgtgcctttctttcctgactggcccttgactcataccaaaattacattagctaggcctgtaggtagattttttttaagttgatctgtatggcatctttaaaaaaatggaattaggtttttcgaatatgtaacacataatgcaaaatttagaagggacaagaggacctgctgtagagtgaagagtcagttttcttcccatttttgtattccaaacactcatttctccttcccagtgagtaatactctttcccatttctgtcttctcccagaatctgaatgtactggcatatgtgtatatatatccttgaaactgctagaatattttatttattgtattgtaccatgcgttgttcagttagcagtccttatcagcacaaataaatctgccttgttctttataaaggctgcatattccatcctggcatataatataacttattgaactggactgaattgttgggcagttgacctttctacttttgctgttatcatccaagcgacagtgaataatgaaagtcttagtatacatttgtgaatatctaggataaattcttagaaacaaaattgctgcatcaaaggttatgtgtttatttaatttgaataaatatttgccaaattatctaccataaaagttgaactaggccgggcgcggtggttcacacttataatcctagcactttgggagagcgaggtgggaggatagcttgacgtcaagagttcgaaactagcctgaccaacacagtgaaaccccatctctactaaaaatacaaaaattacctgtgcttggtggtgggtgcctgtaagtccagcgacttgggaggctgagtcaggagaatcacttgaacctgggaggtggaggacgcagtgagccgagatcatgccattgcattccagcctgggctacagagtgagactccatctcaaaacaaaacaaaacaaaaagttgaactaattagttttcccagcaatatatgaacttgtctgtatcaccataccctttctaatacagattattatcattattattattattttgagacagaatctcactcaagattggaactacaggcgcgcgccaccatgcctggctaatttttgtatttttagaagagatacggtttcaccatattggccaggctactctcgaactcccgaccgacctcatgatctgcctgccttggcctcccaaagtgctaggattacaggcgtgagccaccacgcccagtctctaatacagattattaaacactttgaactctgcttctctgatagattggagtttaagttgcattttgcttgtgcatgagattaagtttcttttcatgtgcctaaaacagagtttctccacctcagtgttattcacatttgggtggataattctttgttttgagggtttgtcctgtgcattgtaggatgtttgtagcatctttggtctttacctattagattcaagtagcaaccccccatctcaccaccaccaagaagtctctggggacaaaaccacccctgattgagaagcattggtctaaaaacttttctcctttgcctgttttcctttcccactgcacttctggtgtttcaactttgcttatggtgtttttgctatttacttgtttatttctttttaggccatacaaaaattttatattattttatgtagtcatatttgtaaatatgctgcttctcagttcatacaattgatagagaaattgatttttgataacgttttgttaatcaaataaaggtaccaaattcttcttcctttaatcagctgtgatacttcccttcagtgctagacagcaaaccaagggaaaccagagtaagccctgaattttattgatgactgctagcacatagatgtattggagaggatcagaaatcttaaattaataacaactaccactatcgagtctcttccgtatgcccagcactgtttaggtaccttgcacatattatatcttagccttgagacagagccctgcgtgatcaggatgtataatcattttaaaggtgaggaaactaaggcccgaagaggttaagtcacttggccaagaccacagagcaagcaggtagcacagctaggttttgaacccagatccttcagaatcccagggttgtgctttcacctcatgtgtgatgttgtctcatagctaactctgtgctggggttgacattaagcttcaagggaattctcagggaaaagaccatattcgtcgtgcttgtgagatccatcttacttctctttggcttggacagatccgcagagtactttcttccatcgcatctgactcaagttgttcactgaatcttgggtcttggtctgagttttgtattgtacttgtgcaactatttcctcctcacctgtagaatgggaaggataatacctgcctcataagatgttgtgagggttaaatgacagcatggtttgcaaaaaggctttgtgatctgcagaataatgtccatatataagtattattattgttactgttaattgcttgcttaccatacttcatatatttgattacatcaaaatgcaactatataactatacaactatatatataacaattgaacatattttaacatattataaaatagaagacattggtattaacacatgtaaccagtgtatacttaatttcttgagtatattaaacatcaaatattataaattgatagcattgcctagtacttcaatatttttatgtcatttagctataatttcaagtctgagtcaaaccgattatcttactgtatatatatttaatgaattttaagagaattcaaagaactttgattccatttgatttattatttcgggttttcatgaagaaatttacaaacttgacaggtctgcaaatgacagattttacacacttggccattacattggtgactgaagagcagaggttttgtttggactccaggcatgcaggggaggcagacataattttccccctttctagagttcttggccttggaaatttaatatctactttaatcttaaatgtagagatgctgaaaatcgtgtaagtcaaacatcaaaggtgtttagaacctagagacttgttattgtctgtgattattttagatgtttagaattgaaatgtggctaatgcacggatgaggattaagagctttgaaggctgtaagcagttaaggaaggaaaacctcatttcagtggctcatttactgtcattggcatgtttctgaacagttgaaagctgatttaccaaaggatcctgcgtgcaggaggagtaagcattttgtagaaatcagtagggaactgttttgagaagtgaatgggaagcccttagagctgaaagtagcttggagagcatctcattcattcttttcattttatagatcagaaaattgagacccagacagggaggttatgacttcaaggtcatagttggtggcaacgctcagatgcagacccaggcttctgactcccattgcatttccaagtgagatggtttttgcaagatttttatatccagaacattttaaaattggccatctataggatgatggtgctgtactggagatttctaatgcagtttgcatgtgtacgaggagcatcagagagagatcttgccccagctgaaaagccagtatctttttcccactgacctgtgcccacccaaataaggtgaggatgagaatcactgggttactgggaaaagctggaatgaccatagtcaagagaaaatataggccacatgcggtggttcatgcctgtaatcccagcactttgggaagccaaggcatgtggatcatctgaggtcaggagtttgagaccagcatggccaacatggggaaaccctactaaaaatacaaaaattagccagccgtggtggcatgtgcctataatcccagctacttgggaggctgaggcaggagagttgcttgaacctgagaggcggtgattgcagcaagccaagattgtgccattgcactccagcctgggcaacaagagtgaaactcttgtctcaaaaaaaaaacaaaaaaaaaaaaaaaaagagagagagagagaatatatatgcataaaacagagtattcctcagtcattttgtaaacctttgttcaacaaaagaatgaatacattgtgttgtgtaaacttcagatagagattgagagactatcaaacccaaatatccagggattaagtagttacatagaagtaagtagttacatagaagaaatattctatgtaactggggcactgacaggccctcccatcccagacacagaaggctacttactgcccaccggagcttctgcagggcctgataatgatggacatcacagttctgtgccactttttggaattaatctagagaaagaattgagacagggcatcccagatgaagccaaataggggtgacttatagttccctggttaattcctggagggggtcctgaataacaggctcttggatcatgcaaaggaagtagagtaataaaggacctatgagattcattgacattgtggttgtcgaaggaggcaccttctagccagaaaatggaagatttctttccagtgattcatatgtattacccagaacactttgacttcctggaatttaaaatataaactcaagtctcttggcaataacttttaaacactgcagatcactggcttctccactcctctcccttttcccctaaccccgatcctttaaatagatagcagtatacgtacatgttaggtagctgtgatgacaaaaaagttcaaaatgatgcacagagtgtaccttctttcttttctgtgatactgttgacacattctcagtccagcacagtataaccatgcaataggaaacacagttctttggagagctcagttaagtgagatgaaaatacctatcgtgattctgtgtctcatggccaggcaggatgcaatgacatgggaatgcagggggcctagggtctgcctaatctcagccctgtatgtgcttctgtgagtgagggaacaaagtacctgcctagcaagctgtggcctgggtggtgacagctacattttgcttgcttccctctcctaagtgagcagtatacttgctgctgtggctccgcaactcaagggcgtcctatcacaaataatgaaaaatatgggtcctttcagcatacagatgacttagtggtaatagtcccttcgaaccttgagtgcttgcttataaagtcaaggcccagccaatccagcagccacttcactgagctctggagtttgagttatcaaaaagctgtcacctcttacacttcctgtctagcaccttttaaaggtaacatcactgcctccacttccaaaaaagaatttctgttctccatctcttctatttcttattctttgtgtccaattcattcaactcttaaaataatactttcaaataatatccagaaagtctggtgattgtgcttctaacccccaccctccccaaacctagtgaagctgcttatttctctgcctcttggatctatgggtggtcccatttaggcttctttagtttcctatgtcatcatcttcaggattattagagaagaattcccagattaaaagtatggagaaagatttgattcggagctggaaggaaaggaaaagtaatgttcactgagtaccttctgtgtactcaacttagttttagccattgtcacatgctatttttctgcatcccaagaccaatgggtatattatttccatgtaccgattagaaaactgaggcctagcaaattcattttattttattttatttatttttgagatggagtctcgctctgttgcccaggctggagtgcagtggcgcaatctctgctcactgccacctctgcctcccgggctcaagcaatttttctacctcagccgctcgagctgggatcataggcacccgccaccacacctggctaatttctgtatttttggtagagatggggtttcaccgagttggccaggctggtcttgaactcctgacctcaagtggtccgcccacgtcggcctcccaaagtgctaggataacaggtatgagccaccgcgcctggcctcaaatttaaatagaatattcaatccagagaaagaattcaactttaaaaataacgattatggacaatttccatttctgtagccacgaagagaaaatttattaggggcttgaggagacttgccccttttaattgttggtggatgaatcgcaaaacttgaatttaatggaatccaagtgccttggactgcttttgagcaggtcattcatgtggttagagcaacgctgcttccaagggaatgttttgattgattgtgtcagcgtccttgggtggcccttccaggagcttgaatgcctgtgtaagtttggtttcctctggctagcttctaagctcctgcagatgaggtaccacatcttctttctattttgttcttctaataatgactagtgtaataaattaatcagtatggaaattcagcacaggtaggttgacctactatagaaagaggctttttcagctctgttgagagtcactagatattatagacaagtactatcaactaggtatttgggcctcgtgattagttgcagttatttctgcctcattattactggtcattgtggttcttaactcagggatagaaggtagattttattttatgtacccactctatctgttgctgaccagcacagtatgctgagaattcggagatgacatctaggcccagcaagaactatgataggttaataatttttgttagaggagaggagagtgcagcacctaccctataggtgctgctgtcatggttgttgccagcagtccagcagttatctcaatgaagactgggtctttcttgcccctcttgaccactccagaagttattgggacaatgtgtacactttggagatagcatggtagactttgagtattgactctgccatttattaatagtgtgctttgagaagaatactacatgtctcagaatctcagttttcttctgtaacttggtgtaaagcgatgtcattcacaggatggctataaagagtagatgacataatagctataataccctgtaaaatagaaatccaacaattgttagtatctttcccttacgtagaggttaaataggaagctttttttttttcctttttttttttttttgagatggagtcttgccctgtctcccaggctggagtgcggtgacatgatttcagctctgtgcaacctcccaacctccacctcccaggttcaagcagttctctgcctcagcctcccaagtagctgggattacaggtgcccgccaccacacccagctaatttttttgtattttcagtagagatggggtttcaccgtcttggccaggctggtctttaactcctgacctcgtgatccacctgcctcagccttccaaagtgttggcattacaggcgtgagccaccacgcccggccaggaagcttctttatagagactttgctgttcttaccttctgcaaacaaatgagcacatgaaagaatggagaatgttaatattagcgttaaagtagatatgttattttcttcacttttgtgtcctaaattgttagctgcaaaagattaatatattttaatttattaacaaagaaagtagaaacttttcaacaggtttattttgggcatattaaagaacctgcattgtagactataaacattcatgatcgcttttattgatgatcagtcttaggaattatgaatcatttggttagtgagtaaataaatgagaaatacagttctcatttaactctgtatttatcccccatggcttttgaattgtttctttcagatgggaaccaagtgacttgccagaagtgggcatgcttgctagcattttgtgatagcttcacacgagcttgagaagcacatgctgaggaacttacttgacactcatcaattttagaatagagtgacagccatagataaataatttctgtgttttgtcttcctcaaaagagcaaatttggagggagacagttgtatcatcttaactacctttttgtggctgaagtgttgaatctaaggtaccagaataaagggtgaagtttttaaaattttgcatgtttatttaatagatttgtatttgttcatatgtatgtgaataggtttatacataataaatgccacagtgatagtggtcaataccttaaaaataaaaattagttcttccttaatcattatttttcttgtttgctttaggaattctgaatggatgtcatgactatatatctaataattacttaggaaatcctctcaatctctgggcatggggtattaggctatgaaaaccagaattttccattttaatcataacaactctgaacatttttatgctaatggtgaaagcagaaactttgttcttgtcctcaaatcaaatttaagctttcctgttgattacacatatccttgacgagtaagattcactctctttcacctgcctggttattgatcagctcatgagcagatggaagatctaagcataaatcactcatgaagatgatgaataagctgaaagtttattcatatgtataccctttcttatccagtgatagtagaagcttcatatttaagaaggggattaatgacataatttattattgtttcttgttcttttcgttaaagggaataaacaatataagtgaataattaattgaattttgtaggaagggttcagaaaagacctgccagatacagacaggaacccttgtcattaaacccaaggccagcagacattgcacgggtgtgtgttagaagcaaaggcaaagggctctgggaaagagagtaagaaagtgttccttttagatctgagaaatagtaagctttaagaggctggctttattgatttatttattgagacaaggcctcactccatcacccaggctacagtgcagtggcctgatctcggctcactgcaacttctgccccctgggctcgagcaatcctcccacgtcagcctcccaggtggctgggactacaggtgcatgccaccacgcctggctaattgtattttttatagaaacagggttttgccatgttgcctaggctggtcttgaactcctaggctcaagtgatccacttgccaaggcctcccaaagtgctgggattacaggtgtgaaccaccacacccagcctttaagaggctttaaattgtcacttgacattggtaatattccagtatgctagaaatgatggcaagagtacaaaacatggccttaaaattattctggacatgatattaaacgtggtaagacaattggagactgtgactaaggtggcagaactgttcagtcttttgataattgccatgatcttatggtagaaaaagcactggaagcaagagcgagtggggtaggatgatgaaaaatggcttaaaggataaaaacatgtgattattaggtagaaggaataaattgaatgtatgatagcagagtagagtgactatagttagcaaaaacgcattatagttagttgctggacaccctaaataccccgacttgatcattgtgtgttatatatatgtaacagaattttatgtgtattcatacatttgtataaataaaagaagcagcacctggattttaggactttcaaataaaacatataaggtttgggggagaaaaagaaaataaattaacctacgtcaaaatcattgatttctagttaataaagatttgataattgtttcagaaatagactagaatggccatatcattaactgggtcataattttatggaaaaaagcttatttcatgtctctcctttttatcatagtgctctatccagaaaagatgctcagagaaaacaggtgtattgattcttattttttttttctcttaatatgtctagtaaaagtcagggtgcacactcactataagaacaatgattattaagttgacttgttcattaagattaagaataatgggccgggtgcagtggttcatgcctgtaatcccagcactttgggaggctgaggtgggcagatcacgagttcaggagttcgagaccagcctggccaacatggtgaaaccccgtctctactaaaaatacaaaaattagctgggtgtggtggtgcatgcctgtaatcccagctgcttgggaggctgaggcaggagaattgccctgaacctgggaggcggaggttgcagtgagctgagattgcgccactgcactccagcctgggtgacagagcaagacttcctctcaggaaaaaaaaaaaaaaaaaaaaaaaaaaaagattaagaataatggcccaactatgaataaatctgaagtttggttcccataccgggaaccaaaagagcattaatgatattgggtatatattattttcttaagatgtgtttaggatgtgggcctatcttgctaatgcttatttatagtattttagtctatgctttgactttatgcaagatctacaaataaatatttctgattacagaaaaaagcatcatttcttattttgatgtcatttggaataaaaaatgacccaaaaagctctactgggaaaaatactcttaattgatccgtgtataaacccaaagaaagtttaactttgagtcttgtggcctctgtcaggaggctggagatttggctccactgaggttcattccaacgattgacattcatttgtcacctacttagggcattcacagcagttttctaggtattgatgagaagatacatacctttgaagtttgtatacagacagtttccttatgatgcatatttgtgcaaatgtgtactgagaagcaggtccacctgaaccttcagggagcagtcaaaaggaagcttcacttaaagcaagtacataagagtggtggtgggcctcaaaatcgaaagaaggaagagtgtgaagaggaattctttcagaatctagccaggaggatggcatgtgcgttagtatacatccaggatagggagtgtggtatgttccagaatcacagatcattcagtttcatgatctaaatggagagtcatagaaaaattctgtagggaagtgaactgattggttgaatatgcatatcagaatgtccctcctggctatggtatgaagaaagcatattggagggattatgaaaagagggagagggactattgagaaggctctgctgtagtctgtgaatgatataatagcttgaacttggacaaaggcattgaagaatggagagaaagaaataggcgagacgctgaagagagagaagcagtagtacttagctacaattggcatctggttatgggacagagaagaatctaggctttgatgtttatggttcataaggaatattctttaaaatttaatagattataggaccataaaaacttagaactgagaaagcaattatatatcaggcctttcattttaccaactagaagagcaagttgcagagagctgcactgaattgctcaaggttatttagctttgcggtgcagacctacaacggaactgagatctcttgtctcccagtatggggaccttctgatacactagactttaaacttgtacagtaaactctctgtggaaaaggtgattttgttgcacccaggaatttatcatcatcattattattatcattattttagcagacggagtctctttcttaatgaatataatggacttagataatgtgaatcacctagtaaagtctgcttaaatgcatcagttccatgaagagaagaagtacagttttagaagtgaattggtgaaaatgctttattccaaatggcttgtgaaaataaggatttaaaagctggtaggtttccagctttgatggtatggagcctattagtacaattaaaggtgtaaaatgcattcttctttccccattagcttttcaagtttctaattcagttttggaagtcacctcttccatcatagcctaactttaaaagtagatacacacccctctatgagtaatgtatgtttttttttttttttcttgtttggatcagatctgctataaattatacaactttatgttgagatcaatttggtaaatttattagtttataagaattagataagtgattgtattttgtaaaaatatttcattatatatcggttaaaaaagtacatataaaatgtatggtacattttcattctgaattaaaacctcatagggttgccttaacttcagtatctagccataaaaggaaaggagaaagagaaacgggaggaatactagggaaaagttgctgaaattcttctttgtatacccaagtagtttctctgatgatacttggtttatttaggagaattgccagaaggatttagaaatgtttctagtccttattagtgatggtagttttaatttacttttcttccatgtctctgattcttatcctgtacagaatctagacctccaattgttttattgtggtaactgagtattagcgtgtacacaaggatgtttcaaatgtcaacttagtctaattctgagctacatctcgagagttaattagaaacatactcatgggccaatactgaggtttagaaagaattatcttaaggaagtcagttttgatacatattgtcttgatttaatggaatgttccagattcaggaagtatatatggagccctgaggaatgaataggcatattttaataacctgaacttgacataccaagttatttaagttaaatggaaggagacatgttggctcatctcatcagtcagtaatgaatcacgtggccctgaatagcgttagcatttgattctggaaggctctgctgtgtgattttaagcagtgtgcagtagaaactccaaaattacctccatgtaactgactttccaaattaaccaacaccctctactcccttttaaaaatatgctgactgatgcccatggtgtgccgaatactcctggctgatagctactccggggttgaccctacacatgacaccacccagatctgagttttgtttctactaagagtcagttcttttgtccctgcctgaaattgcattatttaattaaatgttatgtaaattgattaaaaagtgagtgccaaaaaaagaattatttgcatgaaaattaagatgaataatttggaaagaatcaataaaagtgaatctctaatataatattgactgctgatttagggctaggcaagacaacattaaaactttggaaagcaaattataaaaatcagaaatttggcattcaaacgacttcccaattaaaaaaagtttcataaaagcctcatttgtacattcaaaaaaaaaaaaaaaccaaacatatattaggtaccgaccatgtattaagcattttgctaagctctagggatgagcaactgaaaaagatgaggtccaaaaactgtttctttctttctggaactcatatgcttttggagcagtcagatgtgaacccagacaattagaattctgtctgtcctgcacacaagcatttgttgctttaagagcatgtggcagggagtgggagcttccagctttgccctggcatcttcaagaatggccttaggaaagaggtcatgcttcagcagaggtgtgggtggaagtagtaaggtggggaggtaggttgggatgaagaggaaagaggctgtatacaaccgtgtatggaggaatgtgcagtggtcagaagagtccaagtgttcaggatgactgagactaaaaagaacatgatgacagcagcagagagagatgagactggataggttgcaagaactagatcaaggagagcccttctgccatgattaggtttagatttcttccactggtggtatagagaatctctgaattagttaagcaggaaattgatgggtgtggttttcagttcaaatgagtctgtatcttagagggaatgatccagttagaaactatttgaggacctttttgctaccatcgaagtttatgataatatctaaaaaccaccatctagcccctgttagacattcctatcactctgtgcatagttgtaagaacagaaaatggaggctgagcacagtggctcatgcctgccatctccacatcttgggaagctgaggcgggaggattgcttgaggccaggaatttgagaccagcctgggcaacatagtgtgacacatctctacaaaaataaaaaaagaaaattagccaggcttagtggcacatgcctgtagtcctagctacttgggaggctgaggcaggaggatcacttgaacccaggagtttgaggctgcagtgaactatgatgatgccaccactgcactctagcctgagggacaaagtgacaaagtgagaccctgtctttgtctcaaaaaaaaaaaaaaaaagaaaaaagaaaaaaaagaaaatgggtgttgtgtaaaataagcaatctggatttttaatctatcagattataaaaatgaaacttgtgatgttgtcttacaaatttttaatatttagtatttctgaagagccatttgaaaccaatcagtatttgggattgtgtacccaccagaggccaggagtcctctaaaactagttttccctgggtgtttttgtgttacatggagatttaaaggtcacagtccacctggcctttttagcatgttaaaagaaaaaaaaaaggcatcaggagcctgttttcctgcctaagggttttccagttgaggtatctagaaagatctgaggctgagcttcttaaatgtccatctctcccacagctacacaggctattatgtatgctttgggatggttaatttccaactcatagtgattttgacaccttgtgctgcatccagtctcgcctacctatatgctgtcagtgacagtttgctactcagaagagaggactaaaagggatccgtgccctttaaaagaaataaaagaccagcatagaaaatagaggccttggctgtggcagcagagttaggggggagccatgggaaagtaatgatccatggagggtgggaataaaaaggagttgtagtcgggccttgcagatttttgtttatagtagtggttcccaaacattgtccacccagaatttattccttttggcatttgctggaattttatagaccctatttcattttattgcccagtgtgtttcttctttcatgtcccatggggaacgtttctctgcttttgtgtgagtcctagaaggtctccatgcccttctttagcttgcattcttcctctgttcttccattcctaactccacccgaaactgccacattatatttttcttttccagcacattatgtctctctccccctctgaagccttctgttcaaaatagctgcttatctttagaaaataggaaaggaagttttatttaataactaatattaagatatttagataacagttgaaagcaaaattagttacaatctgtacttaatacagtgggtaaaagctccagatggaatgagttgaataattaagcaagaaagagaagaaaataaaataccagcatgaaatagattacttatcagatacttggaggggtaatagctttttaagaattgaaaccatagaacatataatagagaatagcacttataaacttaattatagaaaagcagcaaacaaaatttgtataatccagacaaactaaaataaacaggaaatagattgacaaagatgttttcatcaataagacaaatagaatcttaaagtttatgatccataaaaaccaacacgagagtaatttaaaaatcattaacattctaagagataggtaaaatatatggataacaagatagttcaaacaaggagaaataaaagcagtaaacagatatgtggggaaatgttcaaaatctttagtaaagacatgcaaaatcagcattgtggtaatataatcagatagtaagaaaaatattcacagctcagaagttaccttgaaactagtaaattggtaaaaatatttagaaataaaatccaggggaagcagccaagatggccgaataggaacagctctggtccacagctcccagcgtgagtgatgcagaagacgggtgatttctgcatttccatctgaggtaccgggttcatctcactagggagtgccagacagtgggcgcaggacagtgggtgcagtgcaccgtgctcgagccgaagcagggcgaggcattgcctcactcgggaagcgcaaggggtcagggagttccctttcctagtcaaagaaaggggtgacagacggcacctggaaaatcgggtcactcccaccctaatactgcgcttttccgacgggcttaaaaaacggcgcaccacgagattatatcccgcacctggctcagagggtcctacgcccatagagtctcgctgattgctagcacagcagtctgagatcaaactgcaaggccgcggccaggctgggggaggggcgcccgccattgcccaggcttgcttaggtaaacacagcagcctggaagctcgaactgggtggagcccaccacagctcaaggaggcctgcctgcctgcctctgtaggctccacctctgggggcagggcacagacaaacaaaaagacagcagtaacctctgcagacttaaatgtccctgtctgacagctttgaagagagcagtggttctcccagcatgcagctggagatctgagaaggggcagactgcctcctcaagtgggtccctgacccctgacccccgagcagcctaactgggaggcaccccccagtaggggcagactgacacctcacacggccgggtactcctctgagacaaaacttccagaggaacgatcagacagcagcattcgcggttcacgaaaatctgctgttctacagccaccgctgctggtacccaggcaaacagggtctggagtggacctctagcaaactccaacagacctgcagctgagggtcctgtctgctacaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctccaaaggaacgcagttcctcaccagcaacggaacaaagctggacggagaatgactttgacgagttgagagaagaaggcttcagacgatcaaactactccgagctacaggaggaaattgaaaccaaaggccaagaagttgaaaactttgaaaaaaatttagacgaatgtataactagaataaccaatacagagaagtgcttaaaggagctgatggagctgaaagccaaggctcaagaactacgtgaagaatgcagaagcctcaggagccgatgcgatcaactggaagaaagggtatcagtgatggaagatgaaatgaacgaaatgaagcgagaagggaagtttagagaaaaagaataaaaagaaacgaacaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactccttgagaagagcaactccaagacacataattgtcagattcaccaaagttgaaatgaaggaacaaatgttaagggcagccagagagaaaggtcgggttacccacaaagggaagcccatcagactaacagcggatctctcggcagaaactctacaagccagaagagagtgggggccaatattcaacattcttaaaaaaaagaattttcaacccagaatttcatatccagccaaactaagcttcggaagtgaaggagaaataaaatactttacagacaagcaaatgctgagagattttgtcaccaccaggcctgccctaaaagagctcctgaaggaagcactaaacatggaaaggaacaaccagtaccagtcactgcaaaatcatgccaaattgtaaagaccatcgaggctaggaagaaactgcatcaactaacgagcaaaataaccagctaacatcaaaatgacaggatcaaattcacacataacaatattaactttaaatgtaaatggactaaatgctccaagtaaaagacacagactggcaaattggatagtcaagacccatcagtgtgctgtattcaggaaacccatctcacgtgcagagacacacatagactcaaaataaaaggatggaagaagatctaccaagcaaatggaaaacaaaaaaaggcaggggttgcaatcctagtctctgataaaacagactttaaaccaacaaagatcaaaagagacaaagaaggccattacataatggtaaagggatcaattcaaaaagaagagctaactatcctaaatatatatgcaccaaaaacaggagcacccagtttcataaagcaagtcctcagtgacctacaaagagacttagactcccacacaataataatgggagactttaacaccccactgtcaacattagacagatcagcgagacagaaagttaacaaggatacccaggaattgaactcagctctgcaccaagcagacctaatagacatctacagaactctccaccccaaatcaacagagtatacatctttttcagcactgcacaacacctattccaaaattgaccacatagttggaagtaaagctctcctcagcaaatgtaaaagaacagaaatgataacaaactgtctctcagaccacagtgcaatcaaactagaactcaggattaagaaactcactcaaaactgctcaactacatggaaactgaacaacctgctcctgaatgactactgggtacataacaaaatgaaggcagaaataaagatgttctttgaaaccaacgagaacaaagacacaacataccagaatctctgggacacattcaaagcagtgtgtagagggaaatttatagcactaaatgtccacaagagaaagcaggaaagatccaaaattgacaccctaatatctcaattaaaagaactagaaaagcaagagcaaacacattcaaaagctagcagaaggcaagaaataactaaaatcagagcagaagtgaaggaaatagagacacaaaaaacccttcaaaaaattaatgaatccaggaactggttttttgaaaggatcaacaaaattgatagaccgctagcaagactaataaagaagaaaagagagaagaatcaaatagacgcaataaaaaatgataaaggggatatcaccaccgatcccacagaaatacaaactaccatcagagaatactacaaacacctctacgcaaataaactataaaatctagaagaaatggataaattccttgacacatacaccctcccaagactaaaccaggaagaagttgaatctctgaatagaccaataacaggctctgaaatggtggcaataatcactagcttaccaaccaaaaagagtccaggaccagatggattcacagccgaattctaccagaggtacaaggaggaactggtaccattccttctgaaactattccaatcaatggaaaaagagggaatcctccctaactcattttatgaggccagcatcatcctgataccaaagccaggcagagacacaaccaaaaaagagaattttagaccaatatccttgatgaacattgatgcaaaaatcctcaataaaatactggcaaaccgaatccagcagcacatccaaaagcttatccaccatgatcaagggggcttcatccctgggatgcaaggctggttcaatatacacaaatcaataaatgtaatccagcatataaacagaaccaaagacaaaaaccacatgattatctcaatagatgcagaaaagacctttgacaaaattcaacaacgcttcatgctaaaaactctcaataaattaggtattgatgggacgtatctcaaaataataagagctatctatgacaaacccacagccaatatcatactgaatgggcaaaaactggaagcattccctttgaaaagtggcacaagacagggatgccctctctcaccactcctattcaacatagtgttggaagttctagccagggcaatcaggcaggagaaggaaataaagggtattcaattaggaaaagaggaagtcaaattgtccctgtttgcagatgacatgattgtatatctagaaaaccccatcatctcagcccaaaatctccttaagctgataagcaacttcagcaaagtctcaggatacaaaatcagtgtacaaaaatcacaagcattcttatacaccaataacagacaaacagagagccaaatcatgagtgaactcccattcacaattgcttccaagataataaaatacttaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatgtatagattcaatgccatccccatcaagctaccaatgactttcttcacagaattggaaaaaactactttaaagttcatatggaaccaaaaaagagcccgcatcgcaaagtgaatcctaagccaaaaaaacaaagctggaggcatcacactacctgacttcaaactatactacaaggctacagtaaccaaaacagcatggtactggtaccaaaacagagatatagatcaatggaagagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatgaattaaagacttaaacgttagacctaaaaccatagaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaagtgggcgaaggatatgaacagacacttctcaaaagaagccatttatgcagccaaaagacacatgaaaaaatgctcatcatcactggccatcagagaaatgcaaatcaaaaccacaatgagataccatctcacaccagttagaatggcaatcattaaaaagtcaggaaacaacagatgctggagagggtgtggagaaacaggaaagcttttacactgttggtgggactgtaaactagttcaaccattgtggaagtcagtgtgacacttcctcagggatctagaagtagaaataccattggaccgagccatcccattactgggtatatacccaaaggactataaatcatgctgctatgaagacacatgcacacgtatgtttattgcggcactattcacaatagcaaagacttggaaccaacccaaatggccaacagtgatagactggattaagaaaatgtggcacatgtacaccgtggaatactatgcagccataaaaaaatgatgagttcatgtcctttgtagggacatggatgaaattggaaatcatcattctcagtaaacgatcgcaagaacagaaaaccagacaccgcatatcctcactcataggtgggaattgaacagtgagaacccatggacacaggaaggggaacatcacactctggggactgttgtggggtggggggaggcgggagggatagcattaggagatatacctaatgctaaatgacgagttaatgggtgcagcacaccagcatggcacatgtatacatacgtaactaacctgcacattgtgcacatgtaccctaaagcttaaagtataataataataaaataaaaaaatagaaaataaataaaaagaaataaaatccaattttgacatgttaattaattaatctatttatttattttctgagatggagtctcgctctgtcgcgcaggctggagtgcagtggtgggatctctgttcactgcaagctccgcctcccggttcatgccattctcctgcctcagccttctgagtagctgggactacaggcgcccgccaccacgcccggctaattttttgtatttttagtagatacggggtttcaccatgttggccaggatggtctcgatctcctgacttcgtcatctgcctgcctcagcctcccaaagtgctgagattacagtcgtgagccaccatgcctggctgacaacatgttaatttaatatattaatatagtgctattgacgttattgattgacatattctttttggaaattcatctgttgatatactcagaaattcaacagcccagcactagattctagagaaagtggtgaacgaaataatctacagtatagtgcacgacctgaccagcttcccaagatgtggagatggcaggcatgagcaggcttgagccactgtgcttaaccatcccaaagctgttatgtatgctttgggatggttaattttcaagtcatagtgatttcgacaccttgcacatcccttttgttgctgatatgctggtttgctttcccttttatatgttcttctcattgcgccctgccatcataattacgaagttgatgaggatggctaacgtttgctgagtgcctgctatgtgctgagttctgtgtactgtgaatatatgaattcattcaggtcacacaacagccatatgagctggatacaattatttttctcattttacaggtgaagaagtggggtagaaaaacattaaataacttacccaatgtcctgccagtaagaaataatttagttgggattcaaactcctggaggtctgattccaggctgttgctcttaatgtctatgctctgtattctccccatggtgagacagttacattagtgtaatcgactcatgttatattttcttgttcgctatatctcctagcacattgccttgcatactaagcaatttgtaaatgttaactgaatgcatgagaaaataattactaagaataaaactttgtgcttgtggaggatattctttggagctttatctctaatagttaaaaaatgcagacaaggctgagcgtggtggctcacacctgtaatcccagcactttgcagggctgaagtgggcagatcacttaaggtcaggagttcaagaccagcctggccaacatggtgaaaccctgtttagtacataatttttgtatgtactaaaaatacaaaaattagccaggagtggtggtgggtgcctgtaatctcagctacttgggatgctgaggcaggagaatggcttgaacttgggagatggacattgcggtgagccgagatcacaccactacattccagcctgggtgacagagtgagaccttgtctcaaagaaagaaacaaagaaagaaatgcagacaagctaagcacagtagaggaatggctatataatttaccatctgccaatggaatattatatagctactaaaatcaatcattaaggctctgtagcaatacatggtgcatacctgtatgaaggctgtgtagtaagaaaagaatgcaaatgtaaactgtagtggttaaactgtaatctgaacactcatctaggctttacaaatttgtgggcatagataatgtaatgatcaaatcacattacgctagccaaaagcccttgcttgcttacctgcacccctctgtaccccctgcaagtgtttctgatgatccccaagggctgctccccagcctgctgaattacagggatggaaaggaacctgtggattgtgtccctcagccacctcatttttgcagatggagacactgtagtctacatagtgattttgaagtcttttaagattgttgccgaaggaggcctcaatctcaaggtgtttggtgtttctgcagccaacaaatgttgctgcgtttttcctaagggggacagagccttgaggtttaggaatcattaggagagagcgacaatgacagcatctgtgatgaagaatgtgaagtggaattttatgacatgcctaatatatggagctccttaggttatgcaaggtataaaactagatcaaaatagatagcgcacagcaatggcgaggttgatgataaatgaacaggaagctataaacaaagttgagatgatgaatggcctcatctcatctggtgtgtgtgatagcgcttcgtatctcctgggttataaacagaacatgttattgaagcatttactaatgcccaccagcattaaaaatttgtggtatttttggaattgttgtttgcattgaggttgatcttttctacttgttgaaatctgcatttactttaacattagcttgatatacctggtatttgataggtggcgatggaatgaaaatggtcttattaattttcaaagcaggtaacaaaaagagtaatgtcctatttgcttgaatgaactaaaccaatggttaaaatagtctttaaagtcagtgatgcttgaatggtatctcaccaccatgttggtttgttgatgataatagtcttggtagatcctgtggaggaacttccttgtaatgatgtctgtccacccccaacatttttgtaggtattaattagtatgtttctacatcttctggcatgctttattttccttttttctttttcttctttagagatggggtctcactgtgttgccaaagctggtctcaaactcctggcttcaagtgatcctcccaccttggcctcctacagtgctgggatttcgggcatgagccaccatgcctggcccccagcatgcttttatttgctgtttttaaaaagtcacctctttgtctagagcaagcttgtccaaccccagcccatggggtgcatgtggctcaggatggctttgaatgcggcccaacacaaatttgcaaacttttttaaaacatgagatctttctgtgattttttttaaagctcatcagctatcataagtgttagtgtatttaatgtgtgactcatgacagttcttcttccagtgtagctcagggaagccaaaagattggaaacccctcatctagagtttaaaactaatggttactatgaatattcgtgaagtcttttagttcttgtgatatataaaatagaaaacaccttcattataaaagaatgaaacgataatgtatttttacatctgatgtcaaataaatgcatatattcttaaaaaaaaaaccaaagagatgctcactgatggggagtgttgggtgcatctttaacttttttaaagcattttctctttggaactctgttgtgtcttttgcatgtactatggagaatactagtctcttctctcatatgtaaaagaaaatccctgtaccttcataatgattatatatttagtgagttttaagttaaaacttttagaaatttaattagaatctggctaatgggttatttaaaaatgtaaaataaggtttaaaaacccaaagccaagtgtccagtgcacattgaaagcgtatccaatagaagatcctgtagctatccttgtttttccccggttctgtgtcctgtgattcagatctgcctgggtcctaagttttaatctatcatttatattctttgtgtttaactctgtctacttttacagactgccttatatccttatggaaatgaacaggaatcgggcctgtgtctgtatctgaaacccagcttgtctccctttctccctgcctcttacactccagccacatcagctccctctcagttttggagcctttctaaaacacctcacctcaaggtcttcactcatgttatttgttcttctgtaaacactcttctgccaacttttcatcttgctgtattcttccccctttaggttcagcttaaatctcacttccttggacaggttgttctggatcaccctaactctggttttttgatggagtccgagtcagtataagttaacagacagataatcaagaattgaagataggcagttttagaacacaacaactgtaaatctccacattccatagggacaaaaccagtccacattcttctttcttggtcatgtgtaggactaggccttcctggttcctctgttctagctttagaagaaggtaactgtcttcttggagtccagcctttcttttttccccttggtgatgcataccgaatgaaaaggcaagcatataggtttggttttgtgtagcgtggcatagtttttttttttttttttgacagggtctcactctgtcactgaggctggagtgcggtggtgcaatctcagctcagtgcaacccctgcctcccgcgttcaagtgattctcatgtctcagcctcccaagtagctgggactacaggtacatgccaccatgtctggctaatttttgggatgttttaaagtagagacgggggtatgccttgttgaccaggctggtcttgaactcctggccttaagtgatctgcctgcctgggcctcccaaagtgctgggattacaggtgtgagtcaccgtgcccagcctaagtagcataggttcttaaagtgagcaatggtttgctgtagcatgtaattattatataacatatttgttatcctaaagcagaatggggggagaaataatgtggtaacttaactttctaaaaatattgctacccatcaccaaccagccctgcaagggatatcaacaaaaatgctgaaggcctttaagggaatattattctaatcagagacaagtgggaaagtcaaatcaaaatcatgtgtgtgtctgttctgcaaaaggacagatacgggttttccttcagatggaggtttgttttccctgctctgcctttgccacgataacttgaaatggtctgtctgctggcacagaaagccagggagcgggtggagtggccaggaccctgctgcaggaaggtcaagaacattcttagagtgccttttgggaaccagcagccgaagtatttttatagtcagctaagataacaggaaagaaagaggcagggtctgcctttttatggtataaatttttagaaaattcagtttgcccgcatttatatacaagtcatgaatatttgttcatctaaacaaggttccaattcgtggcacagaatgtgaatattattctgtcagcccaattacttgagtactgcaagttgttttacagaccaaagtgaatggtggaatacaactgaaacgcctgacttatttaaaacctccagcttgttgttcttccagcatggatccttttgctcattttgaccttttacagttgtaccgtgagatactttgagtgaccgtcacaaaattacactttctggagtaacaggctgaaggcctacctcttgttaattgcagtagttcccaggtgactctctgatgcaatatagtgaattatggtgatgaccagcaaagtatcaagctaacaaggttatggaatgtctcagccagcattctgcagttcaccttcctgtaatattttctaaaatatatgccccatggctagccttgtaaccagcgtaccacaagcatctcaagtcaaccttaacaataacgtactcttttcctcttgatgttctgaggttttatagaacttgggaagcacagatgatacatcactagatgatgttttgagagtggcatgaacttttgaaacagaaggaaactattcatagttgaatcctaaagtttgtaggtgtattttcaatttgtttctgtgatgtaactgactattaggtataaaaagactgcctgccacaaagggttcaatacatacttattgagctgagacaaagagctttatattgtcatttagattttagaaatgctagaactggagaatagatattttatttattattcataaagggttataaatactggacttttattggttgaaataagtcaagcagaaaccatttcctttataaccagagagacacagggttgttggagtttagggattattgctgtatccacgtatgctggtatagtccttgaaacaactgtgtggaggttatctcagggggttagaggtagatttaaatgaaactaagttcatgatagagttcaaagtctactgctgatattgggaataccttgtaaaagtcaattggttactgtttctttgtttaaaaaaaggtggtgttggccgggcgcagtggctcacacctgtaatctcagcactttgggaggccgaggtgggcggatgatgaagtcaggagatcgaaaccatcctggctaacacggtgaaaccccatctctactaaaaatacaaaaaattagccaggtgtggtggcaggtgcctgtagtcccagctactcggaaggctgaggcaggagaatggcacgaacccaggaggcggagcttgcagtgagccgagatggcgccactgcactccagcctgggtgacagagtgagaccctgtctcaaaaaaaaaaagaagaaaagatggtgatatatatatatacacacacacacacacacacacacacacacacacacagacatatatatgtatgtatgtgtacacatacacacacattgtattctagtatagattgattatagggagccctcactttgcatcttaaaaatcaatttaaaaatgatgagttctatgaccttaagaaatttttgccaaagcattaaaaatgttttagtgtaggttattaatatatagggaaatgaaaaaaatagtacagctaatatttatttagtacttgataatttaaaatgttagaaacattgagagttaaatgtttcatttctttgagtaaaacttgggaataatttcaacatgtttgcttttcattgtataactgatgatatagagtatttcttttcttttgtgtactgtcgtactcctttttgagtttgtacaaaacgttggaagctgatccaaagttgtgaaatacctgagagttactttaatgttaattcctttgggaatcttcatcctgttcattacagccaccttccaatttcacttccagtgttgtcactttgtatttctttgctatactttcttttttgttggctcatactgtctttcgattatccacttttgtaaaatgtcctgtgatttttatccctctgagatgaggagatggcagaactacctgctttgctgtttgttcctgaactgaataccagatgtgcagggaccaatcaccgacaggctttcagagaagtgacatgattggtcattggtcgtgatacacatctgttattcacatcatgatttgcgaaccaaagagctagcagtgaagtttgtatttgatgcagttactcagttaatataccttggtaagtgaagtctgaaccacgttgtcgggggactggtattatttaacaaaactacggtaacggaaattcatgcgtattggaaccataccaagtgaggagtgcctgtattccagttataaattctttgtagtacatttaaagctgggcctagctccctttgctttacccattacacactgagcctgtccagtgtagccaaactgtggtgcagaaaatcaaatcagagttgaactgagagtttcaaagtcattgattcaaccttggagtcagctttgactttctcttttcttacccaagacctcacagagtagtttgggcactaatgaaggtatttttcagaccccatccagcatggggagttttgacttgatctgcagcctacgccctgaagaaagtttctgggttgtcacctttgtaatttttccaactctctcctccctcctccactttctcccctcttccttggcctgctcttttcctcctgtgtcccatcatcaagttccactgattttccctccagccttacgttactgcatgtttctttcagttcctgttgccatcatcctaattatatgtttttcaacttgaatttcaattgctataatagtttcctcactgactttcccactctactctctctcctttccagctaatcccgcatgccatcactggagtaatcttcctggaacactcttgcagctttacttaatcctctgcttgaagcctccaaaataacttactgataacagaataaaacccaaagcccttatcaagcctgtaataactttctttgtctaacacaagcctccttcttcgaatttatcacctgatctcttcccttccctctagaacctgaggtttcagcaacataggtttactcattatctcccaaatatgcccaccacctctcctttctatgcattgtcttcctaaaatgcactttctgatgttgtctgaatcttgaccagtttcaaaaacttatcctaaatgatctctgctgtgaagtctattttaacttcctagaaatgtcttttctcctctgcagttccaaaggatttatatttcatactttccagttaccgcttatttgctgatctgtgtttttagttatgtgttatttaatttctccatttagcttttaagtcctagatgggcagggactgaatcttctataccatgaggaatggcatttgacagagtgataggtataaatctgtcccttccctcattcagtattttctgtttttttttttttttttagcatttcttctagacattgggctatgtgctagcagtaaaacataacaaggtaacttcctgacctcacagagctctggttgagtgaggcatacagagaagtagtcagtcagttgtaatgccataagatgcatggaatgatggatagtgaatcagatttgtggcagcaagaaggtaagtgtcaagcctagatgaggggcaatgggaatgcttctagaagtgaggttcaggcagagtctgaaagatatgtaggaatcaggtagttgacggaggccagatggaaagaatgttccaggcagaggactcagtgtggataaagctctggaagggtgagagcacactgaggaactgaattaagttccatgtagctgtattgtagagaatgaggtaagattgctaagtgtgatgagattgcagaggatccctgtaatgggcaaaaagttgacatctttggtgaatgttcaggagggaggacttccaggaccagatgtttgagtagataaaatgagggggcagcacccaggtgtttcttaaagatcgcttggtggatggaggtattggagggaagacgatgagttcaattttgaatttgaggtgcctatgaaatatgtatatggtgacacatagttgtagacaatttgaagctcggaagaaagctttgaccagaaaataaaaatttgggtgacatcagtgtatgataggatgaaatcatagagaaagagtgtgtagagtcagtgaagaagacttcaagaccaaaccttaacacacatcagtatataaagaacaagtaaagagagcagagtctgcaaagaatgttaagatggatcaggcaggaggaaggagcaaaataggtgagtgaggtgtcatggaaaccaagggaagactgaaatccatccattgggtttagaaatgtggaaaccattcatgaccctagcaagaatagtttctgtgtagaggaggggcagggaatgggaaaacataaaccggcccaagatagattgtagcgcattgagaagtcaacaaacaattatggtggaaagtttagttatggaggagacgatttaaagagggtagaagctggaaggaaatggagctgaggggcttttattataatattcttcaagctgctggaaatctgtgatgtttaaaggctgataggaagaattcattagtgataaagaggttgaccataagctaaaatagccagagttataactcctcttaaaattctttgcccagtctgtcctgttacctttcagtattctaaataagttaattccaaactaattttggacttcactgagatcttgttacacaagattgcaaattcctataaagtatgattcaaactattctacttatttgttctgggtagcatttagtgtcttaaatagagaaaattttcaacaaatattatttttattactgatttgtttctttattttttgagcaaatatatttaatttttaatttttgtgagtacatagtaggtatatatatttatggggtacaggagatgttttgatacaggcatgcaatgcgtaatcacatcatggagaatgaggtgagcaaatacttatttaatctccattgtatgccagacatttttctaggtgccaaggatgttaaggttaccaggccatacacactaccaggccatacataccccttgttctcgaggagtttatcatctagggagtcagttaatgaaataattatggattgcaaatggtacttaaaatggcatggtggtagacaatcatcttgagtggctactgtatatacacactcttttcctatgaacttttctttccattgttggagggagaataattacaagctattaaagagttaaatgacttaagatggaaagaaaaaggtagtcagtaacggagactacttttggcatagcgagtttactcctctgtttaccatttctaaaggtcatgggactctgatgcctataatgggctgtatgttttgcaggttttgttggttgatcattacttagcctctgagagactaaccaactctccatgttttctcttttcccttttagtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaaggtaagcttttttcattccgcccatttgccagacctctgttaacctgccaaacccacatagaagtcaaggatctgcgggtggccagggctggtattgaaacagaaaggagtacatgatttgtggcctgagaaatggcagtagagacagaatgtgggcccaggtatgtagctgcagtactttctaggccatagagagttagtgtctaggaaataagaaaataaaaaggagcccattcttctctagtgattctttaccaccaagagctaataaatgtgcatggtactgttctgacaaggcctgggaaatagaaagatgagcaagacagtgttctggcccttacagcattaataagctagtggatcgcacagtacctgctggtgaacttcacaattgaagaatgcttggttttagttgtaaacaatcatttaacctcactggacttcaatttgttcgtctgtagaggaaagtaaactaggtcacttggagctcaaaaattctatgacgaattcatccttttaaacctggcatttttataaatgcacacttttaaaaagggaatcatagaagtttactggctctaattctttaaaacctgagtccttgcatcaggagatgagattttgtttgaaagctacggaaagtagcttgttatagatataaaataatgcactttggtattttgtgtgtgtgtatgtcacaagaagcacaaaaataacaggtactgtattatttaagggtaagagaattgtgccttgtaaaactgggttttctcttttaatagaaacatgtaaatcctacaatttttatgacagaaattttatgagaaattcaaaaataatcaaatgcttgatctttctgattaacatttgataaaatttacctgcttagaacaagcagcatgaatttcacagctttatgactttggaaaagaatattttagtctcatgaatgtattactgttaaaagttttaatttctctctataattgcaaattttaaaaacatataaattcaggcttaatttttattttgcctgtgcccttaagaattgtgatggctggctgggcacggtggctcacgcctgtaatcccagcactttgggaggccaaggcaggcggatcacctgaggtcaagagttcaagaccagcctggccaacgtggtgaaaccccgtctctactaaaaatacaaaaattagccaggcatggtggtgggcacctgtaatcccaggtactcgggaggctgaggcaggagaatcgcttgaacctgggatgcagaggttgaggttgcaatgagctgagatcgagccattgcacatcagcctgggtgaccagagcgaaactccatctcaaaaaaaaaaaaaaaaagaattttgatggctatgcagcaaaatgctacacatgcatgcatgtttataaaatttactttcatgttttaaaacttttgatttgcctgttagttattcaggactaacaagttttcctcccaatctgttgtagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacaggtaaacatcatcaccgagcctgctttagcagtgtcttacagatatggtatcattttaacaagaaagccagacttgataaaaatgcttttttaaaaaaaaggctttgacaaactatgacttgtggccatatttttgtaaataaagttttattgccacactcatagccacacttattcatttacatactgtctatgcccattttcatgcgatgactgcagaattaaatagtccagtgagatcatatggtctgtggaacctaaaatatttactgtgtgtctttttacagaaaaagcttgccagtccctgatgtacagaatacatttatttatttatttgtttattgattgattgattgattgattgagttggagtctcactctgttgcccaggctggagtgcagtggcacgatcttggctcactgcaacttccacctcccagcttcaagtgattctcctgccttagcctcctaagtagctgggattataggcacgtgccaccactctcagctaacgtttataattttagtagagatggggtttcaccatgttggccaggttggtctcaaactcctgacctcaagtggtctgcctgcctcgtcctcccacagtgctgggattataggcatgagctaccatgcctggcttccagaaatgtttcaggaagtccatgattacctgtttctattttttcagttaggatgatctgtgtataaaatgtgtcaggcgtgagatatggtacagaatatatattccgcaaagatgcttgtaaatatttttgccttttgcagtagttttgttcatgagttttgaattcattgtgcaataataattcatgtcatctttgacaggaagtaatatttcatgttatcttttattttcttataaaaattcaggccgggtgctgtggctcatgcctataatcctaccactttgggaggccgaggcaggtggattacctgaggtcaggagttcgagaccagcctggccaacatgatgaaaccccgtctctactaaaaatacaaaaaattagcccggcgtggtggcaggcgcctgtaatcccagctacttgggaggctgaggcaggagaaccactggagcctgggagatggaggttgtagtgagtcaagatcataccactgcgctccagcctgggtgacaggagtgagactctgtctcaaaagaaagaaaaaaaaattcataacttgcaaggtgtagtgcatgagttgtttgaagtgtaactttaggcctacatttatatcataaagtgagagaaaggcaaaattttctttaaaactcatcattgaatgtgcatagcgaagacaacctaaaagcgttggttcctccactccattatgtggtaatgatggaggcttcgttctgtggtttccctcctgtcttttggttatgggttaaacccctcatgagaagactagatgagatacatttattattattcctctgcgatgtcttgaatattaaaaatatatcgtgtgtgtgtgtatatgcgcatgaaatacttgggagtaatagaactaattgtcactgctttagaaacctgggaaacacttttaggtagtaagtcaatggtaagattgtcacctttcttctaggagaaggaggggagattgtagacctgaatggaaggcagcatatgggaatggaaagagcatccttgtggagttgtaagaccttgattagagctgtgagcccagcactcggtaggagggaagtggcttccttatctgcaaagtagagataagatgtggggctcatgagactttgttaagattaatcaagataatgtgagccctgctttgcaaatattatagaacgatgcaaatattagcttagagaatatttatcaagatgagtcaaacttaagcagccatctactatgactgtttttatatcatgtgctttcagtaagataggggacagcatcgatcccacaaacacagccctcattggcctgtggacacctgaaatgcgactacaggggacctaacgtggcttttcattccccagttttgcaaatgcttttgggagaaggaacatcagtctaaatttagcttaaaagtaaagacaatgtttatgctaagggtagattttgataaggacagtggggctgaagataaactttatacacttcacagctttgcactgaactagtcttggagagggaggacaaatttcgtgccatttgcattgtttattcattccagcttaggttggtcatggagaaaggaaaaagcagatctttttaaaattgtgtgcccagtacctttctccccgtttccaagttggaacacagatgataaaaagcaagaaaatgaggcataacaaacttgttattcttgtataatattaggtgattgttaacaagaaaagatgaaaagatactattgacttgtaagcctagagtgtacaattgaaatgaattggctaattgatggagttacccaaataattaaaactctggaatacttttgtcttatctgcatacatctctgacttttggtctaaaagatccaaacagtgatctcaattcttaattcattttgcatgtgtactcactcatacacagcttcaaaataagacctgttttttggaaagcattctcagcatatatttattggtcttcctgttcatgaggaatgttgctggatgctaaagactgcccaattaatttgtgcaattagggtgaaccaggcatttaaaaaatacattactggcaaataatcatagtgtgtaggtgtatcctactatcctacaaaggattttgaaaacatttgtgctttcttgctgtggttggtttgcaaacgtagctatagccaggaggtataggtagattttaaatggcagataatccaaaacaaaaacaaaaccctggataaatgctcactgttgctttgctcagtggagccgtcttattaattgcaagtgtcaaacattgagactttcaatgcaatagttaccaataaacatctatgtttatatgttgctatgagaggtcatatacaaaataaatttggcagagatagcccttgtttctgtggcacattctaataattaggtagtaaacttgggattgaacaccaagatgaactgtgatcaacgtatttaaattcaggaaagctttgtagggtagaatttcagaactgtttggagggtggaggaaaatggatgattgatgaggaaaccaagctcacagagcagaaagggagagtaattgaacagaggaaagagaacagtacaagaaatgggcagggaagagttgtcagaagagatcagagaagtgaaatagcttgggattcttggcaggctattgcacaaatattaagcctcttaaatctgaggcatagtgcagtataaatgacttgctggcaaggtcagcgtgtcaggaagcccctttgactaagtgatcaactcagcgtcattaatagtggggcagcctgaccttatgtgcctcctgctgtgagacagtatagagtgcagaattacccatgaagtgttcttgccaaatatatctaacctgaatctaatcaaacccttagacttaaccccaagtttacagggaataccaagggtaaagaaacaagttaaaaacatcacactcagacagaaaaaacaatcagacattgacaacgtagggcattgttgcctggtttcttaaaaaaaaaaaatcagagtataaaagaaagtgagatgatgtttgtagaaagagacacaaaaaataagtgtaatatattcaccttaattaaatcttgattttttaaaaaaaagccagatctaagagatattttgggaatagttggggaaatttgaacatgagctctgtcttagtccattttgtgttgttataacagagtgtcacagactgggtaatctataaagaaaagacatttatttctcactgttttagaggctgtgaagttcaatatcaagatgccagcatgtgaccagggccttcttactaagtcaccccatagcagaaggacaggagaacacaagagagcaagggggagctgaacttgcttttataacaagtccactctggtgataactaacccactcccaagataatgacattaatgcattcatgagggaagaccctcttattaggtcccatactcctaacactgtcgctttcaggggattaagtttctaacacatgaactttgggggacacattcaaaccataggaaatgtcattagatgatattttggaattactagttttcttatgtgtggtaatagtattgggattatgtaggaaaatatccttattcttttttgtttgtttgttttgagatggagtctctcactctgtggcccaagctggagtgcagtggagcagaggtgacactgcaacctctgcctccctggttcaagggattctcctgcctcagcctcccgagtggctggaattacaggtgtgcaccaccacacccagctaatttttgtatttttagtagagacggggtttcaccatgttgcccaggctggtttagaactcctgacctcaggtgatccacccgccttggcctcccaaaatgctgggattacaggcatgagccaccgcacccagcaggaaaatgtccttattcttaatagatgaatgctgaaagttttaggggtgaaattccatgatgttcgtagtttacaggcacactttcttttactgcacctcacttccactctttgtagatagatattgtgtcttttactaattgaatgaaggttctggcagccttgcttataggcaagcaagtttttctgacagcatgctctcactttgtgtctctgtcacatgttggtaatttttgcaatatttcaagaccttttcattgttgtatctgttatggtgatgtgtgataagtgatttttgttactattgtaattgttttggggcatcacaaaccacaaccatataagatggcaaacttaattgatacatgtgtattctctgactgctctaccaactggccattcccccatctctctccctgtcttcaggcatccctattggctgaaacacaacaatattgaaattaggctaattgataataacacaatggcctttaaatgttcaagtggaagaaggagtcacacatctctcactttatttatttttatttatttatttatttttgagacagagttcttgctctgttacccaggctggagtgcagtggcacgatcctggctcactgcaaggtctgcctcccgggttcacgccattctcctgcctcagcctcccaagtaactgagacaacaggcgcccgccaccacgcccgggtaatttttgtatttttattagagatggggtttcaccgtgttagccagggtggtctcgatctcctgacctcgtgatccaccctcctcggcctcccaaagtgctggggttacagacgtgagccaccgagcccggccacatctctcactttaaatcaaaagctaaaaatgattaaccttagtgaggagggcatgttgaaagccaaaataagccaaaagctaggcctttgcatcagttagccaagttgtgaattcgaaggaaaagttcttgaaggaaattaaaagtgctactccagagagtacatgaatgataagaaagtaaaacagctctgttgctaatacggagaatgtttgagagaggtctagaaccagccacaacattctcttcagccagagctcaatccagaacaaggacctaactttcttcaattctctgaaggcttggagaggtcaggaagttgcagaagaaaaatctgaagctagtagtggttggttcatgaggtttaaagaaagaagccatctgcataccataaaagtacaaggagaagcagcaagtactgatgtagaagctgcagcaagttgtccagaagatcactgataaaggtggctacactaagcagccttatacctgaagaagatgccatttaggactttcatagctagagagaaagtcattgcttggcttcagaggacaggctggctctcttgttaagggctaatgcagctggtgacttttagttgcagccagtgctcataggctgttctgaaaattctatggcccttaagaactatgttaaatgtactctgcctgtgctatataaagagaatagcaaagcccggatgacggcacatgtgtttgcagtttggtttaccgaaggttttaagaccactattgagaactgatgctcagaataaaagattcctttcaaaatattactgctcattgacaatgtacctggtcactcaagagctctaatggagatgtacaaaaagatgaatgttgttttcatgcctgcaatcacaacatccattctgtagcccatggatcaaggagtcatttggactttcaagtcttattatttaagaaatacattttttaaggctattactgccatagatcatgattcctctgatggatctgggcaaagtaaataaaaagctttctggaaagagtttgccattctagatgccattagaaacattcatgatacatgggaggaggtcaaaatatcagcattaaagatatttaattaaattagatacttgaaaatgtcaaatcccacccttatggatgactttgaggggtacaaaatttcagtggaggaagtcactacagatatggtggaaatagcaagagaactcgagttagaagtggatcctgaagatatgaccaaactgctgcaatctcatgttcaaacttgaatggatgaggagctgctgcttatgaatgagcaaagaaagtgctttcatgagatgaaatcgactcctggtgtagatgctgtgaacattgtgaaatgacaacaatggatttagaatacgctataaatttaattgataaagcattagcaggacttaagaggactgactcattttgaaagcagttctagcatgggtcaaatgctatcaaacagtatcacttactacagagaaatatttagtaaaaggaagggtcaggtaaagctgcagacttcactgttgtcttattttaagaaattgccacagccaccccaaccctcaggaacccccatcctgattggttgacagtcatcaacatcaaggcaagaccctctaccagcaaaaaggttatgactcacagaaggctccgatgattattagcatttttaaagcaataaagtgttttaaaattaaggtatgtactttaaagcatagcgctactgcaaacttaatagacgacagtatagtgtaaacatgacttttatttgcactgggaaactgacagattcatgtgagtcgctttattgtgataataactttattgcagtggtcaggaactgaacccacaacatatctgagatattgcccgtagtttcagaggtattttacacacaagtagcacgaacttgactcttgagcggttcatatgcaggtgatcattgtattatcctttgaatatctcagtatattggaaaatattttagaaagaagggggaaaatattaaaatttcctagacttataaatagaatagtatattttaaagccgaatttaaaagctttcactgtaatacatttagagactttttagaaacaaacttaaagtttttaactgtttaatgggagtgttgggtgagtgtgaggtgacatgaggccaaggaagagaaattggccttgtgaaatgaccaagggccaatctaagaagtcaagttgaaaaaaaaggagatgactataggggattttgtgaggaatcaagcatcaggattgcgttacaggctgttgtgaagacaaggatgatgaagaaatgaacggttctgaattttcttctaaataaataaatgctaaataaatgctaactaaataaatgctcaccagagttgatttcttgacccttagcagggaggattgtgagaagatgagcaatgacatctttgttacaagcagcctcatccttgattaatattaggaagggtgtactcttaattatcagtcaaggaagtccagggtgttttcgagatggaatgctagagaattaatggagaaaattcagtgatcagtgaatagatttgctgatgatagcttaaattcatgaccacagaggacatttctttggattgcattataatgagaaaagagcgggaataatggagttaaaggtttctgtaatgttttctcaccttgacagagaatgccaacctgtagggaaaaaaacatttctattgttttgtttttgtaaaaagttacgtttagtatttcagagttctaaaaatatgtttaacaatcaaataaatcattggtgtttatgtgaattaggctgtctatataggcagtctctataggcatcactaaatctcctatattcaaagaacagaaattgatctcatagaactatatagggtgacagacaggagtggttttcttgaatataaatcaagtatgaagtagttggccggtcctaattttggcagagttaggtttctgtgctacctggagtaagttgtggtagtctacatatatgtgaaaacatttgcaagagtttgctcactgactgttagaatgacaattccagtggttacaatcaccagccacttcagggtaatctcatttttcacaggcttcaaacccgaacatttctgtggtagttatcatctctgaggagaggccaagtttcagaaaatacccctccaatttatttttgcatcataggaacattgaatatgttcatcttttttacataaaaatcaattgtataagggtgtcctttgtttttaaattggatctctttaacagtgacctaaattcaaagcttgtttggcatctgactttttgattgtttcaaacatgttttattgattgcccagttcctggaaacaaacatgtagtgacctagttatgccagatggtatgaaaaggccttctatgggaagcatttagaatcacagtatagagttcagggtccagcttccatgctgaacctgcccactgcctcgttgcacaagcctgtgctctttgttgaacccaggaacctgcctcgtaatcagacagaagcgttataaggggagacaaaaaattcaagtgcttcaagatttcctgtttcaagatgctgaaagatcagaaaattttacatataaatacctgagttaattaaaaagcaggtattccaggactctggaaaaccctgatttatacagcatatgttttaagtacagcactctaacacagataaagatgatcaaataacacatgaacccacttttatagtttgcaactataaaactcttagaaaatattttaaaaaccataagaaacaaacttttctgcatctattgagataatcaggtggtttttgtctttggttctgtttatatgctggattacatttattgatttgcgtatattgaaccagccttgcatcccagggatgaagcccacttgatcatggtggataagctttttgatgtgctgctggattcggtttgctagtatttttttgaggatttttgcatcaatgttcatcaaggatattggtctaaaattctcttttttggttgtgtctctgcctggctttggtatcaggatgatgctggcctcataaaatgagttagggaggattccctctttttctattgactggaatagtttcagaaggaatggtaccagttcctccttgtacctctggtagaattcggctgtgaatccatctggtcctggactctttttggttggtaagctggtgattattgccaccatttcagatcctgttattggtctattcagagattcaacttcttcctggtttagtcttgggagagtgtatatgtcgaggaatttatccatttcttctagattttctagtgtattagcgtagaggtgtttgtagtattctctgatggtagtttgtatttctgtgggatcggtggtgatatcccctttatcattttttattgcgtctatttgattctcctctcttttcttctttattagtcttgctagcggtctatcaattttgttgatcctttcaaaaaaccagctcctggattcattaattttttgaagggttttttgtgtctctatttctttgagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgcttcgaatgtgtcccagagattctggtatgttgtgtctttgttctcgttggtttcaaagaacatctttatttctgccttcatttcgttatgtacccagtagtcattcaggagcaggttgttcagtttccatgtagttgaacggttttgagtgagtttcttaatcctgagttctagtttgattgcactgtggtctgagagacagtttgttatcatttctgttcttttacatttgccaaggagagctttacttccaagtatgtggtcaattttggactaggtgtggtgtggtgctgaaaaaaatgtatattctgttgatttggggtggagggttctgtagatgtctttgacaaaattcaacaacccttcatgctaaaaactctcaataaattaggtattgatgggatgtatctcaaaataataagagctacctgtgacagacccacagccaatatcatactgaatgggcaaaaactggaagcattccctttgaaaactggcacaagacagggatgccctctctcaccattcctattcaacatagtgttggaagttctggccagggcaattaggcaggagaaggaaataaagggtattcagttaggaaaagaggaagtcaaattgtccctgttggcagatgacatgattgtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttccaagataataaaatacctaggaatccaacttacaaaggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatgtatagattcaatgccatccccatcaagctaccaatgactttcttcacagaattggaaaaaactactcaaaagttcatatggaaccaaaaaagagcccacattgccaagtcaatcctaagccaaaagaacaaagctggaggcatcacgctacctgacttcaaactatactacaaggctacagtaaccaaaacagcgtggtactggtaccaaaacagagatataaatcaatgcaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatctcttctttataccttatacaaaaattaattgaagatggattaaagacttaaacgttagacctaaaaccataaaaaccctagaagaaaacctaggcattaccattcaggacataggcttgggcaaggacttcctgtctaaaacaccaaaagcaatggcaacaaaagccaaaattgacaaatgggatctaattaaactaaagagcttctgcacagcaaaagaagctaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatggagccaaaagacacatgaaaaaatgctcatcatcactggccatcagagaaatacaaatcaaaaccacaatgagataccatctgacaccagttagaatggcaatcattaaaaagtcaggaaacaacaggtgctggagaggatgtggagaattaggtacacttttacactgttggtgggactgtaaactagttcaaccattgtggaagtcagtgtggcaattcctaagggatctagaattagaaataccatttgacccagccatcccattactgagtatatacccaaaggactataaatcatgctgctataaagacacatgcacacgtatgtttattgcggcagtattcacaatagcaaagacttggaaccaacccaaatggccaacaatgatagactggattaagaaaatgtggcacatatacaccatggaatactatgcagccataaaaaatgatgagttcatgtcctttgtagggacagggatgaaattggaaatcatcattctcagtaaactatggcaaggacaaaaaaaccaaacaccgcatattctcactcataggtgggaattgaacagtgagaacacatggacacaggaaggggaacatcacactctggggactgttgtggggtggggggaggcgggagggatagcattaggagatatacctaatgctaaataacgagttaatgggtgcagcacaccagcatggcacatgtatacatatgtaactaacctgcacattgtgcacatgtaacctaaaacttaaagtataatgataataaaaaaaaagaagaagaaaaaaaaagaaacaaacttcaagattaaggtctttatacatattctacagaagaaaataaactttatgtggattaggaagaaaggaaaggactggtagttgatgtggaatcctgaaatcattgtgaaaactcttttttcctttaattattggtcatataaataataagccttagggcaaaattgggttaaagtgacacaagaactgtttgggattctgttagagatgccagaagttgttccagcagttctgtttggacaggaaaaatggaaacagaatggaccattggagaacaagattatctaattgaagataggtctcttttggcagatatgttcagtaacatcctaagctctaaagcttagcactggaacacacacacacacacacacacacacacacacacacacagagcattctaaagggccaaatagatatacttagcttttgtttaaaaaaacttaaaagaataagcttaatggagaaattaacaggaaaatatgagctcattgaagtggaaagtatcctaattgcatggctgaaattacttttttttaaaagagtttcaatacttttgtcacaggactttgaataaagaaaaatatttcttggtttccactggacaaaagccagtaagaagctggggaaatagatgtgatgcctgccaactccacatgggagaaaaagatgggtagatggttgggtcgatgcagatgagatgggcactttggaaatcttttctcagtgatgagaaatggtgttcatttaggggagctgagacattgagttctgctcagaaacctgctcttgaatttccgcagtatctctcctgtcctggcaacgtgaatattactgggatgaagcctaaatctatgattacaaaacaaacaaacctagttttatcctgacagaagtaatgccagaattattgtaacacttttcacactggttattccctaaactgagtccataaactatgtaaatagattagaagtctaaagaaaaaaatggttataaaacatcttacttatgtggaaggggaactgagccaggctgggtcagtagagggcagaggtgaattgtggctctctcttcctccccatcgcctaaggccacatgcccttatggatagggccctcccaggtgatcttggaccagtgcagtggcctgccttcttttggaggagctgctgggcagtgactggggaaggtgaggctgaggctactagacatctgtcttcttgctgagcagagagctcagttggagtgtgtgctgattgcatttattgaagcttggcttccttgaggtggaataagtcattaacaccaggcacttcctatgccatctgggcttttcttcagtgtcccactcaagtactcctttggcataatctaagaaatatttaattgagtgttactgagtctcttgtggctctaaaatggctgctctctgtagccatccgtgccaaaccttacctgcgtcaacagctgaaggtatcactgaaggtgtcctacacatctcactgataggtgctgggacttttaagtgttagctggtcttgttccagcaacctctgccagattgactttcgcgcaggggccctctagcctggagtcaagaaagatcagcagagacaggggtaagatccaaagagggaaaatcaccgcatgtgagagagaacatgtctgcatgtcactgggctcctgccagtggagaggagaactgctcgttttacttggattgagaatgtagggctgggacattaggataatcaaaatatagattcttagaacttcagagaatgggttgtgacccagacgttacccttcctgcggcccagtatctggtctttacccaggtagatgtcttctgggaaccaaagaggctgtcagctttaagggtccacctgcccggacctgtttaagagaagcaagtatgtgtttcttcattggttctccctaagcccctcctctcagattttttttcattttattggcaattaaaatgcctttatcatgacgtggaatatcaaattaccatattttatacctctagggctctataaaataatatacctattaataattagactcctgttcctacataggaataagcattgaaaataataattatggagcagctcagagtggaagcatgttgagctacttctgatattggcaaagtggtaagattttatggtcactgtgtttgaagatgacagttctgagcatgttggaaatagttttaagagacgatggcttgaattgatggttgattttggctctatacattttaagaaatggtttcaggatttatagctggtatttctgggctctgatggtctgatgtggctctgtgctatccctcagaattgagatttgctaaaatgaggaagaatcatctggtttactaaaaaaatcagtcctctgaaatctgccccataaagttgtagtgagagaagcaacattttttgccgtatattgaagaggacagagttctctcctgaaccttctctaagaccatgatagtactgtttttttcctttctcatccttccattttttttccctcttctgtctcctttcttaaataaaataatttatatatagaattgaatgttctatttcaacaaggtcactgtatgagactgtgcatttactctagtgacactgccattgggcaaatagcttggacacgtctgtgaacaagatttgccaccgttgagaatatttaaagtatgtctctagccttgaagaacattctaaaattcaaaatattttgtatatttctaaatattttaaacaaagagagcaatgcctccaagatgatcactttgcagaagactggtttagaatctgcaagctctaacggagttgttaaagaatatggtcttaacattctgtggcttcaagataagcctctttttttttttctttttctttttttaagagatagggtctcactctgttgcccaagctggagtgcagtggcaggatcatagcatgctgcaagctcaaactctcgggctcaagtgatcctcctgcctcagcctcccaagtagctaagagtataggtgtgtgccaccatacctggccatggggcaagcctcttcgtaagacaatgcatttttagaaaactgatagctgatttgaccttcaaaacaatcaggagaaacatgaaaagtagacatttatgtctcccatttatttatgtgaaatttgaggctcagagattgggactagcttgtgttggtatttccaagacaatagctctctttccattttagcaaattcatcatatcttggccctcagtttcttcatttttcaaataattggattggctaaggagactaccaaggtgtctttgagccctccaaacctctatgatgatttctacatctttgctcttttctgcaatcttagacaccactggtgctgacatatgcacaggccatatggacagatcaatgtcaaacagagtgaatgaataacctatacttgtctctcaaatgctactgacttagaagactcgtctttagtatcagtttctctgaaaagctttttagtacttcttcaacccacacttctctctgttccttaaatctttattgcatttagaatctaatcagacaattttaaatttaaatattttaaagttgttgcttttgtgcctcgtttctcttcctcaccagcttgcgctttttataaggccaggatcacttatgaattgatcttagaactaggcacacatgaattgtgggtaaatatattagattagtctaggttgtgcttcagtaacacattagcacaacaaagtttacgttttgtgtgcattagacatgttagaggtgagcagaggactctgctctgcatatttcagggacttgggttgatagtggttccatcatgttactgccatgttatccagaatatatggcttccttaattcctacagcagggaacgagaggttctgcaaaggaccacactcattccctttcccatagccccctgttcagaatgagtcccatggccatacctattagtgctattgatggaattatgcctcccatccccaaattcatatgttgaagccccaaaccccaatgcagctatatttggagacagagcctaaaaggagataactaaggttaagtgagatcataagggcagggccctgatgtgataggaccagtgagcttgacctctctgttgctttccccacacacttgcacaaagaagagtccatgtgagcacacagccagatggcagccacccacaagctaggaggaggggcctcaccaaaaatccaccatgttggtaccataatcttgggtttccagcctccagaactgtgaggaaataaaaaaaaaaatctattgtttaaaccacccagtctacggtattttgttatggcaatctaacacatagttttggagctgggaaatgtggggaaacaagtggctctttggggaacaatggatgtttctgccagaagagtcagggcagtggacaagacagacatggttccctgcacccagggatctaaatgaacctgttagtgttatttgtggctttcagtttttctacatgacttgcaaccaaaccacaggtaattattagttttgagttctgtgtacttggaagagacacagaaaaaactgaaagcttaaccaaatgaggcatgcattacaatttcacatagtgctatgaggcctaaaatgtttttggttcctttgattatctctttatagacatgaagcttaatatagaagatttatctcaatatggttgtagaaataagcattggaggccaggcacagtggctcacccctgtaatcccagcactttgggaggccgaggcgggcggatcacgaggttaggagatcgagaccatcctggccgacacggtgaagccccatctctactaaaaatacaaaaaactagccgggcgtggtggcagcacctgtagtcccagctactcaggaggctgaggcaggagaatggcgtgaacctgggaggcggagcttgcagtgagccgagattgtgccactgcactccagcctgggcgacagagcaagactccatttcaaaaaaaaaaaaaaaagaaaaattggagaagataggcatttatgttcatcattttgggggtgatcaggttgctatggtgatagtaatcatggctatatgcacatctttattccctctctcaacatgagtctttctttttagacacattcctagtaattaaacttaaaataaattcgatctactcaccatctagtactaggatttatcacatgatttgtgttgttttgccccaaggaaaggctaacaggaattatgatgtcagaatataatcatgataatactgtacttaaattttctttttgcaacttaagagcaaaacacacatatcacagcctggaagaagacttgactgttgaaatgttcaaatcattgtagaggtggagaaaataggcagcacagattctatcttttctttagaaaagatgtcaagtagaatcataagtttcatgcttaagagggttttttttcccttcatatgtgactttaaaaaccatttttgccttagtgtaacttttaaaataccgtttcataaactaaagtagttgtctggaattccttgaagcccatggtttggcttcagcaggttttaaacaaatacactgtcagaaatcgatgtggatacatttccagcagttaaatgctctagtcacagtagatactttgtaaaatcaatagcctgaaatatcagaggattatagttgtatcagattccccaaatgcctaacattgttttaattactctaataaaagaaagctgagtggacttaaaaaaaagaaagaaaaaaaccttgcctataaagaatgttctgctcaagccaaagcaaatttttttacaagttctcttagaaaatctggaagtatttatgcattttcctcttcttatgagacaatgcctgttacccagccagttctgcattgtacagtgctctttataacaacgacccttagaacaagttgatcaaatatgttgctctagttgcactagcgataggggttagagatttagaactttttactttttgatgcatagaaataagcatatttaatgatctagtactgggacactaaagagtgttcatgagattttctagtttaatttggagccatagttgattcaggggctagaagaacaccattttgctcagaacattgtcaggagtcacttttccagagtggagatgtgtttatatcatagtgaaaagacagtttaagaggagcaaagaagaggaaagacgaagtttggattgatccaacaacctgttacatgtagtcagtacttttcccataggggacttcattctgattcttatgaaaagaagttcaagatttcaaaaaaaataggattaacattcctcatccagattcatagtattgatggtgtagcttttgtttactagaataccccaaggctttgtgccagaatgttagagtaatgtgcttctgaatgtggatggaggtgaggatggcacctgcatgggtggaataatttatgggacatacctgtacagtgtaggttgatggattataatgtgactttataatggtcacagcccagtacacccaagatctgcatttccatgaccatcttgaatcatttctgagatcttgcctattgataattatatcattcattatagctacccaatataatctagaatcgagccatttaagagctgtaactcttctcaggaaggtagagctgccctttgtgtgtacaggttagcaggaaagggctggcatgacgtagggtgaggaaaaggcagcccattattatggttatccttgattaggttggcctaggtcagggtatgaggataccaccaggcaggctgtggcagcatggaatctaatgtatcaacctggcaggcagggggcacctgaggaacaccgaccttcataggattgccctgccacgtagctccttggctgccctcagccctgccctggagctttcataaaatcatagaacttgggcacttaaatgagtattagcaagtagtctgtccttacaattttatgggttgatgcaactaacatccagagaggtagatcagtttgcagttgagtttgtgtgggaggtggggagtaaaactgaagattttagtgtctagtccagtcttgctactattttttttttttttttttttgagatggagtctcgctctgtctcccaggctggagtgcagtggcgcgatctcggctgactgcaagctccgcctcccaggttcaagcaattctcctgcctcagcctcccaagtagctgggattacaggcgcccgccaccaagcttggctatttttttgtgtgtgtttttagtagagactgggtttcaccatgttggccaggctggtttcgaactcctgacctcaagtgacccgcctgccttggcctcccaaagtgctgggattacaggtgtgagccaccgcacctggccagtctttctactattgcaccctgactcttaggccatttcttctagggatggaggattcacaagaaaccattgctatctaaacctgaaaggacagctatattctctgggacctgacttagttagagagtcgcatgctgtgtggtgttttgtgattgggccatggatccttgaggggaaggagcacagtgagctccattgctgttgcttcatggtcttggttctctggcaccaaaacatagcaccatgacaagtacgatcgtgatgtccccaaagtgaaatcatctgccgcttgaacgtcaatatttacaagttgaattattggaattccatgataccatgttgtgcttcttaagcagagttaaaatgaaatctatacaatgacatgccctccacagcattaattcactgagtatttctttactagccagagcacttttgagaaaacctgaatatttttagcaaggtcttaagaatatctttttcttttatttctatatctaacttacgtgtttattttatacatctcttatctgtaggctgaatctgggatattgtatatcgaataactactagattaattgctcttttgttaaataagcccaggtttttaaaggaggagcctgggggaagagatctaatacaagcccagtggggcttggccatatggctgtctcacatacagtccgtctcacatgtgttgtctcagtccactcaagagctccatgaaaaacggatgtctctagtgccattttatagaagacaaaataggcagagagacgttgagagttttgcctatagtcatggaggtggtaattggtaaagtgaagatgtgaatgtttttctattttcaaaagctgccctcttgccatttacccagttgtgggtcatccttacattgcttttcactgagttcaaggggaatgtggttgtgcagaaaagtctgtttcctgttcataatgtgctaatgctgcaaggcaagtagatatctgggagtttgctttgtgttcagaagtctttttgctgtggctggacagcatttgttgagataagatattattcgtgctgaacttaactcctttctgctgtttgtttgagaaaaagtacagtcaatgggcctccaatcatctaatttcaaatttttgtcctcttgttattcctgattatgtttatctccagtatagtttcttccttttcctccctgtgaatgatatactttgtcctggtaattcttttttacatttcaggggaagtactagatatagaacactttacctttataaaaacattatctctttctccttttcctcctcttcatcctcatcagtctttctgtacttaccattgtttcaaagatgctaattatttaattggaagcaatataaacttttttgctttgagaaaaggaactatgatgcttcttttcccctgtttcctggttgatttttatatccaactgtacatctaatctcaaatttggaaaaccctccatggtttagctccacatcttctctgactctgcacacccactctttgttccttcgtattgacctgccttcccctgtctttaccctcctccgttgccactggcttttctcccagctggtggttggtgttatgcttagctagagctgttccatctctttggaatctctctccccagtagagccattgagtcacttccttgtttcagttcttgcctaaacacagtcctacttactcttgcaagagttacaatgaatcagacttctgttttatttcatgttttccctcagtgcagtctctacaagtattttttgaaacctgtatcactttaacgttttgggttctctcctttggctctaaaagatgttctctactgaaacttaaaatattttatactttattatataatagtccttcatagcataataaaatgagttatatacatgtaatgaagacaattaataagagtatttcagtttatcattttttagtgttttaaatagtaagattaagtagtaggttcctgacatgtggctatctttatggagtggcccttttaatagttaaatatctgaagacttttaataaatgtgtcctgagagtttatcaaatggctagtactttaatgctggttataggttttacccacaccaggcaccagttgaggaggatgattggggcctggagtccagcccatgctctgctcatccaactccatgtcctgatgcaggtcacatcctacagctgcccttttctaatccccacacaggggttgatggagtcccagtatctgggattggacaagcatcatttaatctcacaatcctttggggttgggattactggctcagagaggttggatgatttgctgaacttctcactgctagtaagaagtttctgggatttcaatccaagtctaatgactccagtccagcactcttttcttaccaccactgctggatcctccttccccaggactctgcacagtgcagcaaacactcttggaatgagggtacgttgtaggcactataggtaccagcgattttaatacgtgaaaattaaatcttataaaaccttatgaaaccatattccaccatctatcacaatctcttcaaatcatcattcagcctctgaagcaactccagtggggagtttttaattgacaaaaattgtaatccttggttaccagataagttttgaactatctttcctctcacattgataggcagatgtaaaagtgtctatgatcacagcccaactttgaatatcagggaagtgctacagtattacctcaaaaatgagattaaagtctgaagatatgtgttcccagtcaggccaagatttagatacatacattaccctgcaatctgtaatttttgatgactagcttcaaaattaaaggtttttttcactattgcttataataattttgtgttgtaaatgtagtaacatggatatttgtggaataattgtaatgattcttgaacagccttaccttctgcatcacagtgttcatacagatgtgcacataggaagggttgaaaagttattttcatgcactcagtgttccaggaatcatgaccagtgcactgctgaatcaaggctgggagtagctttgtttgtttttcttccttttgccttatttgtataagtgctgtagttagaggcccaggcagcatgagcaactctagagatgtggaaatgagggaggaggagataagacaaaaggaggtggttaggaggccgtctgcctagacgcagtcctattatagatgtgagagcagcagaaacacttgagttttgctgtggtgtgtagtaacttgtatttcctagatgggataatgtaacctatcagtatgtagtgaccacagaaccttagaccttgcagaaatcgtaaaggtcatctgcttcatatcctgggcatccctgagagatgggtttccatggtcagctcctagtgaagtcagcatcttccactgttaaggagcattaactgttgaaaagatcttctgcttaatgaggttgaatccactctttctatgatttgtagcctttagtcctgccaatacaagttaagcatcccaaatccaacaatctgaaatccaaaatgctccagaatccaaaatgttttgagtaccaacataacactccaaggaaatgctcgttggaacaatttagattttgtacttttggatttgggatgctcaactggtattttcaaatattctaaaatctgaaaataactaacatctaaaatacttctagtcccaagcgttttagatcagagatcctcaacctggaccttcatcgtgcaacaggcttcctcttgctcagggtatctgaacactgccatcatgtctgcacgtagtctcaccgttccgcctttcctcagttgatccttacaggacctggttgccagaactttcatttctctgcttgcactgcttcatctaggtcatgcatgggctgaatcctgggacagctgtgtagggttgtagtgtcccttaatctgcagcccaaggttgtgtgagctttttgaggcactgtagcttgtttgacccaataggatttttgttttggatttgatttagctaaatattgggttgtaaatttagcacatttctccaggattacttattcgtaagacacatcctgaaatgataaggctttccatgttaatgtagtgaataattcacaaaggaggaattccatttgtgtttttaacttgtaaaacatcacctcaatctgtgcgtaaaaatatagttagcgtgagcctatatctgtgtgattacatctcaccagaaagcagaacctaacagtcatagacaaggattttctgaatgctgatctcatcctattccatgtgattctcttcagtgtggccttttggtgtgggagagagaagatctttcctctaccttcttttcctgtaggcatttcctacatccaggtgagaccctatggtgttcagtggtctcttgggtgagagccctgagtatggccacagagatctctcagatggagtttctggctgcacatcgaagcctcttcatagttaaataactgaagggcatatgtagaactttgagtcttgttataactgtgacttcatctcttgtagcttattcttatactgtgcagacccagtttcaagacacacacagtgttgtggtaccacctacactaccatttatttaaacaatttggatggcttatgctgctcttggctgtggacctgcaaaaacaaagccatgggataaagcggcctgaatcatgtaatgaaaaccttgtacctttctggaggccctgttgagaaaaaatgatttatttttgccctaccaaataaaacattctaggaatccaaggtgaaaattggattttaactgctactaacattttaagcatataaaatcagcaagtgttgagtgtttcgcttgattaggagatgaacctaaagagtccagtacaagaatgatctgcatatgatgtgaactggtgtcttacataaattttataaaactggaaataaaccctaagcatgctttggcagccaggttgcaacggtggggacctctgtgtttttacagaatcattttgttcccagtcttaggcctgggtcattgttcgcctttcctcccttcagtccttcatatttcagggttacacgttttgtgattaagctcaaggagtatggaaactacctgattccagccccaaatatgtgcctgtcttctctaaggttcccgtttgttctcacgttggatctgtctctccctcttcttctccccactctgcgtgtacgtgcctgtgcatgtttgtttcgtcatctctgtgactacctacccacctaccactttatcactctttttttggtccagtcttcccccgtgtctgagactgttcatctgtggccctgccgctgttccaacctcggggactttccctcactgcacgtggttaaacactttgctgagagccctgtcttcaaacagacttccccaggtcattgtgttggtatctggcacacaacgtcactcattgtttatccagttgtgttgttttataagagagtttctttatctcaaggaatgcgtgtcacgtgtctgcaggagttactgccccggtttcaagagatgtgatggtcttgggctttactgacttacactagggcttttttcagtgccttccccagaattacgtgttttttcaagttcatctaaaaaaaaaaaaagcaattgttttggtatgcctagttttgcttaactcagaatgtctttaacacctgcttttatattagggaagttcattttgtctcgtagggtcgtttcttatggagtctggtactttcgagagggcaattagactaacctgtttgattgacaggaccgtttacaatctactccactcacacgccttctactccctggggaatccgacaaacatttggggcctcaaatgggacatctggagtagggagcttttatctataataataataataatgataatggtaatgatagctgacacatgtaagtgctcagctataatgttcagcattgcacatgccttttttctttcatgtttcatgaccctaggagaaagatactattatgcactctacgttatgggtaggaaaatgtctaagataatgcgtgtaagaagtcctacagtcagaattcattctcaggcctctctaactcctgagtcacatttttaatcactatcatatactgctgttggagagcacacagcatcctgttgaaatcattaaaaataataaaaccttagaacatcaaagctatgatgtaactaaaacttagctgagccttctgtggtttggtcttgttttacaatttggatatgtagttacttagcgcctcagtcagaatgttgcatgcttggacctggcagaaaagaaacgctgcccctggaggcctgccaggtgactggtgtctactacttgctgtccttctgagggccaccacctgcctggaccttctgtcaccacactctgctcactagcctggggtatggatgctaaacttccattggttttcttttgttttttgttttttttttttgagatagagtctcgctctgtcgccaggctggagtgcagtggtgaatctgggctcactgcaatctctgcctcctgggttcaagcgatccccctgcctcagcctcctgagtagctgggactagaggcacgcaccaccacgctggctaattttttgtattttagtagagacagggtttcaccatgttggccagaatggtctcgatctcctgacctcgtgatctgcctgcctcggcctcccaaagtgctgggattacaggtgtgagccaccatgcctggcccctccattggttttcacatagccattgcttgcctggatggcctacaactagcttgttccttagttccctaggttgtttgttcctttcttcatgcagcgtttcctgagcatttgcaacgtgtactgtgtactggaatataaacataagatacatacgcatttaacaaaaatgcatctcagaggcagtagactgtatagacagtgctgtggggtaaaaaggagggaggaactcattggaattaaggagataggggaggtttcatagtgatggttcttcagagctattaatacatctcatgggttgaataaagtttattctgggaaagaaaaaaggggagggtgttccagccagacatgctccttttggaaggacgtgatttgttcagaaaataaagagccctttggtatgtctgcaggatagaggtggatggggacaagagattgccttaggtgggaataggaaggaccttatagatcattctagagtgtgccattttcagacaatggagagtcagtgaaagtttttaatcggtaatgtgaccagatttgtctttggaaagacaactctggaaactgttgggaggatttttgtagaggctgaggcagagaaaggcagaataaccccttggatgctctgtgtttgcacaggagacaaaaatgtggggtgtgttagcctgcatagcaggggtggagagtcagctggtcctcccctcaggctggcctttggatgggtccacagagcaggatctgttttcttaggcacttcctcaccccattgaggtggtctaacttcaggcccctgcctctcagctttttctcacttcctgtggttgaccaggagtcttacctggtcttaacactggacaaccagtgttgcaccagtagcctctaagtcctactcttctgcctgctcaagctggtctcgcttaaacatgctggcaccttcctagcttggctgacctccctgggtcagaatacttggctgcctggagccttcgtctctgctagagctgatttggcccagccagtaattgtttcttctgtcctgtctgtgcccaggccttggggttataggaagaccagaagcctcctgtaggtgggacctgtgccatcttctcacattttacacacatgccatacccttaagagttatgttccctgatggtccacacaagagatttaaacagacagatacaactaaaatctaaaaagcctatattgatcttacacactatgaggctcttattaagaaaaaaaggcattggaaatttaagttttatgaagtactctgagcagtgacagattttcttagactagaaaaacatcaaggtgctcccatttggaaatgtacttgttcatttttgtgttgtattgatttctgtccaggtattttctttccaagttttatagtttttttcctttctaattgtgtcgataacaagggaactggtttatagcgtggctgtgagggacagcagtgctctggggctgggcatcctgcactcaattaaccttcatatttcacacctaatcattgcagtgtggcaaagcgctccctggcctttcaaagcaagaggactgctgtggaactgtgggtacctcctggggctttaacaaatgccagaaatgccccaagaaaccatgtaagtaatgtttcctcactcctttgcaggttaatgtagcatatctgttttttatgattactcctttaatgatgaggcaatattagactttcaaagaactctcctactgaattctagaatgtagtactatgatgtgcatttccagaaaatttgcaagtctgaaaaagttttcatgtcaattattttgtaataagcacagttattaattatcctctttagttggattacttatggggaaaaaaagtcttaagtggtaatgagttaaaatggactttttgtctcaggggaagagaaaataagatctcttttaaaatggtaaataaatgtttcaaaccctgtaaaaagtacagttgttatttcctaggtttaaattccttaaatgagatttttattaatgtccacaacttatgttgtagtttttgttatattatcggttttcaaatttcattaaaaggaaagctaaaatggagaaataattggttgttgatttgtaaaagagaaatttataatcactaggacacaattctttcccattttttctgacactggttttatgctgtcacagacctcagcaacattaatctatattaacacccccaggctttgatttgcttttattgttcagaacatgttgatttgaataaatcagatttacacctttttaatactctattcctgacaataatttgtacctttagtttttcaatgtagtattaactctggataactgatttctaataaatacttttttttctttttgagacggaatttcactattgtcgcccaggctggagcacagtggggcaacctcggctcactgcagcctccgcctcttgggttcaagtgattctcctgcttcagcctcccgagtagctagggttacagacatctgccaacatgcccagctaatttttgtattttcagtagagatggggtttcaccatgttggccaggctggtctccaactcctaacctcaggtgatctgcctgcctctgcttcccaaagtgctgggattacaggcgtgagccactgcgcctggccataaatagtttttagagacagaggtgactgggtttaagttgagctttctgacccttattcatcatgtttttgccaagagagcaagtgatatttttgtcagtcatctttctttgcctcatataactgaagtttttataatttttttattctttgtactgcaagaaatttctcatttgctttaaatgaataatttttgtttactcctcttatctgttgatttgattgtattctcaaatgccttttaaacctctatattcaatctaggatttgccatctgggcattagtattccatatctctttcttacattatttgttcttctaccagtataacaattcattttaagtaattgtctctcatttggacttctttgtctcacaaacttacagattttctaaatgcctaaagcaagtaattttatttattttgttgatactactcatctctttttagaagactaacttgtggaaatgcccaccgaagttcctcataattaatgaattcttcatttacaaaaataatccatgtaaataaggacattttcagtactgagagaattttccaagcagatgttctaagctgattcgatgatcatttgcaatgcaaatttccaggaagtaggttgagtgtgatggttcatcgtcactggaagatccatttgcttaaaattattttggcaacctgaccaaagggatagctatgatgcatttggtttgatttaaaaattttagtgtttgaagttaggtagccctgagttcgactcccagctctttcatttgctattgagtcttagagctcattaagcaggaatctatacctaaaacgttgaagaggcgttgccatctttttttttttaaacctgcctctttgtttaccatgtctgtctgtctgtaggaatattgaggaggatgatatattttccactgtttggtctaagaattaaggatgagggaagttaggttcatagaactttgttttggtcctaagtctatgttctctaatattaaataccttccccatctgtcttatttttctttttcattttcatttacccccttctttgtgtatcttttgcttagctgcttctcttctcttgtgtccaaaccccaaagtagcagggatgtgatagacattaaaggtaaagagattcctactgtccttttattttttttttaatccctaacttccactcttgaccttttgtcgtttttgtctagaattgcgtcatttttatctaagatgagttcactgatgtctgtggtttgtgagctctgtattttaatcttgataaggacttagttgaatgtgaaagtgcaaagttgctgtcacttttaactaaatgttggtgaaaaaaatccatatgttggctcatttaatgtataaaattgaagagactgccttcacttcaggaagggcaatgtggactatgaatgaagtaaactgttaacatcttgacatttattctgtttgtgtcctcttaagtgactcactcccaagaaacacactcagggtcacattcttcctgtgtcatttaaaaagttttcctttccttggttgggactcctctctaaatcatattcagtttggaaggaagcagactttccttggctttctacgctatggttttgtgttccacacctcttttttttcactcaaactagttcaaactttagttttcaagtggcttttatttaacatttgaagtttttgtttagccacatacagaaagacctttcattgttgatcattttttttgctgtgaatacttaattttaaatctgcaaatgatttcttaaatagtttgtgacccattagaaatgtgcctagcatgaacaagtcacttgtcctttaaaacttttgagaagaaaatgaacataaaatcctaagctgaggaggactgtaagagattgcctggtctggctctctgccttcaagtagatgactgctgaaagttctaaaacaagttcatatccatctcttttgactttgaggaatttgcagccagagatcccacagtctctgcaggatgcctgctctagaggtctatgggacaagacagacctgaggccaaggagctgaatggagggactcccacacgcccatatctcccgtcttttaatttgcctttcccagatgcctcactctgatcttctcttttaggcattcgggggaatctgaagagaggggaaatacagcaaagaaaagaattgaaggagaagagggacaccccagtacatattcaccctgttcctttagtggtgacagataaagagcatatggggaggctgaaataattttattttttaagagaaaatttccctttttattttctactttccccttttactcctctttcaagtcttttttagtggtttaatctttcatcccattttgattatagcttgttttctgttgcacagtagcctcttaatagaagaattccttactgcaggacatagcaatggcatttgacactttgggagtgcttatcacacttaggccctgtggtaggcatttttcatgaattatctctaaattgcagaagaattcttccctgctcagtagatgggaattaccctcattgtatagaatttctgtgtgaaacccaagaggcttgtttcccaaggtcacagctattgataggaagaggatttgaaatccacttctgccacatcccagaactttggctgcatccgctatgccaggtgctctctcaagtctcactctagagtatcagaatctcaggaaatagggttttgttgagaagttggtgattgcaacatttgtattgtttgcatattctgagtgtagcccttttaatttcctgacttcctctcatcacctgcctattcttctctggttcataatggtgagaatcatctcatgactgggatacccgatccagcaattaggatgagtgtataatttattgtctaaagtgggacactttggggagtaaagtactgttaattaactttgctggaataacagacatcacccagaatgttccaggacgtgtagtaaccctacctacaatggataagaaaatccaaaacctaaagcacatcaatggggaggaatagatcctttgtgatggaaatatgtaatcactaattagaagaaaatgtacaacaatcttaggattgtttcagttaacgtaataaagatttactgataatttcttgggactttattgcaaaataagtatcctgaaaaataagcagaatgggaaaaaaattatggagatatacattggtattggtttcttatattaataaatgaataagtaagtttgctgatgccttaaatggcttcagatatcacttacactagtctaagattgtaagaatttaagtatgtaacaaagcatttcttcccttacagcttatcatggatacaaccaaatgatggaatgcctaccgggttataagcgggttaacaacaccttttgccaaggtaagactaactgaattcattgatgtggactcaacagttgttttggctttttagaaacttcagttgtttgccacggcttgctcattcgcccagcctgtcacagtgaaccacctcatgttcactccttttggctaaggaaatgtaaggaaataagtttaaaatatggttattggaattgctttactaccactgaaacttgatgcaagtttttaatctaaaagagtttggatagaatttaaaagagtttggatcacattagagagcacactgtggtttccatgctagtcacctcatatcctttcatgggcgtgtgcacacatgtgcttgcaggcacccacatgtacttagcagttctacttcattgccaatgcatggttgggcaacagaattcccttttctcctctcatcaaaatgttgttggtcatctcaggaactagatatcagagtaaacacattttgcctaggcaataagaaaagctatgtagctaagtgtgaaatgccctgagtacttttgtttggtttatgttgaacagtacagcaaagttgtacaagcagggggaagctaggagattgtctggtacagtgtctactttataaatgagaaaactcaagcccagagaggttaagtgactttcttgtggcagcatagagctgagattataacttgagtttaccaaggcctagtttagtacccatatatgatatcatattttgttttagttactttatgggaagaccaatgcttctaatttccctttacatgtctaggatgaagatgttgttattagtaacttggaaatatgtatacattgaaactgagaaagcagagagcctcccagagtctgatagaaccaaaagccatgttgagaacatggcacatgtcttctgatttgtgttctgaggctctgtatccttcaccaccatatgtatttaggatacagtagattaaggtcatgttacagagtataggttaaccccctattcaaatggctcatgtcaaaggaatatcttgattacctgagaattttctcaagtagattgtctatcaccctattcaaatggctcatgccaaaggaatatcttgattttttatctgagaattttctcaattgtctatagtgcatctgtgtaacttttatgatatgtagagtctttggtaacataaaagaatttatttagaaatgcacatacagtctgtctttgaaagactttgtcttaaaaatattgtaagccctcatgtgtcacagaatgttgagaaaattagaattaaccacttaaggagaggacacccatgacacattttgagaaacatctgctaaacttagtaacatgggaatagtggattaatctacattattttagagtcagaatttaaggtatcattgaattaattagatggatgaatgagtaggttaaattaaataatgaatagattttaagatgcatgttttacaatataaaccaagttattgttttatagatttggataaaagtctatagccttagcacatctgtaggatgcattagtagaaatggaatgaacagggcagtggaagtaacaaccttgtacactgtgcccctcagactgatttggggtttgggtgttcagtgttcattattgtcttttggttaataaagtcaaccaagtttgtgaaggacctagaaacatgagtgtgtttagcacgcagaagtacagactgaagagaaatattatggctgccctataaacacgccttaaaatgtttgtaaacaggccactaaatgattaactgtcctacaaaacaagacatacctaataacaggggacacttcaggaaactcggtgtcgaggggctaaaacttatgtgaaaggctgagacgtaattcctttcttctcatgcacagtctctgtcccaggggactgatggtaatgatagcatcatagaactggaatgtgcctatgggccatctaaccttatatgctgttcaggataaaaatactcttatcatatccctggccaatagttattaagaagctatcagatcacctctgtggacaggaagctcagtacttccaaagacatttcatttcaaggttgttggggaactctattccacagaaaaggctttcttgtagttgttccgttaaactagaggacagaggagggtccttatttatccttcactaatccaatcctgcatagctaattgttagatacattttccagaatgtcagatgctcctaatttctcttaatgtcaaatggataaaatatacatatgttctcttggtatggtgtgtttatttgtttgccattttttaccattcatagatatttgaagacagaaggcttactctctcttagatagttttatggtgttatttcttccttacgtatttagcgtaattcacaggagaagacatttggtcctgaagttttcttttagaaagtgtttcggttatggagcaaattaatagctatactattattcagatttcccattactactttgtgtcagttttaataatctgtattaccttagaaagtgtcattttatccaaaatgtcaaatgtattaatatgaaatgttttcctaatatcctcttttctttttaatttatatagcaacccccatcccttttagttatattgctacctgtgctatatttgtttttcttgaattaggcttgccagtggtttatcaatgttaccaatttttcccccaaagaatcagttatttgttttgttgaaaacatttgtctatttcactaatttctgatctttgttttcttttcctctacctttttgttcaattgctactatttctaatttctttagatgcatacttaggtcattgatgtcagcctttcttctttttctgaaatgtaaataaaaggctgtaaatttctatcagtctagattctgactttaactgtgtcccttaattttgtgtcattttcttatctttaagttcaagttttaaaaaaatttccttttattttttatcagcatataataattgtacatatttatggggtatgtagtgatgttttgatacttaaaatgtatagtgatcagatcaaggtatttagcaaatctatcatcttgaacatttataattggaacattcagtgtatcttccttctacctatttgaaactatataactacaaaacactagaacttattcttcctatttaactgttgtattagtccgttttcacactgctgaaaaagacatacccgagactgggcattttacaaaagaaagagatttaactggacttacagttccacatggctggggaagcctcacaatcatggtggaagccaaggaggatcaagtcacatcttacatggatggcagcaggcaaaagagaacttgtgcaggggaacacctatatttaaaaccatcagatcttgtgaaacttactcactaccacaagaacagcaagggaaagacttgtccccatgattcattacctcctaccaggtccctcccacgacatgtgggaattcaagatgagatttgggtggggatacagccaaatgatatcagctgtcattttgtatcttttaacaaatctatctttaactttacctcccctctacccttcccagcctctagttatcttctgttctactttttacttcagtgagatcaacttttttttgcttccacttatgagtgagagtatgtggtgtttaactttctgttcctggctgatttcacttaacataatgtcctccaactccatccatgttacacaaatgacaggatttcattcatttttatgactgattagtattctgttttgtatatacaccacattttctgtatccattcatgtatttttggacacctaggttgattccatatcttggctattatgactggtgctgcaataataagttcaatttttaaaaattattctgattttgttattgacccatggattatttagaaatatattgcttaatatgcaaatacttgtgaaatttttcttgttctatcagttgttgagagaggtgttaaaattgcctgctacgattatggaatggatttttttctttcacctctggcaaatttcagtctgtgtttttttacctttacaatgggtgtcttatagacaacatgtagttgagtcttgcttcttttctacattctgatatctctgcctcttaataggggtgtttattgcagtataatctaaagtaattgatcctggcataccccaaagttggggcctagcctgagagggtttttggctctgctcaggaaagaattcaaggctgagccagcagtgaaagaaagcaagtttattagagtagcaggtacagcagaatggctgctccataggcagatcagggctatcccagaggtggggtggcccagcatagtagcagcagcgtacagcaacagtagccatccggagcagcagtccctgtaaattgctggctagctatatttaatactcactcttaataatatgctaattaaggggcaggttatttcgaattttctagaaaataagtggggagttcttggaaccacgtaagataacttctgggtcactgtcgtggcatttgtgaactgtcatagtgctggtaggagtgtctttatgctaatgagcagtgagggtgactagaggttgccttcatggccctcagttggttctggccattttttctgctacagcctattttgattagcagggtcatgattagtgctcagaaaataagtcctgctgatctcctacctcataattattgatgtggttagatttaggtctatctaaacatctttgtctgatcaggaatttttttgttcttttctttcccttttcttagaattccattttatctattggctttttaccaatatgtttttgcatcattttaccttttttttttgtcttttttttgagacggagtcttgtttgttgcccagactggagtgcagtggcatgatctcagctcactgcaacctccgcttcctgggttcaggtgattctcctgcttcagcctcctgagtagctgagtagcaccaacacacctgactaatttttgtgtttttagtagagatggggtttcaccatgttggccaggctggtctcgaattcctggcctcaagcaaatcacccgtctccacctccagaagtgctgggatcacaggtgtgagccactgtgcctggcctttttgtattattttaaagggattactctaggaattataatgtatgtagtaactgatagaccgtttgtattataattcctagagcaatcaggaatttgacagtttaagttttcatagcctatttagagttaacatagtacctctaaacagaaaatatagaaatcttgcctccaagtagctcctctttttggcctgaaaatcaatcccctacttatgccccatgccacacccttagtgaaaaccaccatgacagtctcccagacagtagtaggatttcctcttactctgtgttggaattatttattcacattatatgttgttgttcacctctttcttttcctgacaggctgatttctcagacatcaaggacccagtcttactcacttttgtgaacccagaggcccaatttttaaaaaatagatttgatgtggatgaagaaagggttcatttgttattgatgagataagaagctcttttttttttttttttttttttttttgacagagtctcgctctgtcgccaggctggagtgcagtggcataatcttggctcactgcagcctctgcctcccagattcaagcaattctcctgcctcagcctcctgagtagctgggactataggcgcgcaccaccatgcctggctactttttttatattttcagtagagacggggtttcactgtgttggccaggaatgtcttgatctcctgacctcgtgatccgcccgcctcggcctcccaaagtgctgggattacaggcatgagccaccacgcccggccaagaagctcttattatagctttattttatttggtccagtaccaatgacttacaaataaaaccaacatatttgtagtgattcatgataaactatgtttgtaagcccagaagtcataaacttataaagagggaaataaataatgaattaatttgattttaataactaaatttactgtgtgccagatgctttgtttaataagcactttatatcagttatctccattagcctttaagttttctatttaaagtaggcactattataccccattttacaggagaaattgagacctagagaggctaagtcatttgtgcagcatattgctaataagtgctacatgcaggaattaaaccaaggtagaatgaggccagaacttatgctatcaaccgtcttgttctgctttagggaaagggaactaacctttattgatcatttactatgggttagtccatatgctatgtacttggtttaatcttcaaaacaatcctatgagatttgggcattattattctcaattagacattgagacacagagaaagtaaataactttcccagggtcacaaagatagttaataagcccaaccagggttataccctttttttttttttttttttttgagatggagtcttactctgtcgccaggctggagtgcagtggtgcaatctcggctcactgcaatctccgcctcctgggttcaagcgattcccctgcctcggcctcccaagtagctgggactacaagcacacgccaccacacccggctaattttttgtatttttagtagagacagggtttcaccatgtttgccaggatggttttgatctcccaaccttctgattcacccacctcagcctctgaaagtgctgggattacgggtgtgagccactgtacccggccctaaccagggttatactctcataccacctatggccacctttaccaattatatatttgtttatattttgtaaaatatcactaatgcagatactagctaattagaagttatgccatctgttgtgagagctaatagaagtcaaagcaattaatattaattttgttttatttcattaaaaagtgatggttatcagccagatgtaatggctcatgcctgtattcccagcactttgggaggctgaggcagaaggattgcttgaggctaggagtttaaaaccagcctgggcaacaaagcaagaccctgtctctacaaaaaaaataaaataaaaatttgctgggtgtggtggtgcatgcctgtaatcccagctactgagaagctgaggcagaagggttgcttgagtccgggagttcgaggctgcagtgagctatgatcgtgccactgcactgaagcctgggcaacaaagtgagaccctgtctctaaaaagaaagaaggaagggaggaaggaaggagagacggagggagagaaagttgtacaatacatttcttttactggctgattaatgttttgaataatttatattaataaaaataccactttagaagtgatagaagtgcaaatttgcaagtaatcacttgctatctattttgtatgttagaatggagacttattcaagtaattgcatgagtttttttgcattttcctctgtcggtacggctgactgacccttagcaaactttgttcatactgagcatattagatggttctgccttagtcaattcgctgatggtctactggtaacaccaaatcctggcttaggtctctggaggatatttgtaaagcagtgttatactttttggcaatgattctaaagtgaagtaacacacaaaattctatttcatgggtcctcaaggaggcactgctaaattacattacaaaggcatttgactcataatatgatttcattcagtaaatctattgaaattactattgagagaagggcttaatttcactccctttgtgatattgatggtcagtaaaatgaaatcgaacttgctcacattacatatgtacattcagttttcctagaaccttgaagctttttgattttgttttcctaaaggttttcaaaaggagcccatttagcatctaattgcttgtgccttccacattgttcttacagtctaatgtcttctcagtttacaaagcacttttaaaattaaagtggttaataactagaattacattatttccttcaactaagtgaactaatgtcctgaaacaacttttactaatgtgcactcagtaacaaagaaccaactgtatacatgttaatttgaggagctttcaaataattgccctcaaagttgttttttttcctcctctctagtggtgctgcaattatcttttcaaagggatgatttattacatatacacacatggagctccaaaacagccttgctactctcagcattatggaattgttataatttgcttcatttatcataacaaacaatatagttatatgctctgatggatctagagcagcatttgtcatttgattattatgctataaaggtctgatgtagaactagaattaaatgaaataatactaagagctcctacgtccatgctgcttttctttaatactcagtccttccctgagtggaaatactgagtaccctcttttgtccatattttgccataagtgggttcttaaaaagttagatgtaaatctaagtttcaaaaatagaatttggttctgaaagtacttggggaatcagtctgttgagtgattttattaaaagcaagtatctcttttgacataccaaagtcacttaccagtttcagtttacaaggataaaatcaacttagtattatttgctacatttttggcacgtactgtgggcaataccacagtacctcagtacgtgctgaatgtaattaaaagacatctacacttttataattcagtgtatgtatattcgtttttcatagatcatctcgaagactttttaaatgactcagtattccacaaacattaatcgctggggcactcctagctatagactgaaagtatgtgtgatgaatgatgggtaagacattgttcctgcccttagaatttagtgtaatgaaatcactttgaatgagcaggatgcaatgtgctttatttactcttcgaactagctgaattttagctggctccctatgagcccgttaaaggaaataggaaagagctagccacataactttctttcagcatcgttttattatactcgttctgctttaataaaataaatttatgaaaccgatacattgaggcacaagaatactcattaccaaaactttcagcctaggctccttttagataaaaagttcctcggagtgcatctgaaatcacattttgtttggacaaaagaagagataatgtacctgttttcagggggcatatctgttattaaatgagactccacagtcttgatcaatattctgcataaggactttttggctacaaagcgcttgtctggactgtagcttgcatttcagacctcttcttaatgattaccaaaaaaatactgagtgtgaactgcagtactgtgagcaggtaaaggcagattggtctttgaatgctttgagaaccctagataaatgagcactagaaagtgcaggtgagacccccaagaaagcctgcctggctggagaaaagaatgtgtcttgtagcatagtgctggattaaaacagacatgtagaatgaggtgaaatgattgagaatcttaaggcaaagctcttataattaatcgaaccatttgcatgcaattaattatgggctttgtgatacgtgctgggaaaacacttactggatttgttctgcttttaacataatgttaaagaaaaatattgtttataacatttgttaaagaacagtaagacagattttattcaggtaactgttgtaacaggtataagaactactgcagtggagttttggggtaggggagagagattgggctcaactctgaaaataaggaaaagtaaaagtgtatcaccaaggagtgagggtgagagtgtgatatcagtggatgaaaaattactaagaggacacatgaggggtaaggggggattctggctcaaccatcctaggagggtattcttgctgaaggcagatcagggtgaccagacattacctaggggttggtggaagatgaggaacccaatcagatatccagcatgggggattctggctaaactaacttaagaggatattagctaaaactggacaatgcagagacaaatacagaagcatacatgaagtcagagctagttgagaagagggttcagaggagcctgactagagtttgatcaaggagagcatctttgtcgatggaacactgaaaggccattatggcaacctcttggatatttgaaagaaaatggatttgtggcttagaccagagtcattattttacaggtattgtcaaaggtgtacctaatggaaataaagcctttttccctcatatagctaatagttaaatgaatttactgtcatttttctgatggcagtatttcttgtatcctgtgcttgtttcctgcatttgtttcttcttttggggaggatttgccaaataaaatccagaacccagttaaatttgaatttcagataaacaacaaataggtttttaaagtaagtacatctcaaattatttatttgaaattcaaatttgactgctatcttgtatttttatctggttaatctgtattttgaggttatattctttaacagatcctttagtgagggtcactaaagtatatactttatgtgtctgaaaatatctttattttgcactcattttataatgagactactcgtgtgtacaattccaggttgatagttgttttctagtggtgcttgactacattataccaaagtcttctgacttctgtgttttgacacctcttcctttgtagataatgtgtttctctcttttgagataatctcctaattctttatgttctgtagttttatcattatgtgtctatatttagatttatctttattttactcagtgtaatgtcactctgaaaactcatgtctttcctcaaatttgaaaagtgttcacctattatgtcttcaaatatcactttccaccatgcttttctgctgaaactctcattaaacaaaagttggagtgtgtttttcatggctcttaaaaaatcttttgtctttttattctctttttcgctgcattttgaatggttatctcagttccattttccaattttctaatttctgctttactatgcccatctaggctttatctcatttgttacatttttaattttaagactgtttttcatttccaaggtttctaataaattattgttcatagctacctgttcttgttttatattgtttaagtattcatttaactggttaaggtatgctaaaaatccttaaagaatcttggtaagaccatttcgtaaaattattctcatctagagaatatttgtgttcaaatcattggcttcaattagtttcttagcaaacaagcattaaaatttttaattgggttgataagctcactttgaatcagaagtttattttcatcctccccacccttttcctttttctgtctagcaattttatggaaatttccacttggagtttggggccgttggtctagagctagattataatgatagcttctgacccatggagcttttctttttatgatactgtttgcataagaatgtgataattttcctttttctaatattagtaaatttactttttgttcatgattgccttacacaacttttcaatctacttatttatatattttgctaactttttttttatttttattttttatttgtttatgttaacttttgttgaatgactattcagtggagccattgtgttaagtacattggagacaaccttgtgagataagtagtggtttgtgtgtgtctgtgtgtgtatgtgtgtagctccctcttttctagagcttatcactaccctttcaacttcagatcaattttatcttacgaactttcaaataattcagtaagtgttttctttagtgtctggcttctttcactcaacagtatatggccagcacaatttttatttttagaattctgccttataaagtgaaaatatccattgatgtttttatttaaacaccttttcccctcttccatcttgttcttctctgacttctctgcttagaccccattgccccaaagttacagctttgtctctaaagttgccttcagttgcattatcataagtgagttgctatgtttatttctttctagaaggtttttgggaatatataagagagtgatgtgggcataaagatgaaacttagacgagatcgggcacattcagggtggtatggctatagacacgagcattcctatacaccaataatagacagacagagagccaaatcatgagtgaactcccagtcacaattgctacaaagagaataaaatacctaggaatacaacttacaagggatgtgaaggacctcttcaaggagaactacaaaccactgctcaaagaaataagagaggacacaaacaaatggaaaaacattccatgctcctggataggaagcatcaatatcgtgaaaatggccatactgcccaaagtaatttatagattcaatgctatccccgtcaagctaccattgactttcttcacagaattagaaaaactactttaaatttcatatggaaccaaaaaagagcccgtataaccaagacaatcctaaggaaaaagaacaaagctggaggcatcacactacctgacttcaaactgtactacaaggctacagtaactgtatatgcagaaaacagaaactggaccccttcctcacacattatacaaaaattaactcaagatggatgaaagacttaaatgtaagacctaaaaccataaaaaccctagaagaaaacataggcaataccattcaggacataggcatgggcaaagacttcatgactaaaacaccaaaagcaatggcaaaaaaagccaaaattgaccaatgggatctaattaaactaaagagcttctgtacagcaaaagaaactatcatcagtgcaaacaggcaaactacagaatgggagaacatttttgcagtctatccatctgacaaagggctaatatccagaatctacaaagaacttaagcaaatttacatgaaaaaaatcaaacaactccatcaaaaagtaggtgaaggatacgaacagacacttctcaaaagaagacatttatgcagccaacaaacatgaaaaaaagctcatcatcactggtcattagagaaatgcaaatcaaaaccacaatgagataccatctcacgtcagttagaatggcgatcattaaaaagtcaggaaacaacagatgctggtggagaggatatggagaaataggaacgtttttacactgttggtgggagtgtaaattagttcaaccattgtggaagacagtgtggtgattccttaaggatctggatccagaaataccatttgacccagcaatcccattactgggtatatacccaaaggattataaatcattctactataaagacacatgcacacatatgtttattgcagcactgttcacaatagcaaagacttggaaccaacccaaatgcccatcaatgatagactggatgaagaaaatgtggcacatatacaccatggaatactatgcagccataaaaaaggatgagttcatgtcctctgcagggacatggctgaagctggaaaccatcattcttagcaaactaacacagaagcagaaaaccaaacaccacatgttctcactcataagtgggagttgaacagtgagattacatggacacagggaggggaacatcacacactggggcctgttgggaggtggtgggctaggggagggatagcattaggagaaatacctaacgtagatggcgggttgatgggtgcagcaaaccactatggcacttgtatacctatgtaacagacctgcacattctgcacgtgtatccaagaacttaaatataatttttaaaaaagatgaaacttagaatatattgttcttggtatatgttttggaaataatagtagaaaaccaacaggtaagaactaagactgcggtcaaccagacttgataattctgttcttcaaaacacttagaaatgtttaatattccttttgtttagcctgccagaggttaatcataattttctattgtattttcatttaatctcagaaactgtcatgtacttagtttgatgccagatcatgttttacagtggtcaatggctcagtgggaactgatagataatttactgatttgaaggtgttaactgttctggtcatcctcttagaactactgctgcactttctagtttaaatgtgcacagtattttcagtaagaatttaaacagtttttgatctggacctgagcaccctatttcagcatttgcaaatcaaattgggacccattcctgtgcattttagaattatttttctggtgtgtcctcttactatgctgggataggtttcaaaaaggaaatgtctgtttattttattaactcttcctcaggaaagacagtggtgaagtgagtcattagcacattgtatttttcaatagctctttgaccttaatctctgtggctataaaatgaatgggaagatgcctactgtattatgagtgatgaagaaagcccatgatggattcatgttactgtgaatatttcaaggagaagttaatgtaatatctgtagactacagtcatgaatccaagaccaacagagtaagtgtgtgttgctagcagcgtcgtccatgtgtagcacacatgtgtcaagaaataaatacaagctgttctctgggctctgataattcctttatcatgttaccccgaagacagaagaattggaaggaaaggagttgctgccacagtggtttgacttttttcagtgagtccagtgattgaatccatcctatggtggatggtcattttataatcatgggacagttacagggtggtgggtaggcttttaatggcagtggggcctagatagaagcaaatataatcacgaagagactcatacaatagtctttgaagctggccccagagagcagcatttcacaaaaatgtttccacagatgaccagttcagaaggatgttaatagattgtgtgttaaaaagggtcccacagccaaatgtgcagaaaaaccaagttaaacacagaaaaacaagagattttgccaaaggactcttcgggttttaaatatgcttatgtatatagaataggcagtgtttctcaaacatatttggctgcagaacccctcttttagcagaggtctcacaaagtctgtgttttgtgtaaaataccttgggtaaaattgctctagaacattggttttcaaatatttttttcttaatctcctagaataattttgaaaaagttatgtgttcacatatctttaagctgacatctacattttcattaaaaagtcaagtggatacaataggttaatttctggcacatttatattgtatgtgtgcattaaataatttcatcaaaactttggagctgcagaattggttcatgccattgataaacagtctctgccatttaacctaattggtaaagccagatcttcttatgaaagaaatcggactcattactttttctgtgactctatcctggggttgatatatttgtgaattgttcatttattctgtgcctgtgagaattttacctttcaagacagtgttcttagaaaggcctagaaagattctggattgacaagaggtatgccttgacttggtcaagagcaagaaggccctgaggaaaggggaagataggaaaggaagattggcaaatatattcttaggcagatgacttcaaaaagaaacatctgaaggctgaagatctatagattagttcccttaaaagtgtctaagcctgtgtgtaccctatagaatatcttcatgttccttcgtggtatgtctacccagtgcaaagttgttctttggaagtttaagaaatatatatattgtctaagtgatccttattaaataacttaatagtctgtctgggaaaagtatttgtattaagaggtatttttctgctttcaagtggaaggcatactgctaatggaattctgtcatggaatttatatttactagcaaaagctgaacacacacagatgaatctccagaaagcttcatattttcacacagtagaaagatgctcatgtcctgttcttaccttgtcctgactcctgttggacatgcctcatttcctgtataaacttgcgtcactaagaagacagtaaattcttactcactttgttaaacatacatactttcctgtaggagaagagatgcataaaaatatatttatttcccagaagggcacttgtgctgttcgtaatatattatgcaccaaatgtcatactttctttattccctggcattttcagccctggcaactggcagattgttttgaagtcagagaatatttaaactacaagtaaccttggggataatatagttcagcccctctgtgttacaggagaggacactgagatcaagagaaactcagagacttgctctgggtaacataacattttgtcctagttggaccaaaagctagatcttagtggaatattcctcctattattttcccccatcctctccatcctttttagaaatatggccttggacgaaattatctctgtaaaatggaataattattcttgtactgctcaccatccagaattgttgtgaagttccagtgagatacggtgtgctatagaaatgtaaagaatcctgatgaggtagaaggaagatgaaggtcctcacttcatcgtcaccttatcgcatcattcccatgtactgaaatacttaggctgttttatgttgggttgttcatagggagtctcttgttatgcatgtatacctgattactttatattcttctactacctggttaataaaagcccagccctcttatttctgttgtattagtttgaaccataggacattgccaatatttgaccattttagaagaagagcagttttagaagaaaagcagttttgtgttcctgaacttcatctgtgagctgaagtatgtggtaggctatacaggcagagatacctgtaaatgttttaaataagtggaaaagtatgtaaagctccttcatgttagctgtagtagcttcatggattttgcctactccagaggagcacatgggtccgtatgaatttctttcctagtttctgtttctgtaaacttctagactgcctgcctgaacacaaaagctcagatggggatagggaatggtgactggctgtatgtgggtgctgagccccttcagccatttattttggccttcattctttaactcaggaagttgttctgtatgcagtggttataccacttcttcaaaggacagacttccacagttttccagagaaatttgtcatctatagagggagaacaaggaataaattcatgtatttttcaaactaaatattaaaatacttttgatttagttagaatctgttgaggaaggtttgttgacgctttaaaatatgagacttggccggatgcagtggctcacacactttgggaggctgagcactttgggaggccgaggtgggcggatcacttgaggtcaggagttcaagaccagcctggccaacatggtgaaaccctgtctctactaaaaatacaaaaaaaaaaaaaaaattagctgggcatggtggcatgtgcctgtaatcccaactactcaggaggctgaggcaggagaatcgcttgaacctgggaggcgaaggttgcagcgacctgagattgtgccgctgtactccaacctgtgtgacagagtaagactccatcttaaataaataaataaataaataaataaataaataaaaatatgagactcctgaaacactatattgttatttgaatttattccttcacaaataagctatttataaaatgacaaatattgtaatcaggttttatttgattaaagaaagaagatagctttaggcaatgaagtccaaatagaattctggtttaccattcacccgtcacgttccatacagttgttaagtctgaatagaattacggtttaccattcacccatcatgttccatacagttgttaagtctaaatagaattatggtttaccattcacccatcacgttccatacagtttttaagtataaatagaattctgctttaccattcacccatcacattccatacagttgttaagtctaaatagaattctggtttaccattcacctatcacgttccaaacagttgttaaactttggcctgatgatgtcatcacttggaatgttcttctctcatccagatacaatgcgttcagttcaaccaatgctttgttcttaacgtgtttgtgagtctctgacatcctttactttaatttagaaagcttgtgactacctgtctaggaaaaatcacttaggcagttgctcctgtttcttaataattagaaatgtcttattaatttattaatttctgaagtcctatgttaaaattatggggataagttgtttgttggctgggaaggggcacaaagaaccttctcaggtgatggaaacattctttttttttttttttttttttttgagacggagtcttgctctgtcgcccaggctggagtgcagtggcgcgatctcggctcactccaagctccacctctcaggttcacgccattctcctgcctcagcctcctgagtagctgggactgcaggcacctgccaccacgcctggctaactttttgtatttttagtagagacggggtttcactgtgttagccaggatggtctcgatctcctgacttcgtgatctgcccacctcggcctcccaaagtgctgggattacaggcgtgagccaccgcgcccggccagaaacgttcttaatcacaatctgggtggtggttacaccacaagtagatatgcaaaaattcatctagttgtatacttaagattgatatattctagtgtatatacgttaaatataggaaacagaaatctaatctctaatttgtagtagctcaggaaatataaaaaaatagatgaaccaaggcagttgaaggaaacagtttttctggaagctgtgagaatgtgtcacaaaggaaggcccaggcttcctgggttcttcgggccaaaattaggggaagtgttggtgccagtgccggtggcacaagctgattaaaacagtcataacaggaagagtcttacacgattcttcgtctttgtggatgtttctgtttcttcctgtctatacctgataggtttgcttggtcattttgtttgttttcttccgtctgaattcctgtcctccattcccatggcatcagagtcaaggcagtaagcagtgtggagagtcaaagaaggggcattggaagagggtactaggcattggttgtaaatcaggtatttatgagtctggggggaaacctctacattaacctggcagccagccgcaaggctgagatggtgctgttatagaaaccacctagcaagggaaaattctgggtcctcaatcttatcatggaatgtgtagtggtgcagccaatgaacaggaatacaggccattcaggggaagaggaatgctaataatcataccctagtgaggatatgaggggaaatagaagagtggaaattttgtccagccttcttgaccacaactggctggttacccaaacttgaggttttacttgggacatataatagggcttcacttgtaccgtgtaagctccaactggacttggcactcttcctggtccttcatggtggttttcttaaaaagaatgagttacgggggaatattttcagttacatgctgtacataaaagtgcattacagaacaacacacacttcaataaataatgagatggtcaggtgctgtactgtgtgccgtaccaggtgtcatctagctgtagcagtttccagctacgtgcaagttggaacaccatagaatttatacagcaaatatgcattaacttatcatttgaatgtcacggaaggtatcatattttatcactgaaattaacttaaaaattgcatgctctgagtaaaatatgtacgtatagatcacgatgcctacttagaacatgaaatattgatgttcatataatgttaatatttgcttaaatagtgattgagggctgtattttctttttatgtgatgatcctgatagtaatgttttgctaccattgtatccaactttttgattttcaattaattacctttgcaagtgactatataatctttctttgtaaaatcacttcatttatatctctcctctttcaaatcgctttgatttccccctggatctccatatgcagagtatcttaagtgtctatttgtagcagtgatttcctctttcactgtatttctgaatcttctgctgctactgggtatttctacttgggtatcccaatgtgaccttgaactataaaactgaactcctcttcttcctgccttctttcttcctcagaactccttccgcaaaaccagctgtgatttttttttccttttttcttagattaggagcctcccagacatccttgactcctttctcttactttctcatgatgtgtagtccagtcaagcaccatgcattttcagttgttcttaaaaaaaaaaaaaaaaaagatttgtccattctttatcttcctgattgttctcactgtcaccagcctggctgttaccaacctcatacttgcatgaccccttcaagtgatcagacttttaatctcttctcaacaagccatgtgttggccaggtgaattttcctagagtctgtctttgagtctttctttctcctgctcagaaacctttagtatatagctccctgttctcaatgaaactgaatccaaatgcagcctgaattgtaccagctctgtttccaactatttaccttcctgaatcttcttttccagccagtggtttgactcatcatttcctgagcctccatccactggccacactctgtgctcaagctccagggtttcccacacaagtcattccttcccttcctcgcccatccatccagctcctgcccagacatcagcactctaaagccttacctcctcctcagtgccacagtctgccccacctccagcttccttctgtggcttttactgtctgtataggcaatttcataatttaacttctaacagtttatgacagttctttcttgtgatgacttggactgcttttcacttcttaagtttttcaaatattcatatgtatagttagactgtcagtgcttctagagtgagagtctttgccttacctatatgctccataatgcctaacataaactaacactaaagcaaaagctctgtgaaggccagaatttttatcagtttttttcactagtaaatccttagcacctggcatgtagtaggtatgtaataaatatttgctatataaattgtaaatgttcaataaacattaactgatttaagattattcacacctgctacatccttttttcactataactaaaagattactatagtgaaaaaggaagtgaatgcaatgtatagccagaatctgctcaatggggcttgactgctccttctaaagaattgtgttttcctgcagatattaatgaatgtcagctacaaggtgtatgccctaatggtgagtgtttgaataccatgggcagctatcgatgtacctgcaaaataggatttgggccggatcctaccttttcaagttgtgttcgtaagtaataatcactttttattcctgttttggattaattgtctttggggtttttccaaaagaacggaaatactcagtggccaactgaatgcttgtaaatatacaggaaaacctcattaattaaaataacaagcaaggggcctgcctgatgtagtaaaataaattgatatcatggaaccttctctaaaatgcatttttattgtggtgataaaaatataatagctaaaactctgaatagagactaagcacaccgaggaaatatgctttgatgaaaagaaaagagagaattaaaatggacatatcaaacttttttggtacctgagagatgacagtaagtttttccttcataaatacggtattttaagcattctttaggttgaattgaactgtgtcccagcttctgcctttaattattccaaattctgagtcactggactctgatttaatgaggtttcacttctttctcaattgtaagagtctggaaaatagttaccaaggccctgtgttttagattttctaattcagtcctaatttcagatattgtcttgttctttaaacccaccaaaatgaccctaaattatactgttttgccttaaaaatgtttctgagattttcccttgtttctgataagggtaaaaatccttcattaaaccacatgttctaatattggttctgaaagatagtttcaccaaagagatactccctctccgtgtaaattaatccatgtaatcactacagatcatatgccattagagaggaatgcattttaggtgtaaagttctcaaatgcagatttgagatttttaagaatgtcttatttttaaagtaatcatgcccattattataggtaagcactgtaagattttttttaaagagatggggtcttgctatgttgcctaggctggactcaaatgatcactgttcagcctgctgagtagcatgactatagacatgggccttgtagcactgcagatttttaaagattatatacaatttaaatggctgcatggcagaaaactattaggataattttaagaacaactgtgtattagtttctttcctgcaagtttttgtttttatctatctatctatctatctatctatttatttttgagacagagtttcacttttgtcacccaggctggagtgcaatggtgcgatctccactcattgcaacctctgcctcccgggttccaatgattctcctacctcagcctcccaagtagctgggattatgggcatgtgctaccacgcccagctaattttttgtatttttagtagagacagggttttgccatattggtcaggctggtcttgaactcatgacctcaggtgatccacccgcctcagcctcccaaagtgctgggattataggtgtgagccaccatgcccggccacttttatttattttttaatgtggctttggtatataatgagctgcatctttcttgtctagtttgaaatttgccatttggttgacatgttcttcatgagtttactgccattcatttttaacgaagcttatctctcttaactctttgccctaaggtgagatatgtagaggtgataaaataaagacaaatgtagtaaaataaaaatgacagtctcatttattacttttaggtgagtttgttgagtcttttgaaatgttatcactaattactactcttttcctttaaaaactgtcaactgcagattaggaagttttacacgtaagtcctcttttctgtgttcttttacaaacagttctgatcatgaagcagacagacacctaattataaggctttcctaacgggtggtaaaattagaccataaaattacatttgcacacaaattacctttgaaactgatgcaaggatttggaaatttcaggccaaaaatcacattgttgatgacatccagataacttaggggatcatttttggctgatttgaatcacatgaataaatatgttaaatcattttataatttaaatgtaaagattgtagagtttggatatagagtttgttgtgaatgctttttccacccttttataatttgacttgtagtctggttacaattcttatattgaaggttgctgattaggtaaacttgcagaactagtcacaaaacgctctgtgaaactttgaccagatctgatgtctagagttgagggcagacatccaggttttaataagattatagaaatctgccaatgagatttttgaaacacttgcacatttccttagcatttattttccctgtcattgcccaaataattctgaacttattaaacaaccatccattcttatttgaaaaataaataattcaattttatggttcagctacaacagctgaactgataagtattaagagacgtttgttgctagttaagtgttccagttgagagttcgaagtgaaaacctgggctctttaccagtgttgagtgagaagatttatttctctttcctctgaatttaccacatgtaacatcacagagacatgtagagttcctttaggatttgcgatttgaaccagtccagtctgattttcaggtgaattctgtgaagagcttgatgggggaagtctgaagacagaaggaattagggaaaagggtgatacttacagagtaaaggaaataaatgaaaagataatggtatttttggtagtcacagggaaatagcaggaggggactggagatcacacacacgcacacgcacacacacacacacagacacacacacaggcactcaacacagtggttgctaaatgtttgctctggagagagagaaaaccagccagggatgaagcctgcaggcaaatggaggacaaatgacaacatttgctaggacagcatgaatttaggccatatccagagcatacaaggtgtggctgactctctgaactcctgcacatggttatggccaaggaacaacgggaagcactttctcttcttgaatgcactgaactgagatgaaccccccagaattccttgactgcagccaaaggttgcaacaatttcactttctctccttgccgcttgccttggcttagccaagctaaaaggaagaaagcaggcaaatgctggcatttgctgcctctgacctctatgtttgaggcttaggatggtgtaggagcattctccagacatgttgctacctgatttatggggaaaggtggaaattcgaggacttttcagagcaaattcaagaaaagtatcatctttgcaatccaagtaggaagactttctggctttctgaactcctgcaggaacttcagagctccaggatgagtgctgctgagaatgtgtccataggttcagtaaaaaggcccagataaaagaattctgagcctgggcttttgccttttcgtagtattcttcacccatcaacttggagctagttgacagaaatggagggttagagagaagatgtgctcaggaacttctgccgtagtcctggaagtcatgagagaaagggcaaatgccttttaattaagtacatcattcatttgtaatttcctgagcatctttatgagaaacataccatgcttatcttatacattgggaaactaaagctaggaaagtttaagtagcttctcacacagctagtagctgagagttgagatttaaaacaggatttgtgcctccaaatttagggttctagatcaggagttggcaaattatagcccatgggaaaaaatctgtttgtttttgaaaataaagttttattggaacacagccatgtccattcatttacttattgcctaatgctgcttttgtattacaaagacagagttgagaagttacaacagaaatcatatggcacacaaagcctaaaatacttattatctgatgcttgacagaaaaagtttgctgacgctcaagctaattaacactgtccaatagaactatctgagatgatggaaatattctctatctgtgccacctcatacagcagccactagtcatgtatggcctgtgtaactgaggaattgaatttttacttttatttaaattttatccaaggagcaacatgtggctagtgcctaacatattgagtggcgtagttttgtatcctttttggcaagccaaatgggttaattactgctagctttccagcttttccgttaatatgggctttccttccagacttgatattttttgcccatggtaacattttctccagagcaccccggctgggagcctgtgtcatcttggactcttttgtatcttttggtttcaaaggatgacatttagtcttcataatttatcttatgcccgttcttttctttctaccttctctgtggccatctcaggttaggcccctagcctccctcacttggaggtctcatggcaccgtggcccggaggtgagacagatctgtacaagctgcttgctcccagataattacagtaaacaaaaaccatgacaataataatttttattgcaaacttcgtaaatgccaggcactgtgctaagcactttatgtgaattatcccatataatacttacaagatctctattggatttgttctgttatttttcctaatttagaaatgaaggaattaaggcatagaggggttagggatctttccaacagtcatacagtccataaagggtagagcccagatttgaaactggatctgtctcactccacaagctgaacctttaatcaagaaatggaaaagtctgaaatgccaggaggagtaagtcatttatttaaggagaactgacattttaatctcacctgccacactatagaataggtgacgtaactgcaatggccttgaattattgtttcttttattttggttctccacgaattttttttttttttttttgagagggagtcttgatctgctgcccaggctggagtgcagtggtgcaatctcagcttactgcaacttccgcctcctgggttcaagtgattcttctgcctcagcctcctgagtagctgggattacaggcgtgcgccaccacacccggctaatttttgtatttttagtagagatggggtttcaccatgttggccaggctggtctcgaactcctaacctcacgtgatccgcccacctctgcctcccaaagtggtgggattacaggcatgagccaccgcgcccagccatgaaatggtttttaatgacacatttcccagagtgcccagtggttcttactgccctaggtaagctgcctctcagactcctcaaagcagctttacctgcttcctagacctgtatcctaacactcatccccatagatactaagctgtaaagggattaaatgctaatgtggaatttcatccaagaaatgattaaggatattacagatgtgggtgggagtgattgcagactagtaaggttagctagacttttaaacccttgctcttttctgaaatcctccctacttttcaacttcttctaagtaccagattaattaatatctgcttaatatttgtcattcacattttaacccatttatgcctggtgttccattattggaatgctgagcttgtgggagttatttatatcctgctcaaggtcatctcagtaggtctgatttttcacacacacacacacacacacacacacacacacacacacacacatttacaacctccagcataaatgggttaatacattagagtagtatgtctttgaaagtataatgtgagtttattatacaatcctataattaaggccataattaaatataagttgcttaatatatcactgaggaacccgaataatagtatcttagctttttactcttgttttgtaattgaattgccatcaccatgggctgtatggttatgatttggtactatacttgggtacagagctatatgcttgttaccagtttgaaaatttgtcttatgtctgtagccaagagcaaaaaaattactttcctggtggatgtggcattttcagtaggttttatgcttctgaagtgcttttccttttagataaagtatcagaatctttttgccgtaattttagtaacacatcctgcacaaaataggatctgacaaagtactgtttcagtgtacaaacatgtaagagcctacaggcaccctttattatcactcctcagttttattcgattctacagctgcttcccctatcccttagaaatcttttggtatttctagttttctttagtacagcataaaaccttatgactcagtagaatatataatcacatgtaccatattttaaataataaacgtagtacactaatgtgttatcctttacaattaatcttccagtctgaggttaaagatattcagacaataacaacaccaatcacatcattctgggtagcatattgtttctgggtttacgcatcatattgaccggagtgtgaaaatactagagatgtttaataaacagaatgcaagtcatttgaaatgacaaaaagaacaacaggcaatttaggtcgtaaaataggggcagttttaaatggcacaccctgtcaggtatatgtggcataaatgaacagttttggcttcaaatagttgtagattaaagaaaatgtgaatcatgaaagcatcagtaaaatttcggtttgggagaggctttaagatggttgactagaggcatctggtgctcaccccctccacaaagaagaaccaaaatatcaagtagataatcacactttgaacagatcatctaacagagaacactgaggtttaacagagaagtcacaggaaacacctaaggcagggaaggagagggaaccaagggagcctgctcagccaggattagctgggagcctggggaggctccccagtgtgaggaaagggtagatgagagacctccagtgatccacattcccatgtgaattcctgcaatcctagccacaggagagcccttcggccctcacagactctgagacttaacatagggagctgcctagagacctcgtgatggaattgctgccgagagggagctcatgcatgctgggtcccacacacaccttctgagtcttaagcaggtaccaccaccattggcacctgagcactcctctcagaggcctcaggtcaggcccacccaacgtaccactaccatcacagctggcactcacctgtatataccacctgtgggcctggggactggcctgcccagctgctaacaccagcatggactgcgtgagaagcagagggttgtctcaccactgctgctgccatcacctatgctacacccactgcccaggagcctgagaacctgcctggctaactgctatcactgctggcacctaagcaagccacgtagagacccaagaattggcccacttggacccactaacaccaatgccagtgtacgctgccctcgggcccaaagacaaacacatttggcccacctctgctactactggggctgaggactggcccacctggtagcctcatcctcggcaaaattttgcacagaatctactaacaactgcatcctaaggcactgaagaatcagagacaccactgatgctatttacaactgaagaaatcttatggagactacactactgcatgtggccagaatcaaagccaaagtgccccacccaaacagcaccacagataacatcttcaggaagtcctcccctaaaagagatgctagaggaggctgggcgcacggtggctcacgcctgtaatcccagcactttgggaggccgaggcgtgcggatcacaaggtcaggagatcgagaacatcctggctaacacggtgaaaccctgtctctactaaaaattcaaagaacaaaattagccgggtgtggtagtgggtgcctgtagtcccacctactcaggaggctgaggcaggagaatggcgtgaacccgggaggtggagcttgcagtgagctgagatcgcgccactgcactccggcctcggcaacagagtgagactcagtctcaaaaaaaaaaaaaaaaaaaaaaagatgctagaggaattgggtaagggaaaggcaagtcagaaaacctcatttgtatggtgatatgatagagaagagctttggttgggtttggggaatgggcggcggggggacaccaaacttattcagcacctttggcctgacctggacctggttctgtagaatacactccatccatatttgcattagaagatgaacttcttgaaggcagggctgtgttttgctgattttcatatttgccatgtgtgcctagcagagtatttagctgttaggttgatgaactcttatctactaaacgtatagcagaagatgaggattaaagtttaggtattggatggctatagccttgtatacttttgcagtgttttccgaagagctgagcacatcatctcttccttctctggtgtactgtctggctagaacaggggccttgtgtggcactcgaaatcagaaaccactttctgcctcccattcatgttcactggcgtagggtgagacctgatgggccctgcaagctcttacttccctgggatgagaagagcagaggctggcttgcagcatcagccatgttcctcattctccaaagtgcctgattattcactaaatgctgccctagagttatctctactgtggttaaatatagaaaactaggtagtgattttggcagtaggtgactaggtttatttggaaaggtgggtttttgttgaaatgtttctcttcattacgcacacatacctaattgcatgcttgctaaaatggaagaagagaccagagagggacagggacaatcactgtcacgacttttggtgccctgactctaaaactcacatggtaaactgatttttcttcaagaaaggtgatgctctaaatctagacagatttatcctgaagtgtggtttttaattcataccttagggttcattttactatcatttggaaagccaatgtagttttggtttctcatgtaatgtcgggctttatctctctgcttcagctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacaggtaagacatgcccagctgtatgcgcacatagattcccagccacatgagtacacgggacaactttggcaccttgggtcatttgtggtttctgactttaatttttaataatacattgtaaatatttaatcacctttgtagaaactgtacacatacaatgttgaatcagtgggaaaaaattatgtgcaaagagattttcccatttctatgtgatatcagacttccttttgaatattaagaaaagccattatattttatcttcaatttccaggactctgagtctgatatttaagtgtagagagaccagaaggctctgctgggccatgcgctttcctaatgattggctgctcatcaattcacagtaactagactttgtgcaagttgactcatttactcatttattgagtatcgtgcttaatttctttaattggaaatggaggaaattatattcatgattgaatttacgctatgaagattaataacttaaggacagaacttgccaaaactcctgaaaacttctgtgggagttgagtattaagaagtagattattctttatccttcaatttggtacataattgccttatgccctgagaaggcaaatttatctctttaaataccttctaccaatgaaccaccaacttctcaagcaggatcaagtagagttaagtggaagagaaagaaatgtaacctgaaagcgttagacctgatattaacaaggaatggcttcaatgtcacttacttggggtggacattaaatagtctactcaattgcatgtttgataagatgctttctacctaggaaagtgtcttaactctcacagggccatgtagtgtcttaaagctgtaacttacaccatagcagacaagatttaaatataagtatcatgactcacctttgttcatggttagaaccagaaagaactgtgttaaggcaaaggataatacaacattgatggtatgttggtagactagataattttaggcctccaaaagatcctagtaccctcttgtgctcttgctcttgtgccatctgatgcacttttttttttttttttttttttttttgagatggagtctcgctttgttgcccaggctggagtgcagttgtgtgatcttggctcactgcaagctccgcctcccaggttcacaccattctcctgcctcagcctcccaagtagctgggactacaggcacccaccaccacgcctggctaattttctttttgtatttttagtagagacggagtttgactgtgttacttgatctcctgacctcgtggtctgccggcctcagcctcccaaagtgctgggattacagggatggttccactcattattaaaaattaataatcaagtaatctttataatttatagacacgtttctcttgaagttcagtttttaaagctttcagtttgtgaatttattatgcgtattattttgtgtctgtataatgtgtttttaatttttttaaattttttaaatgtttagcttttaagttcaggggtaaaagtggaagctcaattttgatagctttataatccttacatgaagcataaattgagatggtgactggaactcagggatactcctctctagtactatcaataaatttgaaaataatattcaagataaaatttttgcacttaagttttggttatatggtgattttcactaaaaatatttagttcgttaattctttaaacttggtttttttttttttttttttagggagtttgttgttgtttttctggttttgtttttgtttttattatactttaagttttagggtacatgtgcacagcatgcatgttggttacatatgtatacatgtgccatattggtgtgctgcacccattaactcgtcatttaacattaggtatatctcctaatgctatccctcccgcctccccccaccccacaacagtccccagagtgtgatgttccccttcctgtgtccatgtgttctcattgttcaattcccacctatgagtgagaacatgcggtgtttggtttttttttttttttttttttttttttttttgtattttctattacatttattaatatcaaacactgttgtttcctgcatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaatatgtggtgtttggttttttgttcttgcgatagtttactgagaatgatggtttccaatttcatccatgtccctacaaaggacatgaactcatcattttttatggctgcatagtattccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactggatatatacccaaatgactataaatcatgctgctataaagacacatgcacacgtatgtttattgcggcattattcacagtagcaaagacttggaaccaacccaaatgtccaacaatgatagactggattaagaaaatgtaaacttggtttttaaagtcatgttttcttctggaaacatgtttccaagtaaaaattgtttttcctagttaaacataagaatgaggttctaccatttagtgtgtgatccttagaaaaacagtattttagcatactataagcagtatttttagagtttcctttttcttgagaactaattttaggtcccagacattcaatagaagatctcttgttcagtgaaagtgagaaatgacttattttatattcaattttaaaagtagaaataaaaaagttaaccataagctccttggtgtctacatttggtaatttgcctccaacaccaacaccaaagggattaggtggatttttcctctgaaggccacacactgccttacccttcttctcccccttgcctttccccttcactattcatggggattatgccgtggaggttagcaaatcacatgtgctgagtctacttttttttttttttaaagaatacaaaaccactttttttctggcaatggtagtgattgattccagggcacagaatatctccttggcctctgggtagttaaatgagctggtcacggccaggcttttgcccagttgttgttcctttacttgaaaatagctgcatcttgatttggcatttcccttctttcttgatttctacctatcatctccagcatgtctcactctctagactcttcctcactatcccgagattctccccttcagaaacacttccccttttccgtcctccgtaatctacatcctcttaaccagctgatacatggcattttggtggagccctttgtgttcttcaactggaagcaaactgtgaggatttcggcatctcatttccctgaatagtgattttttttaaccttatggctcttcatctaacttagacaaatgtcactgagttcttttttaataactaatgaaattacatcaaagcgggaaaaaaagcctgatttttgctgataagacatatacatgcaacatgagatatataatacatatagtgtcttctatatataaaatatctcctaatatataacctaatatgatatatagtattttctaattggttgctgatatatatgggatggagggctaactatatatatatatatatatatatatatatatatatatatatatatatatatatagttaccctctgtatccatggttatgcatcagtggattcaacccaattggttggttgaatctgtggatgcagaactggatatggagggctgatcatactatgcaattttatgtaagggtcttgagcattgcagattttgatatccacaggggttatcctagaactaatccctcatggatactgaggaatgactatgtaaataatatgatatataaaatatatgctaagtatatgctatatataatatgtatattctgatttgggtaggataaggaattaacagatggaaaaatgtttagtaaaaaaaaagttggatttttttctttaaatatgcaagtttatcagaaattcgagcaatttgcttacattttgcacctgtttttgaagttttaaaatgtaactacattagtgatgatttattaagagctattcatcatgatattttcctctgtataagtttgcactgttagatttttaaaaggaatattttcccatcccaaatctagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaaggtgagagcggtaatggatcatggactctagacatctatctgtgtgtctttgctttgatttccctgtttataaccctctagaacagagtttctcagcctaagcactattggcattttagagtggagaattatttgattgggggctgccctgtgtattgtaaaatgtttagccactgctatagaataatatgtacctagtagataacaatattccatgctaattttagaatgctgtcctgatgtttgggggctgctttatcttggcgtttatatctggagagtaatttagatccttcagggaatagccctaatttcatttcttgtctagaaggccatttaacaactatttatttctgaagtggaatccacagactttcaaaaagttaaagcattaaggtctaatgggcagtcaaggataatggaggatgaaatgaaggaagctaagagattgtcagttgaagagatctggtgatcacctagtgtggttcttccatttaccctctgagaaacctgagacctagagaggggacatgacttgccagatgtcatatagagaacatgtaatgggacctgtgaccacggagcaccttttcccaaggaaatagtttaaggcttatacttgagagggagtctagagacaatggactttgactctctctctggcattcaggctgtggggtcatccctatctcttgatataaacccagcaatatctaatacttcacatatcttgcttacaaagatgttcacctcagaaggaacaaaccttttggatttgtatggaatagacgtattttctctaataaagctcctgttggcttttcacagttgattctgaggtcagaattcagggggccatttttgggtgctgttgaggagatagagtgcccaggctagtgttgtgttgggagtttgccatagccgccttcttggtgaggcaggctttttttctgagctctgaacgtttgtgtgttctggcctatttgattctatgctttcactcactgcatttcttccttggtgaggcagaacaggcaaaacctcagctggaatcaacagtattaatcagtttgcccctggacacttagtatcatgaccagatgtttgcaactgttcattgtttgcacaggcaggaggaaatgggccgtagttccagattttgcctcaagaccttcttcgtggtaggttaggcagaatagaaggttattgactttctccaaccccaagaatattgcagcaatgattttactttgtctggtaccctgattgctttcaggatttaatgctcctgcccaacctgtaaactaatgtttttacaggagacattgattgacttatgagaaaaatcctggtgaatgttgatccagggctttagaactaatatgaaggactgattaatgaaaagcaagtctttaaaaatacaaaggcatcaccaacaccctcacaataacgtttatgattgtgtaatgtataatttgttcagtatattgatgctaatctctaattggctcttcctggcttgtgagattctttttcgtaatttagttagcatatctttttgaaaatattcacggggcttcattaaagattggaatacatcaagaatgcagcacatgctgtcatgtctcttactgaaataagtgacattcttttttaacacttgacaccagaaagcatttcaaacattatataccataaggataaacctttaaccaattaatgaaaatgtttgttttctaacatatggaaagttccacataactgagataaggcataaaatgttgtaccagaaagtattgccttcttcttttaattttaattctgaaagagtttgaaagacttgttcacatcttctccatgtgctccagtagttgaggagtaacagcactgagagttctctgttagtcatgtgtaaaattccctaaaatggcagatgatcctaattctgcatttgctttagtctgattcttaatccttttgcagagataatggacttctattgttttttaagaattgaaatataatagactgaattgtcttaaatggtactaataccctttttcttttctggttttagtggcaactgcaccccctgaaaaggtaatttattcattgcttgcaagtctttttttttcaacgctcaaagtgattttctattagaatatgtatggattttttagacttaaatatagtaacatctctattatgcatcatttggtttgagttaatatagcattcagttattccaaaaaaatttattgagccattgtcatagattgggactcttctcagtgttaggaaaacaatagagaacaaataggacaaaaatctctactttcatgaagcttcaattctcgtgagaagaaaatgggaaactaatgggaatcaagggcataaatagaattcaatgtcacctgatggcctggaccatctgtgaaagaaaggctgtgacatgcttagataatcatgtattcttagagcacatatatagttagtgaagtacttcttagttcaactaaaatttaacatacatgtttgaattgagtttgagtaagaacagaacttacacttaaaagttacaatcaaatactagaatgttgctttttgaaaagtcagtctattggcttttgggcatagatgggggctatgaattgtgagacattttagtaggaaatgtaaacatttactggatctaagtcctatttatgtaatattgttccttctctgaatccggctttctttctttaataaaaacatccattttcattaaatgaatgaactttatgtcagagaactactatgatatattgctagactaaattatcgttgcattttgaaatgggatctcaatgcatgtaacaggctttaattttctttttatctccttctgcataataattacatgaaaattaggtaattattaaatatttatacatttatgtaccattctttaagctgacaagaatgcattattagaatttagatgaggcaatacatacatgagttattttaaatagtattctaaatcttataattatgggatagagtaacatatatgtcataacataagtgctgaaataagaaaaagagacttacaattttggagtgatagcactcgtccagaaagaggttatagtattttgagaccaaaaaatgtataacagatatgcatactttttgtgtacttttgaagctcttagcatctctaaagatcagtcacagcgagtagtttgcaattttgttgattttgaatttagtcctggttgatgtatggaagtaattatttagcttgtaggtgggccagccagcatcctggcagcctcatcacgactcagttcttctgtctttatgattgaatttaataactctcattaaaaatctaaaaaacccccaaaattttcttgtatacttttactgcattttatttggggaggagatagtacgaaaaatgcaatcatagcctttgttgtcttggtacttaaaaaagtctcatgatgttatgtgatggatgaagaaaagaaaggatacccagagatgtgcaaaggtgtggtagaggggacagcaagggtcatgaaagacttggtcagaaaccgaattagggactgctttggaaggcttagagtaccaaactgccattgtaatcagtggggaaataccctgcttctcgactggaccgtatttgttaaatgtagaagtggtgtagattaggaagtctgctgcctcacggtgatgggggaaattctgtaaactgcagtagtggattaacacctgatcctggtctgttccttgttggcattggccatggctgcagggaatggggtgcaattgagactggttgaggtcatctctagtaagtaatagaaagctagttttaagaagacagaggaaatgtgggaaaaactattaagtgctcagtatttgtaggagctgaattttggtaggtctactcaagttaagaagaaagaggaagccagttagattattacaataaactgaaaatgagagtgagtccggcctagggtggtgggatctatggatatgaaaaagggtgaacaactgttaagaaaaaagtgtcaatggacggggcttgcaatgaaaaatgaaagagggaggactaaaaggtgactttaaacctggatgggacagattaatgactgtggcactggtagaaatgaagttggaatgagagcctggatggttttggaagggtaggctggaggtatctgtgggatatctaaatggacttaccctgtaagcatttgtgcttgcaaagttggatttatgatgagatatccaggcagactatcttagaaaaagcagaaaataggtgatacttgaagccaggagaagaggataagaggttaacagaggccagaggagtaagctttctggaagaggacagaaccaagtaactcgatgagtacttgaatgtagtgatatgagctccctggtcacatctggtgtgagtgaagtcacagatccttaactaggctaattgttcagtctgcctgagccctgcacagttgtaaatggaagctgagccacggatgatggactgcttctttgcttgaggtccaggggacaagcgtgggcaccaaaatgtgtgatgaagccccaaatccttctccaagccagcacatttctgttgctctgcctggctaccactgttcagagagctggagttgtaaagttatcagacgtgaggttaaagaaggccatagtaactgactggtttaaaatattttaacttaccatgtgttctttgttatggcacatctgctatatccattatttaatctgcaaactgtggctggtcatcttagtggggcagagccacatgtgaatgaggcaatagtcctcgttgggggttagttttgccctgttgcagaccaaatatggacccctgggccaagacatttacttacaagatcagactttgggcctcagggaaatggctgaagatatgtgcgtggattagcaccactgggaaaaatttagggctttccatagtagcaccacatcaaaggttcttttttttttttttttttttgtaatttcacacaattatacatgtaaggtcctatgatatttctttgcctttctaagaatataattaattacataaaaatagtaatatgtgggaaactaaaaataatttccactttcaattcttttttttttcttattctcttttaaaatacaaccatccaggaaataccttcattggatcaagagaaaaccaaacttgagcctggtcaaccccagctgtctccaggcatttccactattcatctgcatccacagtttccaggtagcctgtgttgatctgtgctgtttgtcagagtattctgaataaaaatgtaagacgggaaatttttgtctttgactttgtgtagtaaattactagacttcataactgaagttcagtgttaagtatagtaatatacttatataatgttagcataattacagcattgtaaggattgtagtgggaaagataggttttttttttttactgttttctgtgatcaggagtagtatacactattcagacattattgaaggttatcatttgatgaacgatcatttttcttggcttccgcatcactctcagatattcttgctaaatgttgaacccagagccttgggacatagaacagttctttatatctgacaaatgctgtgatatattgctagactaaattatgcttgcattttgaaatgggatctcaatgcacataacgggctttaattttctttttatcctctgcttcctcatatagtagtgattgaaaaaacatcacctcctgtgcctgttgaagtagctcctgaagcttctacgtctagtgccagccaagtgattgctcctactcaagtgacaggttggtgcagtatttttacattatatatcacatggaggagacgtggggctgagcttcattttaaatgtagtatccattatataagcttgctcatggcagggttagccatactagcaaatatttggaaatcatctaaatacagttaaaaaggaggagtatgtggaaataaattatagtatatatgaaacagaatatcacatagtattaaaataatgtttgaaaagagtagttaatatcatgaggaaatatggcataatctgttaataaatacagaatacaggctgggtgcggtggctcatgcctataatcccagcactttgggaggccaaggcaggcagatcacaaggtcaagagatcgagaccatcctggccaacatggcgaaaccccgtctctactaaaaatacaaaaaattagccaggtgtggtggtgcgcacctgtagtcccagctacttgggaggctgaggcaggggagtcgcttgaacccaggaggcggagatcgcagtgagccaagatcacgccactgcactccagcctggtgacagagcgagactctgtctaaaaaaagaaaaaaaaaaaaaaggactgggtgcggtggttcatgcctgtaatcccagcacttcaggaggtcgaggtgggcagatcactaggtcaggagattgagaccatcctggctaacacggtgaaaccccatctctactaaaaatacaaaaaaattagctgggcctggtggcaggcatctgtagtcccagctacttagaaggctgaggcaggagaatggcgtgaactcaggaggcagagcttgcagtgagctaagattgtgccactgcactccagcctgggggacagagcgagactctgtctcaaaaaaaaaaaaaaaaaaagaatatgatgtaatgattaccattttacttttaaaatttctacaaacacggaaaaagaaagaaaatgcatcagtgttctgttctcaccagttaatactggatcatggataattatgttctttaatatatttttattttcaaagttctgtataataaacatattattttaatcatgagtgaaatagcataaaatgttttatattctgaaacaaatgcaaaattctaaatgtccatatccttaatgtgtattgagctcttataaatcaataggaaaaatactaacaatagagaaatggaaaaataatataatcagataatttgtaggaaaaaacaataccaagaagcatgtaacagaaaatttcgactttcctggtaatcaaagaaaggcaaactaacctaggataataccttattcctatcaaattagtatgtaaaacccaatcaaatttttttattagggtgagattgagactctctcacattgctaaagggagtatgtgttggggttctccagagagacagaaccaacaggatatatccagatatgtagaaagagctttattgtgagggattggctcacaccattctgaaggctgagaaattccaggccaaggaaggctggtgttatagttctagtgcaaacccaaaggcctgagaagcaggggagttgatagcataagttccagtctgagtctgagtctgaaggcctggataccgggcataccagcgtctgagggcaggagaagatggatgtctcagctgaagtagagcagattgccttcctcagcctttttgttgtgtttgagcccagcacccagcagataggatacccacccacgctgctgagggtgatcttctttacacagtctaacaattcaaaggcctttttcttccagaaacaccctcacagacacacccagaaatatgtgatcagctatctggacatcccttagcccagtccagttgactcatgaaattaaccttcacagagtataaagcacaaattggcaatatgtataaaaaacttcagaactattcagaacttttgacccagtaattctattttaagacatcttgtctaaggaaataatattcccaaaggctgtgggtaggagtttatatgagtggttacctatcacagacaatgtataatacagaataaatagaaataactgtacattcaactacagggaaatagataattatgttacatctatacattggaacattatgttgccaccaaatatagtatttttgaagaatttttattgaaatatagcaggaagtagtcatacaatattgctaaatttaagatgaaggataaaaaactgaatgatatagagtattataccagtttttttaaagacatatatacactgagaaaatgctgggagaaaatacactagatattagcagtggtttttttttagtggcatctgagagatttaagtgttttattttagatttttttattttccatattttctaaactgaacagttatttttagagtcagcaaaaatgtcactaaggggcatcatcatcaactttaactgaatttatgataccactgcaggatgaggttgacaatgtgttataggagctaaatggaagagtttggagcctcctttagaatattccctcctcagaaacatgttatggttcctttctaatagaaatgttctcatatgttaagcttttggccacttagtgagtcagtagaacaggagcctcgcccttcagggtgcagctacagtcacctagccacggctccagatctagacatccctgcactctaaggggctgggaagtccctctttcaccacaggctcagaagtgcctgctgtcactccttggcctctccccgctgccagcgcctgctccagggtggagcaaagttgtggccaagcccaagtgctattgcaacccagccagttgtgcatgtgcttgggtgagtgttgacatgccagtcccctgtcgccttggccccctctggacattgggcaccaatgagcatgggagggaagctgagggtaagctgagggtagctcagtgtgggcttgcaggtgcccctcagcatgaatagcctgggtgtgtggacaacatgttgatggagggaggcagacaggttcctgggtggaaaggggtgagtcctcagtgaaaccccaccttcaagccaggaatggcctgaagcctgggggccaggctgccagttccaggtgtagtccacggtccagagtgaagacttcatcgataacagtttggccaatcagatggtgtttttctaggccctccatgatcacccatggaccaatcagcacacacttcctccattctgagcccataaaaaccctggactcagccaaactcacacagatgtcaggagtaccagctgtgagaaggagctacccacttcgggtctcctcagcttttcaggatgacgtgcccgcagaaaggagctacccactgtgggtatcctgagagctgtcacgtcactcagtgaagctcctctccaccttgctcaccctccagttttctgtatacctcattcttcctggatgtgggacaagaactcagagcccaccaaatggtggtactgaaagagctatgacacaaacggggctgaaacatgacccccccactcaccatgttgagggtgccgagaagggaagaagagctgtggccctttggggagcccaaacctaggggctccccaagccagggctgtaacagcctctttggtgctgtgtggtttctggcatctccgagctttcgggcagcactgtgtccgccatctccagatgctggtgcctgcagcagaagttactggcagtatatctggtccagccacagcctcacatgaagcctgcacctgtgccagcacctggagctgcccagtctgctacagcagctgggatgcctggctgtgtgtagtggctggaccccatgcttgcttgctcacacacccctcactgctccacacctggcttgcccttggcaagtgtgggatctgggctggcagcacaggccaagcacagcctgctgggctgagtgggtagaacaagctcagtgggtgcaagcaaaacttgggcaaagatgccaccagccacagaggttctggctggcaaagtgataccccaaggatcctgtgacaaaatgatggtgattttttttaatggccatggctaaaattgttattctctattctgaggtcatgtatgtatctacccactttattgagcacactgataagagactgctttgtgctgcaaagtatacaagcaaataatacactattttggacagcaaggatcttctaattgtttatagtaatgttaaaaagaaaaaaatgcagtaagacattgtaatttactagttctttcaaaatactgcatttcaattttttcaatgtgaagataaactctagttttgaatgggcatggctgacttaaatggacaaacctctttcaaactagctttgtagaggttaagttcagttaggtaaatgcagtttcaacatttaaatgtagctgtgtgaagggtaacaaattgaagttactcagcttcaactgaactgcagagctggttaaaaaaacaatgcaagtagccttgctataggaagttgttaaaacacaacttgttagaggcttaatttgagtttggcagaaatacagggctgacatctgctgtcacatgtttgaagcatgaatatatccttccaagaaacaagtgatgcagattttcttttcatgcaacagttgtaggtacttccactttctgtagtaaaagaatatttctgaaagaatccatagggggaacagtatagatagtctttgaaatgaagtggtttgcaactttagagctacactatacatagtgatctgcattagcacaagaagactgttttgtatcaaatataatttaactcaaaatgtgtatgttcccatcggtttcatatgggagccaaacacagatttaaggagcaatctcatcagttctctcaggaatattgcataataatgtttttgtctctaaaacacagaggaggtaaatattatttgttactgttagtttctcccatgattgaagacagggatagaacaatacgtaagagtctaaaatgaataccatcagctccacattgtttagtgattatatctttacgatggtgaaattggaagtagccttttcacatttagctaaacacactttgacatgtgataattataaagtgagccacatatctgcaggaaatacgtgtgatgttttccactcttaacagctgacttggtggctcgcaacattattggcataccattttcaagtgaattatatgtttcagcatataaattcttgatttagcatagtgtcttaatagctaaaggataggttgggaaaatcaaacttttatttctctggcagatatttacaaagtggaaacatctgtttcaattgttgtgggacaatctatgctcactgtggggcagttaggaagccagggcatttttgtaaacctttccatgagttaacatttgatgccttcctctggctcttcccaagctttctccatggctcttgcagactggtcagaaattattctttgactgagttaactgccttgtggaaacctctgtaattatcatggcccagacatttaaaaaaactatttgctcatcagatcttttccagaactcagaaatgacccaaaaatgtttgtccctcaagcatattaccagtgtcattactgcctcaataaactgtgtatgcggatagaaaatgaactcttttatttccatgtgaaatcatcatgctttagtatttccagactccattcattcattcattcattcattcattcattcagggaatcacatgatgaagaaaaaagctaaaagtcagtatagtcattttcatattttgctaaaagctttctgtttcatttaattttagaaaatagagtaaaaataccacactgttaaatctaccattggccttgttgctggtataaatagagtatttggttttccatcactggctttctgtcatggccctttttccatattctagatggactccagcaaaagaaatagaataaggtccttgacctggtgaagatgaggttttcagggagcagatatagtagggaagagtagggctgtcctgtgaaccaggtggcattatgaaggacatgtgagagagtccagtggggagcactcacttaatcgtctctctgcaaagccaagaaagccaagcatgctaaaaagacaagacattcccattcaccagcatacatacccctgacacaagaaatgagtgctgtctatgtgaggcttgactctggtgtatcagacagagcccagtttctagagtttatattgacacagtttgctcaaagaatcatattcttctacatgaactgatctactcggtgggaaaaggtttgcatgccgatgtgtgagtgaccacttaggaaaaatataaagcatcttgtctttgccctaaaaaacagaaaatgcagaacacttttcctgttctttaagacaacattctcaggacttgtgtactgtctatgtgctcaggaatgaaaacctattagaaaaggagagaaaacacaggggagatatgagggagacatgttttatatgttttaaagtataagtaccagtaatttatttttttacctgatattcaacttttttttttttttttttgaggcaaagtctcgccctgtcactcagggttcaagcgattctcctgcctcagcctcccgaatagctgggactacaggtgcccaccaccacacctggctaattttttctatttttagtaaggatggggtttcaccatgtcctggctggcctcaaactcctgacctcgcctcaagtgatcctcccttctcggcctcccaaagtgctgggattacagacgtgagccactgcacacagcctctgatgttcaactttttgataagtagtgaatagaaagcagacaggggtgttttgaaggtgtgatggttgttttctgtctgcctacaagagtggaatccttggctcacgcctgtaatcccagcacttggggaggctgatgtgggtggatcgcaaggtcaagagatggagaccatcctggttaacacgatgaaaccccgtctctactaaaaatacaaaaaaattagccgggcgtggtggcgggtgcctgtagtcccagctacttgggaggctgaggcaggagaatggcgtgaacccgggaggcagagcttgcactgagccgagatcgtgccactgcactccagcctgggtgacagagcaagactccgtctcaaaaaaaaaaaaaaaaaaaaaagaatggaatcctgcctggcaaaggatggaagggatctctgaggtcaaactgatgacagttacattaattaatcacttgtgtaaaaatgggaagaagtagaaatcaagtatgtttcagaaagtgtccctctttcctttgctgtatctcttagtaccctctagtggtgtcagcctaacattttcttacatgtaacgtgatcctgacagacatgttcagcgtttgcaagccacgtctctatatacttatgtatgaggtaatcaactaaaaatcaacaaacattttttatcaaattccaacctcctagcttctatctaagatattggattggtgggaaaggccattattactcattttattcctaagactaaagagttatacttcttcactatttctcctacctcagagctgacttttgagaagaaacactttagctatgttggcaatttgtggcataggaatatatcacattttaattaagcatcacatatatttgaagacttgttcacacatataaagaagttccattctaaggctgtccctgccaaatgacaaatacttggtaatcaccaaattggtattgtgggagtgggttagtgactactcatcaagcttttcatgaaaaccccagatttatagcctcttaatttgttctgaacccttgccctgaatatattaattcaccttctaatttttttttttgcaaatatggtcaacatgtctttctgctttatgaaaatgtcagagatgagtataaagataggtcaataaccacccgggaaaaaacccaagaaatctaaacaccagtaacttgcaaaggaagcttctatgtataatatagagtcgtgtgcatctcatgctgtttcactaaaaaattcctataaacagaagagaattcttacctgaaagtccatgagtataacctggtgaagattaccttttaccttcagattttaggtacatacaagttatatttttaaggaagacttttcagattatgaaagtgccaagacatgcttagtgtaaaaattttaaaaagtaccaaaaaaaatgaagaaaatgctaatcctaaaaaccataaaacttggatctacttccctccaaccttcttttctgtgtgtattgtagtataatggagattatattctatattataatttgtgcctgtgtttttttaacaaataagcattttcctatcttgttaatgattatatgctgtgctgtatgtataattcattgttttgtgttattattgccagtcacttaagtttaggcagtcatattaattacccatgtttttagccttttgaattatttttcctataatttgataatattttcactataaacaaatgtatcttcctgaaagtgaattaacataactagactcacaaaaggtataagtaatttgtaaatacatggggtgtgcatacatttctcatacatccaggtgactttgtgtaaaatgctgaagttcatatgcttcctttttcagatgacttgcatgagtagtctcaaagtcacagcacagtgaatactttatgaaaaatgaagcatgtggttttggtttcggagagcaacctcaaccccaatttaggtcatttccatagtgaatctgtgttaaagcactgttttccacatccttttactgcagaatagacagtgtgttattagcgagaatagcccacctgcttttcttctcattcaaaccacagacctctctaacaaagctgtgctcctaggttgtcatgctcagaggcgccaaactatttaccttggagggtcgcttggcctcattcataccagcctctcttttgagccttgtttactatacgatgacagataatagcccaaggtagtattggtataaatgtgttggtttttaaatatattcttaaatgacttcaatatgaacaataatggtaacttttattgagcacatataatatgccaggcattggctacatgcgttatttagagcatctctttcattctcatactttgaagttggaactctgattatttccattttacacatgtagaaaagtgaggcatagaatggtgaggtcacttgccccattctgcagaactgtaaagggcagcagcatttgtgcctgcactgtcttcaagccagtgcttctaaccaccagctgtgccaccttcactaggccattagaccttcttacaaaggacattggaaacagaaaatcttaaaggagtaattaatctcagaaggccccctttgagtccttgggtttttttttgatggactccacctaaccatggactcctaagaccctccctccactgtagtgtatgtctgtgagtagactgaggacttgaacagggctaatctgtacaggatatatagaagaagccagtcttacacagggctcagtaagggagtaagggaggaatttagcagaaaagatttgggaaaagattctactttaccagtagaaataaaatatgttcattttgaaattggcaaataagagtaagatacaccaagaagtttttctttgtttagaagtgggaggtctttggggggattaatgataaattttggaggagattggatgtatttgttgaaactcaaatatggcctgctaaagaatggaaagttacaatgtgtttcttatcaatagataagaaatctcttacctattggtgattcagactctatcatctaagatgaactacaatgaatagaaactcattaataggccattttggaagctgttttattaataattgattttcttacaacttacaacatggcctttttctgagtttcttctcacttcagttcatcttaaaaatggctttactaggaactattgatgtccttggataggactaactaatccattataaagtaatcacatgaatttatacttgatgtcagaggtcacctttgtcttctaaatgtagagctggcaataatttgctagttggtcaggaaactcaaagtaatactttgagagtagcagtgaaatctgttcatttctgtgggttttttcacattattttatttacttttaaagaaatcaatgaatgtactgtgaaccctgatatctgtggagcaggacactgcattaacctaccagtgagatatacctgtatatgctacgagggctacaggttcagtgaacaacagaggaaatgtgtgggtaagagacaatttgattgactaaattattaaatatcaaacatttgaacattaagaacatttttttcttaaaccaacttaaccattttgggaaagtgttactggtttaattttttgaaagtttatcccttagctaagggagctcaaaaaaaggtttgctaaacaactggaattctcttacctctttgttcaacatttgtttacctcgcaaatgtaatatatttacataaaggtgaaataatttccaaaagctttttgggtaaagtaaacaaaatatgaattacagaaacagctacctaaaaacatgtatttagcaaaaacaaattaacattagtgtatactgcagtaaagaattacattcatttatgtacataagacttgatttttttaaagggattttaaaattgaaaatccatatatgctggcctgaaggtgtcagtcaatttagaaatttagggatctcatatatgctccttttggaaaaaaaaaaagtatctcagaaagatatgcagtagagttaaataaatcattttaatgtgactctaaatttaatttctctttttttttttaagaaaaagaaaattcagcactaaattatgaggccaataggaagcaacaaaggaacatatctaattaatacttctttagtatatgtgaattttgctgtttggtgtgtgtgtatgggggagaaaggagacagccacctggtccataatttggctatttccttgtcatttgtatacattatatgtgtcactttcagaacctagaatattaagttagaaaggcaacagagatgacctaatccaactccatccacatgcacggaggaagagtctctttcatggcatttctgactccctactgacagcaaattccattgcttggatgtctctcgttatcaggagaatccttctgtgttgacctgaaatctgcctctttgaaacaccagtgtcatggttttgtagttttagcctttgaagtgatacacagtaggctgcttctctcttccaggaacaatccttcaagtacgcgaggagaaagatcgtgtctccttttgctgttgtcctcagttataaaggttgggtggtacccagggaatagtatgatggtattttacagaacagggaaactaagttcttgctacacagaactaatatttttatatgtatttttgttaacagatattgatgagtgtactcaggtccaacacctctgctcccagggccgctgtgaaaacaccgagggaagtttcttgtgcatttgcccagcaggatttatggccagtgaggagggtactaactgcataggtaatggcagcattcttcctgcttacaaattcttagatctgagtttttagatcccctaagactatcatcagttcagtgcttatccagacaacccagaattttttattaaacaattatcatgacagcagtctgctagatcccaggtgatataaaaatggatttttttcccctaacatttttgaagaaagagtgtcatatatgtgcatagacaagatacattaaatgttacttttggaccaccctgcatgaatcaaaactggatgattttgatgtgtgtcaaacaaatcaaagggaaagtagaaatcagttactggccaggcgccatggcccacacctgtaatcccagcactttgggaggccgagcctggcggatcacctgaggtcgggagtttgagaccagcctgaccaacttggagaaaccctgtctctactaaaaatacagaattagccaggcatggtggtgcatgcctgtaatcccagctacttgggaggctgaggcaggagaattgcttaaacccaggaggtggaggttgcagtgagccgagatcacaccattgcactccagcctgggcaacaagagcgaaactccatctcaaaaaaaaaaagaaatcagttacttcgttattatatttgagctaagctgggagatgggagaggtttgaaacagtatttggaacacaaaactcaacaatgctatctgctcttcgtagatgttgacgaatgcctgaggccggacgtctgtggggaggggcactgtgtcaatactgtgggggccttccggtgtgaatactgtgacagcgggtaccgcatgactcagagaggccgttgtgagggtgagtcagctgagagtgttcagcacacatgacggtgatgtgcagggttggtaggcaccttgcctggttcttgtttccttcccacactcagtgcgtgacaccagtttatccaagctctttctgcttcctagattcacaggctctttgcctcttcctttcactggctcttttgggattattttccatcttcatgctctcattatttttcacctcaatatctgcctctctggtatttggaatgaaatcaccatagaatgattaattgcatcatatttagtagaaacacagacttaattacagagtccggaccattcatctgggaacatgctgcaggtgtaaccagtgttgattttttgtttttgaccttttcacctacttacattcctttgtctccaatgctttcttttacatgtgttctggtactttctcacagactccccaagaagcatggtctgacaaactttggtcagattccaactgtgcttaataaaatttcctcattattgaccacagcaatgagctttctctcattataaaaatgttataaaaagtatttatagcatggtcacaattattatccttttcatatttcttttcacgtttgtgtccaagttgctctggttctttttgaaaccaatgtagtgaggccaggcacggtggctcacgcctgcaatcccagtgctttgggaggttgaagcgggtggatcacttgaggccaggagtttgagaccagcctggccaacatgctgaaactccctctctcctaaaaatacaaaaattagctggatgtggtggcacacgcctgtaatcccagctacctgggaggctgagaaacaagaatcacttgaacctgggaggcagaggttgcagtgagctgagatcatgccactgcattccagcccaggtgacagagaaaaaccttgtctccaaaaaacaaagcaaaacaaaacaaaacactatggcactttttttgcaattattttcatgaagaaatacactgaccttctgctaaaaacctgtcatggaaatatgagggtgaaggaacacgggatctgtgagggcacgggagcatggtgctggttccttggggttccctgcctggctgtcagcagagcctaatagatctgggctctgttaggtggggcaggatggactaggttggcacagccagccctcagctgtcccctggcttctgcctgttggttttcttcactgctctaatgacccaggcctggagggagagctaattagacattttttggcagcctacacttgcccctcctgctggtgtcttgcctctgccccttgggttctaatctagagagaagtgggagtgttttatgttgctggatctctgatcagcatggagttttgtaccctccccgagggccacgaggctacagaacaagcacaggtgtaaagtgtctccacgctgctcttccagggaactctcctctgctgaagagatgcagcgtgggagcagctcaccacgcccacagtaactgcctgacctgtagccactgactttgcccctttgaaacgtagtacatcatctgtaaaataggaaccatgaagttaactttccaggttttcatgaaaataacttcatgttgccataacttgtatgatgcctgtcactttgttagttttcaagaagttatagtttctttaaatctccccccatccctgactccttttgtgtttgtatagatctcaagcacctctgtagttgcggggagtgctttaaaaaaatggggtgtttatttgacaagcatttatgtgcagagcagtatcccccaacccccaacaaagaagtcaaatactgatttttttttccctttctttctttctttctttctttctttctttctttctctctctctttctttttttctttctttctttctttttttttttttttttttaaagacagtcttgctctgtcgcccaggctggagtgcagtggtgcgatctcagctcactgcaagctccgcctcccgggttcacatcattctcctgcctcagcctcctgagtagctgggactacaggtgaccgccaccatgcccggctaatttttttttctatttttagtagagacagggtgtcaccgtgttagccaggatggtctcgatctcctgacctcgtgatctgccagcctcagcctcccaaagtgctgggattacaggtgtgagctactgcacccggcccaaatactgattcttaagttctacacacgggtcaagaatggaaagataagatacttaagtaataggatggaaaggaatagaaaataaattggaaaattatgtacttaaattggaagcttgtaggagaatattcggtgatattcaatatatgaaaattatttgggagaaagatgactagcgttccctcagtaaataatatataattctatccccatgaaaagtcttgaaaagaagaaggagccaagaaacgcggctgttttcaaatttcatcatggactagaaccaaacgtccccgggcttctggcacacagaagattttctcagctgtcactaacgaagttgctttcaaatagcaccagtctccaaggagtctattgtagtttacagacattatctcatgcatccttactttattctgttaaggtattataaggcaggtagttcctaatttatagaagaggggaaaagccgaggtgagagcaggtagaaattcagggacattatcttgtattgctcaacattgcaccctatttattgggctagcctgtctcgatggcattctctgatttagcagttgtagttctatttttttgaaatatcccatccagaggagaatgtaatgctatttggaaaatgaaactggcaagcaccatctttttgtagaacaagaagtcccagaacatctgacctaaaaaaaccactatgtatcattggccattggcaagaatttttactgatagaaaaaaaattacaacactgacctggtgcttattttgttaatatcatctttaactttttcactttaagtatcttttcacatgtctaatggtatgcagtgggagataatttttaagtatttactagaatgtagacatcacatacccatggatatttagtggacccattatatatttctttctttttttgtttctctagtttatgtcctgaaaatccgtttatattttaagtacgattaaaggtcatatatacattgtgtattgggatacttaaacattaaatccactcatataaattcaagatccacctcagaaaaaacacttatttcaaatgcagctagaagccatggtgttaacacttattttaaactgttgaactctctcttatatctttttcctcattttattgtttgacaatttttaaaaatgcctcaagctgtcgtagttatctcctcacagacttaaccatattttaggagatttttttctccccaaattggaaagaatgatgattaatgacttcagttagctatgaatatgaaaagtaaggtgtatttttaccagaaaatattaccatatggtcatatcaccgtgttttctggaaaggcttggaagtatgtgatgagttcactctctcctcatgtttttttttttttccacctccaaggaattcctgtcatatgaaaggttttaaattattccaacctaggatattcttgggcccatgaagccaaagtgagaatttccctagagcatccaatgtttgcagagagaacctctagctgggtggatacatagcttcctcacactcacccccattctttgtatttctttctggaaagctgtgctattacttgaaaggtttcatgtccagaaattggccctagaggagctgccaactcccagagtggagaggccaggtcctgctagttgaagaattggggccaggttcttccttggaatgtatgcaaatattttaatccaggtatgcttgaccatgcattattgccatgtatttaagtatagacccaatgtctcacttacccaattattgtttttcccactgaaatgtagatataacatgctttcccccgctgccttcatcacaaagtaagattttgctttggtattctgataaaatgttcacgacctaggtttttgatttttcagatattgatgaatgtttgaatccaagcacttgtccagatgagcagtgtgtgaattctcctggatcttaccagtgcgttccctgcacagaaggattccgaggctggaatggacagtgccttggtaggtactatagtgtacttatcaaagatttgtttcttctgcatggcccattttctgatagagtggtgtaatgccaatggagccctctttcaaaatgaaaaaatgaaatcttacatcattctaagaaaagttcccagtaacttttaaccattgagaaaataagaaaatgacttagcataaaggatgtaagattctcgatggggaaaataattaggattgaaacaaactgatattcctaatgagataaatatccaaaaccaaataagatagtaaggtctacaggaaggaagagagatggagagcaaaacacttaaaaagagagaagaagcatctaccacagacaagtagaattaggtaacacacacacacaaattttcaacagaagtatcaaaggtagtgctttaggcactgaggaagacagagtaatgtatttgctttgattctaattacccgtgctgtagttagctctgccccttaatggttttcatttgtgtctaccatgtaatctttttccctaaaacttgaactcttttccactccataccaaaactctgaatatgtgagttaaacttttcattcattcattccttctttcctttctccctcaaatgcttaagaacttactataggctatgcatggtggctcatgcctgtaatcccagaactttggaaggccgaggcacgaggatcacttgaggccaggagtttgacaccagcctgggcagcatagcaagacctcatctctacaaaacattaaaaaacttacctgggcttcgtggggtgtgtgcctgtaatctcagctacttgaaggctgaggtgggaggatcgcttgagtccaggagttcaaggtttcagtgagctatgattgtgccactgctctccagcccgagtgacagtgagaccctgtctctaaaatatgaaacaaaaggcaaaacttactgtatatccccagagttgtactaagttctgggatatattgagaggaaaaactgatatgaccccttccttttggtacttactgtctggtgggggagactgacatgcactcaaacatctcacagataaatgcaaactcacagatttgagacaagcactagaaaggagggttctatgatgctgtgagagcatatggtagaacgagctgcccttaggaaaattcttgagttgaggttcaactggtgagggggtgggagggagaacatttcaggcacagtaaacagcatatgcaagaggctcgtggaagaagaagagagcagaaggccagtgtagctgaaggccagagaacacaggaagatttgctgcaagatgagaggacagaccactgaaaaatttaaagccctcttagtcctgttaaaactgacggtcttcattctcatagccctgggaagacatttaggtgttttaatgggggttgcagaagtactctcagttttaaagctttagtctcatcaccaaacagcatcagctcagactctgtagctggtacggagagctccgtgtcctgagcccctaggcccatccccaacccaagagtctctgctgatggagttgtgagatgtagtctttgaagaaaagatttttattcattagttttttatttgataagcaattgtttttgtaactggtgctgaccaaaaagtattaatatatatggtttcagttttcccatttggcataaatttcatacttgcctatcaaggttccatgcgtattctcattttcacatcctgataaataatccaggagcagagccggaactctaccttaaataactacaattcataatagtagtgtaaacgcagccctgattcatgaatttattagtggaatgtgactgatcaaattggcaagtgattgttcttcaatataaataatactaaatgaattcttatacctatatgtgcatatatatatatatatatatatatataaactttagtgatagaagcacagcacctcatttaaaactaattttactttgtcaaccagatgagtagaatcataagcagaaatattagatcactgcatttctcaattcagccaaagtcccacatttagccccttgttttgtttttgcgttgctgaggtcatgtatttcctattgttaaatggaggcagtgtcctttatctttctgctttgggtaaaattttaggctctacataatctacaaatgaagccactcccccaagatttaattgcagttccatccattgttcatattggacttgcagctcttctaaatttctcatgagggcctttgcaggttatactgaaatagattttccatcttaattttttatagtagtagagctttcaaatgtcgagaagttgactgtgacaaaaagcagatattgcagcatgcctttctacttacattgaaccaatgggtgggttggaattttctgctaaactctgaccatgttaatgactgcccagccctagctttgtacttctggtactctaaaatacctttcagaaggtgcagtcttgtcttaagcctagttttgagttgagctcatcactaacataactggatatatattcattcatttaacaaatactgagtgtctaccttgtgccaggtatttttccagaacactggggattgagagtgactaaaataggccaggcacggtggctcacgcctgtaatcccagcactttgggaggccaagacgggtggatcatgaggtcaagagatcgagaccatcctggccaacatggtgaaaccctgtctctactaaaaatacaaaaattagctgggtgtggtggcacgcgcctataatcccagccacccagtaggctgaggcaggagaatcgcttgaacctgggaggcggaggttgcagtgagccgagattgcgccactgcactccagcctggcgacagagcaagactccatctcaaaaaaaaaaaaaaaaaaaaaaagagagagtgaataaaataaagtttttctcccttcattgtagttatactctagtgcttacgtcgtgcttacaaataaacacataagcaagtacaatatataggatgtcagatgtgatgcatgacgtgaagaaaagtaaagtaaaagattcagagtctttagagatcccttggtggtcaggatagtcaaatgctaagttattaacatgctcttcctggctagtcatttgttttgtctctaactgttacctgtgattatatccttttagttctgataatataggatatattgatgaattttttgccccaattgttaatgaaaattctccgtgataacattaaagactttttttttttttttttttttttttttgagacggagtctcgctctttcgcccaggctgaagtggagtggcgccatctcagctcactgcaacctccacctcccggattcacgccattctcctacctcagcctcctgagtaactgggactacaggcgcccgccaccacgcctggctaattttttgtatttttagtagagacggggtttcaccatgttagccaggatggtctggatctcctgacctcgtgatccacccgcctcggcctcccaaagtgctgggattacaggcgtgagccaccgtgcccggtcattaaaaagtttcctgcaatcacaccattttggtgaaaaatcctacatttgtcatttgttagttgccatctgtagagatgataatgtctatctcacagggctgccgtgttccataaatgttagtgtctttttttctaactctcctctcactgagtacatgtttttacattgttataatcaaacatgtacaatgttttatataacatttcttaaatttcacattatgcttatagttttttttctaaactggtctatcttcacgttgatttgactctctttctattgaatgacttcattaagcattgctattcaacccctatattctgcagggattttataccagttacactttctgcttctttcacagactaaatgatgaacttggtgaaaccgttaatggcctctttgtattcatgacatgtaagctggatcttactgattgatgcttctccttgatttataaattagagcagaaattgttttgggcagaaataggcaaaatgttagcaggtgttttctgagggactacattttttccctagtgtttagctcaggtcatacaatccctcatcctcaatagtttattatccacttcaaatatctatcatttcagactgtacctaacacacatcatccctaatgctttttggcaactcttgttggctcttctgttaacgtagcttcttctttcaagtcgtggatttcattcttctctagagagtcacgttcgtcattcggcactgtattccttggacctgacattcagcctggagttgctgcccactcgatccccacctttaatgactatttcatcactctgggttctggccagttccaaatggctatttcaaccaagtcctttcttaagggaagccaccctgtcaggtactcaatttacaggttcttcttggcttgtggagatctggcctgattgaaacccgatgagagccatcccccaaggaaactctctaatatttaattatttaaagatacatttgatattgctaatgtagagatcttagttccctgaatttagacagagtttgggctacatgacctctctgaagcttagttttattatctgtaaaatggggattgaaatacttgctgtttaagctttcttgccagaatgaagtaagcaatatgaagcacctagtaggcatctgacatatggtggaaccccatccatgctacaaccctttttccccaactattaccctcctctatactgctcttgtcctcaaacataagagatgcagtaataactggtacttggtaaagtaagttatgtatcacattctttttttttttttttttttttctgagatggagtctcactcttgtcgcccaggctggagtgcaatggcgtgatctcggctcactgcaacctccgcctccagggttcaagtgattctcctgcgtcagcctcccgagtagctgggattacaggtgcccgccaccacgcttggctaatttttgtatttttagtagagatggggtttcaccatgttggccaggctagcctcgaactcctgacctcaggtgatccacccatctcagtccccgaaagtgctgggattacaggggtaagccaccgtgcccgggtcacattcttctatataactatattctctttggctttttgaagctcatgtcatatagttttttaattcttcttatgtcattggagcattctcttttctttctttctttttctttttttttttttttgagacggagtctccctctgttgcccaggctggagtgcaatggcgcgatctcggctcactgcaacctccacctcccgggttcaagcagttctcctgcctcagtctcctgagttgctgggattacagctgcatgccattatgcccggctaatttttgtatttttagtagaggtggggtttcaccatgttggtcaggctgttctagaactcctgaccttgtgatccaccttcctcagactcccaaagtgctgggattacaggcgtgagccaccgcacctggccttttggagcattcttttatgaatgtaaataattttgtggttcctgttcaatatctcccatccaaatactaactgggcccaccctgcttagcttccaaggtcagactagatcgggcacgttcagggtgatatgtctgttgactccttccaacttcttagtgttcttacttagctggaatatacttcttgggagccatgatacttctctgtagggtcattagtgattcctaacaaatgttcaggcatctataataatgctgctatttccattcctgtactttattgtctctgctcaccttcacaaggcagaatatgccacctattggatatatgcagctagccttttgggggttgtcttgctttgtagttcagtttgtgatagaacttgagacccggtaacacaaaattctgagattttgtcagtgtaatctttcttttttaacccctgattaagttgagaatgactttctgactcccatttaaactctgtgaatgtaggtcttgggtatttgaagaatttagtatcattcagtctacttgacaactgattagctacagtcttaaccaagacctggcacagagaacttgaagaataaacttggacagaaaacatggagaactcattgttctagaagttcttttcacactaggctttattttcagatttgaagattcagtgttaactttcatggcttatatgaatattcatagactaatccaaaattgaagacttggtacagcagatatttgttttatagaagattgcaactgagtacagcatgtacctttttcatattttatgtgcaaacattagctttatccctacattattatatgctaaaggatgcttctaatcaatcactaagctatttattgagctgttgtctgtgtatctatatgccagagaagattggcagttataaaaacacccacccaaatgtccaacaatgatagactggattaagaaaacgtggcacgtatacaccatggaatactatgcagccataaaaaaatgatgagttcatgtcctttgtagggacagggatgaagctggaaaccatcattctcagcaaactatcgcaaggacaaaaaaccaaacaccgcatgttctcactcataggtgggaattgaacaatgagaacacatggacacaggaaggggaacatcacacaccaggacctgttgtggggtgaggggagggggaagagatagcattaggagatatacctaatgttaaatgaagagttaatgggtgcagcacaccaacatggcacatgtatacatatgtaacaaacctgcacgttgtgcacatgtaccctaaaacttaaaagtataataaaaataaaataaaaacaacaacaacaacaacaacaacaacttttgaaagcaggcagcatggtttgtgggaacattaattattataacaaaatccttctcattgtatagtttatgaaggttttgacatgatggcatcatttgatcctcacagtagtcatctctgtagtacaagtgtggaaattgattcccaaacaagtgaatgggctaactaaaggttataggtaataaatgtcagaactaggatgtgacctctgatcttttatctctaaatccagtgttttgttctgtacaatgtctcatgtacccttcgtgtacacgtaagaaaactaaagaacaaaacaatataatgaagacaataaggaaaataaaagagcatagaaaggagaaagccacatgggctggaatcatcccttgcaagcagcagtaacaatggcttgaggattctagagtttgagacagcaagtctgcaccatatgtagtggcagttgagttttgctgaaagataaaatgctcctttggaaaggtgaggtaggaagccaataatttggtgggattagtgattggatttttctgagatcatccttggctctttatgtaggatgtgcatagcattcattggttcttctccagttctgcaaagccgtgatgattctttgaggattatgtaacaaatgtttgtcagcagctctgctgctactaccacatattttaacttcatcagaattgacagagggggtgtgagattctgaggatctactatacctcaaatgcagttgaggtggtttcatcacactggctggaccaacatctgtctctcattttgccatgcttgcttttctgccaaatatgttcttccatcttctttaatataaaagattatgtgtgaagaatagttgaggagtcgctggagtaatgacacatttggggtaggggataatcctgtgttttcatgtagctgtagtgctagaataagatgctttatccctatctcaagtggtactcactcactgaagcctgtattggtgattaaggaacaaattgaatttggatagccttagagaaataattggctatgttgacatactcatctcattgaaagtacaggaagtaatacaggtaaattactgctccgggacaaattctagccaaccccaagcagctgctacatgaaatgtaagtgagcacaggctggggagaacatgactgggtgacatcagccactgaataccctctgtacatggtgggctgtgcccaccagggaggggcttgagacagtctggtatgttcccaggatattaggaagggaaattttaaattttaaaaggttcttcacccagatgaattacaccccaaggcaacgagacaatgagccaggtgggattactggccagctgggagtcatctctgtgaaattgtggagaattgatagttaccagaggatacggagagagtaatgttctcatttccccgcaaaaagaaaagaagttggaggccaggtgcggtggctcacgcctgtaatctcagcactttgggaggccgaggcgggcagatcacaaggtcaggagatcgagaccatcctggctaacacagtgaaaccccgtctctattaaaaatacaaaaaattagccaggtgtgctggcaggcacctgtagtcccagctactcaggaggctgaggcaggagaatcgcttgaacccaggaagcagaagttgcagtgagccgagatcgcaccactgcactccagcctgggtgacagagcgagactctgtctcaaaaaaaaaaaaaaaagaaaaaagaaaagaaggtggagtctgggaattactgaccactgagcttcatgttaatcttgacaaagaactgtagaatgcatgattcaaatgatgagatgaaacattttaaaaaggaagtgatgattataagaaccagtcaggattcgttaaggataaatcatgctagactgtcctgactgcctttcctgatacagtgattagatgagtagaccaggaaattctgtgggcatggcacatctagttttcaacaatgtacttgttagagtctctctgggcactgtagatgagaaggatcaatttggattgggtgataggattgtaagatggatgcatacatctttgaactatctgcctaccaagtctgacctgatacctcggcaagtttcttaccctgggaggtttaattaattcattgagtggcaaatgccaaattgttatgtctcaaaagcccattggtaaattgtttgagatttagaatccatttttcttttctttctttttttattttttaaagtgtcaaggtcttgtccaggctggagtacaacagcatgatcacagctcactgcagtctctaactcctgggctccagtgattctcctgcctcagcctcccaagtagctgggactacaggcacgcaccaccacactcagctaatttaaaaaaaaaatttgtgtgtggagacaggggcttgctgtggtggccagactggtctcaaactcttgtcctcaagcagccctcccacctcagcctcctgagtttctaggattatagacaagagccaccacacctggctagaaccaattttttttatcaacactgttttttattatatttcctaacagataaaacgcaaaggcctgttgaactcattatgtatatgcactggaagaatttgggtaatatgaacattctgtaagaccatatcttagagtaagacaaattttgagctctaccatgaaaaccagaggcataatcatctccctctgcttcagggaaaaggcaaccatggggtggatggtggggtgggtaggcaccacctgcttccttcataacccattttgtgttgctgtaacggaacaccttgagactaggtcatttatgaagaagagaggtttattgatttagctcatggttctggagactggcaaattcaagatcagatggccacttctggtgagagccttgtgctgcgtcttaatatgctggagaagtggcaggtgaagcaagtgcatgcaaagagagcaaaacacagaggcaacctcactttataacaatccactctcttgggaacaatttcattcccacgagaactaacccagtctcgagagaaagacattcatctatcttaatgaactaatcacctcttaaaagcacgacttccctatgctgccaccttgacaaccaagcctcaacatgagttttagcagggacaaaccattttcaaagcatagcacttcttatggcattgatgggagatcttcccaagggttggaagctagaactgtgggggccaagccttctgctatcattaccacccagggccccacaagtttgtgtccttgactaaactgaagaacactgaaagtcatggaaggtttttaaagtagaggagccaacaccatttatcagatttgtattttagaaaaaagtttattctgtctgcaagctggataatggattagagaagccaagtcttagacaaacaaattaaaagactgtggcagtaactcgggtgagaaagaatgaaagtaggtgatttgagagatatttgaagggcagattggtatgcctgggcaataacaatgtgaggaaagagggagagtaaaaataaggactcaggtttctgacttgggcatttgagtagataatggtactagatattggtgtgaaaaataacataaagaaaagacagaggaggggtcagttttggccataaagactcagaggtacctgggggacatcaaggagatgtccagtagacttaccagctggatgcatgcttctacagtttaggagagaaatctgggccaacgatataatgctgaattaattttacaccatttgcatccaccaagtgtttttacgtgtggttcctctctggagaccttccttctttgtagagattctttagtgatattttactgtcttgctattttctcaggagcatagtctcattaaggcaatgtactttcagttcaaactgttctatctacggtgattggcttgacagaattctggttccatgcaattatgtctataataagtaaagaaagaataaacacatcaggctaccctagatatttcaaggcattctgcttcatcattaatcatgagtagcctagaaaaatagaagttttataagtatctcctaaatggtaatctgcagtgtctgttaatttactttacctagagaaagtatggtcttagaaattgattttgctgttatattctacagccttataaatcactttccctggtgcatgaataattaaagagagcaatccatacatttctgagcttgttaacatttttgaaacaaaaccagatactaaacatgacattttcctgttgctgtctggaatttctatgcctggtgtctaggctcattcccattatttactttggctccaatgcttggcttcttctttcaagttgtttgccttcagtgtttacagaagtggattcccacaaccaaggaaagggtggttaatgagtcagtctggaagtgctatttttgttatcgtggactagagtcagctcaccataattagtgatattttgtgaaagcaacgcagagcacctaggcagtgccatttccttggctcttctcagtatgtgcagggaacacacccgtgtgcacactcacagatacgtgtttgccacattttagtacaactccgtttctgcattccactgtaagaaagaatacagtcttaatacagtgcaaatgcatgcaatctagactctgggtttgtattgtcagtgtgcttgtgactgccttaagagggtagaaagctttgctgctttcgtggtgtagtgagcattgaaaagtgaaacagatgctgtcacgtgtcttttcctccttgtttgcctggcttaggcttaagatgctttgattatgttatagacccctataagattaagcctaattgtgttattgtatgtgtagttttagcattttgtgatttaagtttttcctctttaagttcttgcttattgatacctcactagtgtctgtcactgtgacatacggtggacctacccagggccattcaaatggagcacagaacttacatgtttatttatttttgaaaaatagtaatatgtagtagggacttaatattttttaatgaagtagattttagatgattattttcaatataaatgctgtgttagcaaataataaaaacaaacatcaattcatacattctctctttctttaactgtttctatcactagatttaactttgcctgtgacagaaacttacagtcaggttaaaaggataggcttgggttcacatctcagaaccaccattttctatgtggcgttgggctggttattgaacttctctaagcttcagttccttcctccataaaatggttggcccataaggattttgttcggattaaatgagatgatgtatgtaaagcttttaatgcccacatgtagcaagtgcttgataaagattaggtgctattattattatctacctcttcagcgtgtgccctaccttcaaactgcccagtaggcttgtgtttgtcccttagattacttggtttttatcatatggattcactgccattttagagctttttattggactctttttcacctttctgttaaaacttctctgtgatttctctgggtcatgagtcatatcttttgcttttgtgaactctcccatcctattgaattcatcaatttccaaaatagacctcaacccatctttggttctttggaaaatgctttcttgtagagatgttgcactaaatctcccgtctcttccttcctcccccctacaacaagccatctttacttcttgaatttattcacagagcatatttggttccgagttactttcagaaggtaagttaaagtatagaaccgtcatccatttagctcacgacaagctgctttttctcctttgggctaatttgaaagtttatctttaagaatctgcctggtcttctgaaggtctactgtttccatttctaaccaaatttaactttatccatgttttctttttcttctttttttgttctttccattacgcaacattcttcaagatgtggacgagtgcctggaaccaaacgtctgcgcaaatggtgattgttccaaccttgaaggctcctacatgtgttcatgccacaaaggctatacccggactccggaccacaagcactgtagaggtaaatactgtgatcaagtttcccatttttatttaaacttcatttaaatatagattagagcaattagccttagaaaagggaaccctgctacctgtgtttattttgaccgagcgacttagagcacatattggttggcttggctgaaagtggctccttgctgtggttaaatacagagcatatctatttacataaagggaaacgatgtatttttagagagtgtctgtgagccacagatcggttcatctaaatttttttttctcattataaaagcaatacacacagttgcacaactctgtgaatatattaaaaaccattgaattgtacattttaaatggaattgtatagcatgggaattatttctgaataaaattgatatgaaagtaaccaatatacactcattttagaaaatttagcaaatagagaaaaaagaaaagtaacaatcttacataatgtcattaatgaatattcatatttcgtggatattgtatataaagatgttctatgtataattttatatcttgctttttgccatttaatagtatacctaccataagtgttttacattccattcataactttttttcaaacgttatttttagaggctgcacaatattctagtatattcctatatcacagttttcttgctcttctttaggtattgaacaaacaaaaaattttcagcttctcattagtgaacaaaactggtacaggtcttttttttttttttttttttttttttttgagctgaagtctcactgtgttgcccaggctagagtgcagtggcatgatcttggctcattgcaacctccaccctccaagttcaagtgattctcctgcctcagcctcccgagtagctgggattacaggcacacgccaccacgcccgactaatttttgtttgtttgtttgtttctttgttttgggtgtttttttgaggtggagtcttgctctctcccccaggctggagtgctgtggcatgatcttgactcactgcaacccctgcctcctgggttctagcgaatctcctgcctcagcctcctgagtagctgggattacaggtgcctcccaccatgcccagctaatttttatatttttagtagagacagggtttcaccatgttgggtaggctggtcttgaatgcctgacctcgggtgatctgcccacctaggcctcccaaattgctgagattacaggcgtgagccaccacacctggctaggtctcttttaaaaataaacttttgtctgaactttagaattatttccttattcataaaagtggaattattgggtaaaattttttttttttttttttttggagacagagtcttgctctgtcgcccaggctagagtgcagtagtacgatcttggctcactgcaacctccgcctcccaggttcaagcgattctcctgcctcagccgcctgagtagctgggactacaggcacccgccatcatgcccagctaatttttgtatttttagtaaagacgaggtttcaccatattggtcaggctggtctcgaactcctgaccttttgatccacctgcctcagcctcccaaagtgctgggattacaggcatgagccaccacgcctggcaaaaatgttctgaatttttttactatttggttttttttttaattggcatgtaataattgtccatattgtacatatttatggggcacacagtgatgttttgatacatatattgtatcatggtctttttactatttttacaggagaacattctcatttcatatatatatttattttaattctgaaaaggcttaatttttttatatgttcattccctttagcgattctctgaacacttctaatttttaaacatttattttatatacttaacatttatatttgtttttaaaatttccattaatatcatttctcatttatccggctttttatttgtttaatcaatgtatacgaactctttatatatgtaatacatatataaacgtatgtacatgtggccggacacagcactttgggaggcccaaggcagatggatcacctgaagtcaggagttcgagaccagcttggccaacatggtgaaaccctgtctctactaaaaatacaaaaattagccgggcttggtggcatgcgcatgtaatcccagctacttaggaggctgagacacaagaatcacttgaacccgagaagcagaggttgcagtgaactgagatcgtgccactgcacaccagcctgagtgacagagcaagactcaaaatagagtctcaatgatgataataataataataataataaatatgtgtacattacgtatacatttttggtggtacactgttgtaatttctccaaggcttccctaattttcctttttatgattttttaaaaattttttcttatggccaaatctgtggatttttttcttttctgcttacttttacatctaaaagtatgttctagcaaagggtaaaagaggaaataagtaaacattttcttcttaagtgtcttgatgtaagtgaaggatgtagggtgataattaatttctcactatggtaggcaagtagtaaatgaataccctggtatcctgtaagaatcgaggcctcttccactggcagtagggaacatgcaggcatctggatttgatgccttgctccaataatacaacagagcaacagtggatcttggccactcctagtggaacatctaacgtgggcacacctccatttctcctggtcccttctcttttggctcacatccacagtttcctactgattccttaagccaggtatctcctcagaccaaattaaatatgagaagcatctgaaaggtattatttcttcccccatacactggatcaatggtggatgaggatctcaagccttaggagtcatggttaatctttgattgctatatctagtttattttcatatcctgccattttatcttctttcatcctaatctgcctaatttttttcatctgcttgttgataaaaactcttgtaatctgtcctcctctttcatagtccaaacttacttgtcacagttgcattcttcagctagcattctctgacctatccaaatcaatgtcacaactgccctgtgaagattcttcacagggcagtacttggacccaagtacttgttcaagattatcctgcctttcatattcatcttcttcctcactgcttacctgatgtggctcttccagtggttcatggtatgaccttgggtgaataatctcaggtttccagacattgtgtcatccctaaaattaggggatcagactctctaatgggatgctcaaagtagcacatgttgaatgaatggctcattaccactgtcttgctcttggctgttgccatcccagctgagcctgggaaagattggttggggagacaagacaactaacagcaatctaatatccaagattataatatatatataatgtctaaagtctagtatttagttttgtttttttaaaaaaaggcagcatatcggatgctagtcctgatgcgtagaagctgtgtgagcttggataagttacggtatcttacttcactaagccttacttttctcatctgcaaataaaagggagcaataatggtacctgctagagttgatatgaggattgcaggaaataatacagggacagagatcatgtagagagaatgagttaaagcaggggcagagcatgacatggtggtggtggtgtttgctaaattagaggcataaacaaagtttcgttaaagccaagaagtgtgtggctaactctgcttgtgtgcgtctgggaaagcttcacaaaggtattgctatttgaacttagtcttgaagtactgaatacaaaggggagtaaaacttggcaggcagaggaaacagcatatgccaaagcttagaggtgagaaagggctattacttccacttggcatttaaccttgacctctactccgattctaatggcgtcttcccattacagcctgggatgcattacctcattcttcccacatgatctctgtccctgtattatttcatgcaatcctcatatcagctctagtaggaagcattattgttcccttttttttgcagatgagaaagctcacacagcttctacacgtcagagctaggatctaatatactgctttatttatttatttatttatttatttatttatttatttatttatttattgagatggagtctcgctttgtcgcccaggctggagtgcagtggtgcgatctcggcgcactgcaacctctgcctcccaggttcaagtgattcttctgcctcagcctcctgggcagctgggactacaggcacgtgccatcacacctggctaatttttgtatttttagtagagatggggtttcaccatgttagccagaatggtctcctgaccttgtgatccgcccacctcggcctcccaaagtgctggtattacaagcatcagccattacacccggccctgccttttcaaaacaaaacaaaacaaaacaaaaacaaaaaactaaacactagactttatttggatttcacaagtttttccagtcacgtcctctttctgttccaggatccaatccaggatactacactgcatttagttgtctagtctccccaatgaatctttccctagttttcatgatcttatctatcttaaagagtataggccagaatcctgtagcttttccccactctggatccatctgatgtttttctcatgattaaactggggtcatgggtttttgggaagaagaacacagaggtgaaaggctctggtcctcacataatgtcaggtgtacattcacatgtcgggggtgtgtgatattcttggcacaaaagaaagaagacatttgtccagcattcctattttattagaaagctttcttttggctcagaaatgctatccctcattagaaaagaaaaatatttttatccctagaattaatctatctttgttcccttggtcattttaaagacccaaagatcaccttgtgcaagataactgtgttgcctcaagttattccaagtgtatgtgtcattacttgtcatgaattactcctgacattcttagcaacataaatgagtcagttacgtaagatgtctggcatagcctgatagtccttggaatggagggtctatctctgttgcagacatcttcacatgggaatgcttaatttgttgtcttctatgagaaagtcaaaaagattccaaagcactaaaaatgttgtcagatgttatgtgagatccagccagctacaagaactattgttggtcttcagttcgtgaactgacatctcaagtattttatagaatgtgctaaaagaaaatagtgacgtaggctgatctttgctggcaaccattcctaaagctaagagacttacagtgtttgaaaggtataaaataatctttaaaatgaaagttaccttgtttattttctctatggacagacaatattggcagccaggaattatttataaatcaaagagaccaagaacacaattggtaaaacaaaagtttttaatcaactaaagtaattgctatgaaatattaaataaaataagaaacaaatttttgaactccaattacattaatactttgagctatttcaggaaactatgtcagtatttcagtagcaatttcaactatttcagggagggataacctgatactttgcttatatctggatacattttaaaagttaatgccccattagaggttaagaaatgaaactttgcggctaggtgtggtggctaacgcctgtaatcctagcactttgggagaacgaggcaggcggatcatgaggtcaagagatcaagaccatcctggccaacatggtgaaactccctctctactaaaaatacaaaaatgagctgggcgggaggctgaggcaggagaatcgcttgaacccgggagacggaggttgcagtgagccgagatagcgccactgcactccagcttggcgacagagcgagactctgtctcaaaaaaaaaaaaaaaagaagtttggctcaggagaaacaggtaattgtcaataatacttgagtgaaaggcctatacagttaattgagttttcctggcagacacttttagatgcattttaaataagaaaatttgaagaaaaccacagtcatacattgatctataggacatggtttttaaaaaacaaatccctctattttatttattactccctttagattagggctcctttctcctcctgtgagtatagggctaaagtgttttatatctattcccttcggtaatcttcacaacaaacctgtcatgtaggtgatgaagatcagttgtacctaccatgttttaataatcataaactcttataagttggctagccattcagcagaacattctgaggctgtatttgcactgacaaggcaagacagaattatctgcttaggtcggaccaatataatggccaaacaaaaacatctggaagactctactcttaccagacgtgttcaagttattgatgaagccagtcctttgcttcagttgtataacttcgtatacatgacattttctaggacacttattaagaattatcttctttctcagttagtgattttatcttgtcaaagcatgtttaaaaatcctcacttatcactttctcctttggtattcagcagtcatcataatactaccatttctcttggctttccttgttactttgaaaatgagccagagttctttatacaactgtttggccttatagttcaacttctagacaaagtagaattatctgtttccttccataactgcctatgtttttggttttgtttttcaaattcctagtcgagttttccttctgacttctttcatgcaactaaacaggtctgcaaactatctgagcgacattatattgcatcaggttctgccttctgtttgcagctctaaaatatttcatgttgtattccaagacactgatggtgaggagtatgattattataaatagcttattgatttattgtctatttttagttatttctattctatagatcagtatactgaggttgatacaacagcatgggtggagtgataaatactaaagtgtgtagtgccagacataagaagtactattatttttgttacactaatcccagaatgcattgcagggagcactgcattctcctgggtagtctctttttcagaaaaattgccgttgttgtgtttgcagatattgatgaatgtcagcaagggaatctatgtgtaaacgggcagtgcaaaaataccgagggctccttcaggtgcacctgtggacaggggtaccagctgtcggcagctaaagaccagtgtgaaggtaagagggtagtaacatgaactactgaaacttcagcttaaagcacctggtctgaaaaaggtacgctcaatcaagtgagtttaccttttaaaaattacccagataattgcattatagtgccagaaagccaggacttaaacataagttaggaaagtcaataaaacaagattgaagacagttaaatttgaaaacctatggcattagctatcaatggctaggcattagtattaagaagaaaaattattgctttctgtgtaattctttactacagaaggtaatttccatttaaacatgtaaattaatttaaagtttttatatacttggatttcagcaattagaaagtcattatatcgggctgctttatgctgtggaatgttaataaccttaatttttgtatttaacgttgaaaaattttgtcttttaaaaaaatcgctaaagaagatttctcaataaaactgtaataatgtcccccttagagagaaagtttgcaaaatatgttctgttcctacagctgatagtgaggattctggatttgctagggttgaccttagactttttaaagaaacatttcattgaattgcacacagaaatacttcacttcccaataagtatgtgcttcctgaacttgaagatattatgatctcacctgtgtcaaccacaagtgtccagagttcttgagaggaaacgccatttcttatttaagaacagaatccacactgtataaggccattgtttcataaataaacaatatccacgtcttcatgtatactctgaatatttgagaagcaaaaaagtctcctgagatagtattacaaaagcgacaatacatgatggtcattacttgtatcaacattgtctttctagaatttacactgatccaattgagactgattgaaaatgtttttgaagcaccacttccacagtttctttgtattctcttgctcatagacattgatgaatgccagcaccgtcatctctgtgctcatgggcagtgcaggaacactgagggctcttttcaatgtgtgtgtgaccagggttacagagcatctgggcttggagaccactgtgaaggtaagaattgctcctgatttcagaatcataaaatgcccagatcggagggaaatctgggcatcatctcagccttgatctttgaacctcatctcttgatttcatagtgaagacattaggtccctgcaaagtgtcttccccggggtcacacaaataattcaaagaagggagtagagtccagattatctttgcactgcttggagctgtcttttagacttgtgccagccaaaggcataaaagaatcagtttaactttaccagctatagatggtttatcctgggtacatagttctgaactgtaacaccttatttatgcagaaccaacttctaaatgttccaaataagtaaatacaacttaattttccaggcaattagaaggtttttcagagccaaacatcaattcagtttttggctttttgcataaaatatttctgaaagatatcccacatgtccagtatcgtgcagtcatcaaccactttcactacttgtttggctaagaagctctctgcagtggttgggtgactgaaccaggcctgcttatggagcggggaatatcttctcccagtgggcttctttttcacttttaccaccggtctgtcacttgtgacctttctctgcattcattgtccacctaagtaacaagctttttcccagcccacctgaggtttcactgcatttagagcctgtcagttgtgaaaccagaaatatgcatgttggcagggttgtgtctcccatgcagggtccaagtttttgaaggagggtctgaaccccacctttgagagaagtggatgagccttttggtgaatggtttcatgacacacacatttcagcagccccagatcctttttcactaccagtccagtggattgggaaagatctattgtcatttacagcatctacatttctgaccagagaacttggcagaagcagtcacaagtggctgagccccatatcctcctgctgctgggagtgtaaatgacccaaccctcgggaaggcaattttggcagcgttttaaaggccttaaagtgtatactgttaatgaatcagtaaatcaacttctaagattttatcctaaggtgatcatgttcctcaaagagttaataacaccagtgaaaagttgtaatcaatatacctattgaggccagatgtggtggctcatgcctgtaattccagcactttgggaggccgaggcaggtggatcacctgaggtcaggaggtcaagaccagcctggccaacatgctgaaaccccgtctctactaaaaaaatacaaatattagctgggcgtggtggcgcccagctaatatttttacacacacacacacacacacacacacacacacacaaacacacacaaacacacgcacacacacccctattgagaaataggtcagataagtgataatataagataggactatgtatgaaaaagttgtgttttaggaactctctaatatatgggtaaatgataatgattctagatagtgacatcccaaggtgggagggttggtggtgttggagggagacatttatggaagaatctattctagaactaagtaactggtaaggtatattctagggcagtggtccccaacttttttggcacacagggaccagtttcgtggaagccagtttttccctggatggggttgaggggatggtttcaggatgaaactgtcccacctcagatcatcaggcattagttagattttcttttttttttttttttgagacggaatctcgctctgtcacccaggctgagggcagtggcacgatctcagctcactgcaagcttcgcctcccaggttcacaccattctcctgcctcagcctcccgagtagctgggactacaagcacctgccaccatgcccggctaatttttttgtatttttaatagagacgggttttcaccgtgttaacctggatggtcttgatctcctgacctcgtgatccgcccatctcggcctcccaaagtgctgggattacaggcgtgagccaccgcacctggcctgcattggttagattctcataaggagcgtgcaacctagatccctcacatgcgctgttcacaagagggttcgccctcctatgagaatcgaatccagctgctgatctgtcaggagatggagctcaggcggtaatgctcgctccctgctgctcacctcctgcagtgccgcccggttcctaacaggccacggacccgtaccggtccatggcccagggattgaggacccctgtgctagggcactaaaaatgtaaactgaccatcagcatctcctctgtcctgattcctggccaagccaagaaggaactgcaccattgattaagtcttgggtaactgatgttcattggagggcatgttcctcgctttgtctcttttaatgtgtaagcattttaacagaagtctaaggtttttattccaaaaacatccattgcatgaaaagtcaaacaaaagcttttagcaaactcgttcttcattattaatgtatataagatatgactatgttccgtaagaaagcttcttttggaatatataatcaggcccttttaaagtcaggactagtttctctagtgtactgggttataaataggactggagtccatccaactaatttagagctccctttgaaactatgttagcacctcagcctgctaattcccaactagcaatgtttccgaccctccccagtgatatttagccataattaactaaaccgtgactgttcacacgcctctgacagctgtgcaaggaagagccatctttcttgttggcttttatgtttacacgtgtaattttcccctaatggttctggcaaagaccttgttttcttattgtcctgtcatcctgctggcctcctcgtagagtcagactcccaagtgttgtgcctgcttctgtgcgctactgactccagcatgcttggtagctagtcattctgtgataatgaacgtgcctcaattgtcctcattcttaggagtctggagcatctcagctttcaaaggctctgcctgtgacttgttccctccaagcacagtctttaatctcgtgtctaccttaacctttccccaatccctcactaaggttgctccctgcagtcctttacaaagctgagaagatgactcattacttacaatgtctttccctttccctctgtgccctttgctcttggtcatttatttgtggacaaaattttaaaaaggtggaaaggtgggatagtatttctttccaaatcagagtcattcatacattcacttatgtatttgttcaaatatttatttagtgtggagcttgtgccagacactgttctaggcatagggcaataaaccaaacagaaatttcttcccttttgtagcttacattgtagtgtgggagataacgaaaaaatacaataaatggctgggtgcagtggctcacgcctataatcccagcactttgggagttccgaggcaggtggatcacgaggtcaggagatcgagaccatcttagccaacatggtgaaacctcatctctactaaaaatacaaaaaaaaaagaaaaattatctgggtgtggcggcgtgtgcctgtagtcccaactactcaggaggctgaggcagaaaaatcactcgaacccaggaggcagaggttgcaacgagccaagatcacgccattgcactccagcctgggcaacagagcaagactatgtctcaaaatatatatatatgataaataagtaaaatatatagttcgttaaatggcaataaattttacagagaaaatagagcggggtatatggggagtgttgaggaagggtggtgattttaaataaagaggcaagtagaggcctcgctgggatgataacacttaatcatttatgggtagagcattcagttcaagggaatagcagatgcggatgcccgaggaaccagctatgtggagacctgaggggcaccacgtcagcactttccacttttgatgcccaagatgaatatttgaaggaagatatctgaaaggcaattgtatctatgcatttggaatttaggggtgagttctaggccatgaaattaattgggaatgagtgtagctagaagagagataaatcccgggccctccaacatttagaagtgaggaaatgggtaagaaccagcaaaggagattgaggaaaaagtggcaagtgaagaaggagaaaacccagaatccaagagaagaaagtgtttcaaggaggagggagtgatggattgtgtcaaatgttattgctaggtaacagaagaaccaaaagttaaccatgggatttttagcaagctggaagtagttggtgacctcaacaagctcagtcttggtagaaagatgacagtgattcactgttcctgcccttaaaaccttttactctacttctaggaaaaatatatattttcgcactaccccaggtggtggtacgaaatagtaccatgttgtgctctcgtaatgttcaaccttcttattgctttgaagacagataaaggccttgcaaaaaaaaatttaaactaaacctaaccctaacatatgctcagctttctaatgtatataattatttataaacactttaaataatgctcttttccctcacattcattatttgtcttagattttggaaaataaatgagaatcaaattgctttaaagtagcatgaacagagccgggcatggtggctcacgcctgtaatcccagcactttgggaggccgaggcgggtgaatcacttgaggtcaggagttcgagaccagcctggccaacatggtaaaaccccatctctactaaaaatacaaaaattagccggccgtggtggcaggcgcctgtaatcccagctactggggaggctgaggcaggagaatcgcttgaacctgggtggcaatagttgcagtgagtcaagatcacgccactgtactccggcctgggtgatagagcaaaactcagtctcaaaaaaaaaaaccaaaaaccagcatgaacagagcaacatgcttccattatgctgaggcaaacatctaggttatgaagtgttttttcttgtagaaattcatattcccaggattctcttatgatcttttttgaattgagttttttatttaatgtcactgatcaaatatgcttctcctcgcttcattatctccatttcctacaaagcaaagaaagaaaggttaatggaaaaactgattgtcagtcgggtgcagtggctcacacctgtaatcccagcactttgggaggccgaggcgggtggatcacaaggtcaagggatcgagaccgtcttggccaacatggtgaaaccccgtctctactaaaaatacaaaaatcagttgggcgtggtggtgggcgcctgtagtcccagctacttgggaggctgaggcaggagaattgcttgaacccgggaggcggaggttgcagtgagccgagatacaccgctgcactccagcctggcaacagagcgagactccatctcaaaaacaaaacaaaacataactgattgtctactttacacccattaaaatagttgtagagctgtcagagtaaatgtggaacaatcggagttctcatatgtttcctgtgggaatgtaattgctacagccacttcagataacagtttttcaaaacttaaatataacctaattccatgacccatgcatcgttttcctgggtatttactcaaaaaaggtaaaatcatatgttcacacaaagacttatgattttagaaatatttatagaaaccttattcacaatggcccagatggaaacaacccaaaatgcttatcaaaaggtgaatgagtaaacaaattatggtgcattcatccaatggaattctacccagcaataaagcacagagaactactgatacacacagcaacttgggtgaatctcaaaactattatgccgagaggaagaagccccaaagcacaaaaggagtgagagggaatgtattggggatggaaatgcctgttccttgactgggatggtggtcacaaggatgtgtatacatttgtcaaaactcattgagctgactcttaagtagatcaatttattttatgtacattatacttcagtaaagctagaaaaacacattaaagaaaaagttgagaacctgccttagttgagacaaattcacatcacctgtgttttatgttttagggtcagtacccggaagcattttaattctgggtgaacagtcattataataacgtggttttatttgatagaaagaagtgataaggcactctcttatttctcttttgtttgccctgtgaatagtacagaagcctgttaattggttgattggattctaggagaaaaatgaaattcggtatcaccgtacttgaaccagacagccgggcgtattagacagatggcaacagtctccatattcacttcttcctggaatctctcatattttggcagcaattacaattatttgcaagaaatgccataaaatgccaagttctgagaaaacaaagaaggttttgtttcttagctttcttcgttgctaataacttaaatcctcacattcacaacagaagagggctcatggagtacattaggaataatgtgctttgactaggggtaaacatggtaatcagcagcccttgagaaagatctgctcgcattcatgcggtgaaggggagccattaattgtctttcattctcacagtcaaaactcgttattggttatgtataccacttttagttgcgcatttgctatgaatttttttaaacatttttaaacattttttaaaatccaggctacctcaaacctgtttgttacagctgctgaataagtgacttaaactaggtttttgatcttgctgttctccttctgttcaaaagtccctcttcttccgactcccccatattctaccctactgtgaaatttactataagtaaatttacagatatgcttctgttacacaaaagttttattttaaactttatgatattctttgtctaaatgcatatgacccctaaagttgatgctactactttgtcagataattatattttgtgacaattcttatgttacattggtttggacttataaaacaatgtaatattttatgtttaataatacaatatcatttgtttattttattgttaataatacaatatagtttgtttctttgaacaaacatttctcttggggacaaagaccatgctgaaaacttttaaatttttttctataatgcataatacagaagcttgtataaatagatcaagtgttgctcaagatacacttaataagtatttttgaaatattttaagtctttatcatcaccaacaatataatcaagtaaattattatttgctacagaattttgacttttcctcttccatttaatttcatttgatgtttaaaagttccatttcttggccaggtgtggtggctcatgtctgtaatctcaacactttgggaggctgaggtgggcggatcacttgaggtccggagttgaagaccagactggccaacatggtgaaaccccatctctactaaaaatacaaaaattagttgggcgtggtggtgggcgcctataatcccaactactcgggaggctgaggcatgagaatcacttgaacctgggaggcagaggttgcagtgagccaagatagcgccactgcactccagcatgggtgatggcaagactccgtctcaaaaaaaaaaaaaaaaagttaaaaagttgtcatgtatttaaaattatgtattataaatgatgtaaaatagtgtacctttacatgtaagagaaatgtctaattttccgatatgtgatttatttagtctttaaaaatttttaaattggtttttagatatcaatgaatgcttggaggacaagagtgtttgccagagaggagactgcattaatactgcagggtcctatgattgtacttgtccggatggatttcagctagatgacaataaaacatgtcaaggtatttcttgctcttttttccccagtcattatttacgtaattcttcaattctgccatgttgccagatgatagtctgtggttttgccatgtgatttatatgtaaataatttatgtcaatttttgatattaaaatagctgtcttgggtccacatcaagtgcaggaaggtgttgctttgtccagcatagtgtcaactgaaactcacacgagtaagagctgtgtcctcactgcgtgcttccgtcacctgtactttactgtttattccatgctgtaaccttggtactgggttctaaattatctttatagcatcttttatgggcatattttattttgtctcataggtggtatttatctgtccttttctgactctatttttatccagtgcccgccattgctttttttttttttttgagacagagtctcgctcttgtcacccaggttggagtgcagtggtatgatctcggctcactgcaacctccacctcccaggttcaagcgattctcctgcctcagcttcctgagtagctgggattacaggcgcctgccaccacacccggcaaatttttgtatttttactggagacgggggtttcaccaccttggccaggctggtgttgaacacctgacctcgtgatccacccgctttggcctccaaaatgctgggattacaggcatgagccactgcacctggctcaccattgctttttctcttcctaaaaagcctcactaataatttggtcaaaatcatgaagaagaggatcttatattttttcaatgtgctgtcatgtttaatcttccaaactgtacagtgcatgaagggtactaatgaaaacacagcaacacaacacaggtactaataataacaatcacagcagctgtaactgagcttcttcagtgtgctgagtactgtaggtatcttggtatctcttcgaattcttacagcaacttcagaggtagcttttcttgtattcattttgtgcatgagtaactgaggctccgagaagttagggagtatgctgctctctaatgagtggtaaagttgagatttgaacccagggtcttttcccactactcttccctacattgccataccaattattgttacatttatagccaaaagaaagaagaaagtgaaattaagtgatttctctcacaaggtagcccattgagtcatttcaacaccatagctaaaaaaattaaattctctaggttctgtatcccaacatttttagctatacctgacttgccccacaagctttcctctatttactagtgttagtaaacccatgtttatattttccatggaaaattcacacttattttacctttatatctgtttatttttgatacccaataaatgttatttttttcttattgtttatctaccattatggaactgtgtagtgtatcccaaagcataaataaataaaaaaaattgttggagttactttttacccactattactgaatatgtatgatttttttaaaattctggattgccataagttatatctcatctcacatgtcccaaataacagtcttcttgtaggagaagatggtatctactctctaagatagtggcactggaattatatatctatattaccggtcacacccagccatgtgtcagagatatgaaaaacacggacctttgccacaaggtttttaaaaattaattcctttactgatccaaagatttaaatatacaccttcctgcacttgatgtgtacccaagacagatattttaaaaatcccaagatttaaatataccatgtacctcatttgagatcatgtatttatttgccatcctcatgcaataaggtgaaattcaattttttccaatgcagaaattaaatgtgcttggacttaatgcaaaagagaaggaatatttgaattataaatatatgtgagaatatttccactttgggactattaccttttaacaaaatgaatcttgatttatataaaaataccaagagatggaaaaaaaaaaaaaaaggaaaccaaaccctgactcttgtttttattataggctttttggcttaaaagtatattttcttttctaattcttctcgtcacaatttgttttggccaaatacaggcaaaaccaaatcttaataaaaatggaccaagatttcatattgcataaatttaacttctagagttcagtcacacggaactaatttagttatctgattcattaattgcactacttcattctctcaatatattaaatttgtgtctgtggtttgatatcacctctcaaatatgtgactactccaaacatagagagttttattgactatcaatcattattaaattgacttcgttctctgtcacatatattcctattttccagaataagttaatatgtctgaaaaatgtaaatccaaataaatgagaagcatttctgaagtaggtcttagtactgtttaaagaatagtgtctgtgaatctgttttatcacccaccacctcctgttagaagctgtatatgatggcatgtatatactcacctcgttttgaattatcccttttcgctctttcactagaggcagttttgtgatctttcactctgcctgaagttagtagcctacttttctctaatcccttgatcatgtcagcattctgtggagaggtgtagatttcagagtttgtttaaattctgaaaatgtaattgatggcaatgctaataaccatggacatgtttgaataacagtgtgtgataggcataaactttaaaccttacctaatgttctgaaaatacttctatattcagtaaggcattttcagttggaagcgtgtttaagattttctttcccatacaaaactaatgatgatatacagacagtatggaaattccatgttaatagtctctttagaaatgtggcaggatacatttgagattcagaatgcagttcagtttcatgttttgatttacgcatgccaaattatgaatttctgtggaatcgcggacccatgaaagaaacccaacttaaatatagtctggctttcagcttgaagttactagcagcatagtttagaaatgcctcaataagtacaatccaaattgaatgcatatgtttccctagttccaaatattcatgttgttctttcttagcagtttcctggaaaaaaaaaaagtctaggaattcatcttcagttcccgtcatcaaactttttagacaattatttgtgttaatcagtgacttttttgatgaaaaaactttgtgcacattattccctatgcaaagttgcaaagcaggtagtttttaaagggccacactgaggcataggataaaataagaagaggggtctcaggtagctattagggcttaataagatggatataggtcctgagcttgatccccaagccagtggaacttcatgccaccttcttcctcagatagaggtaattcttgggcagcaggttggaaataaagagtggatctgaggaccaaaaggaggtcaaacttcaaaaaggatggccaatctaagatattaccaataggtagagaacaaacatagacaatgtcagagattttatcaaagaagtaaagaatttcacagagtaaaatcatattgagaaatacataagtagaaaatgattcattgaccttccttgaaatatctaaaaactagtgacagtaacaagaataggagaattgttaagaaagtatgagtaattcctgttgggtttcttatttttattcagcgatggacaggccaaataatctgaattatgttgcagatggaaggctaaagagttcaagattaataaaggaagacgtttaaaccaataattgccagaatttctgttgcacgggaagatcaacaagtcaaaaagaagagcttcaggagattctggctgtagggaaagggatgactttattgaggaccactgggtcagtggctaagcgtgttgtagcagccaataggaagaacatacattctgtaccttttccctgtccttattaagctttgcagtattcatgtgggttcctgtactgaagacctcttttgtaagagataaagggagggcctacgagacttggggaagataggaaaacgaccttagtggaggtatgcctcctgaatgctgctgctaaggacatgggatcatttttatgacccccaattaactaaaagaaccttcaccagtcaccattcagttagcggagaaggaaaataactgagaaattttgtggtggacaaacattcataagaccctgcaatgtacccaataggagtcaggaactcagagcttttcagctgagatcgtttatcaaggagccatcagtgtaatgagggacacagatgagtaaaccaacaattaggcagttgcatgtatcagaaccattgtgaacaggtgaaactttctctaggcgctttatgttgtcatcttgggcactgttagccaatataattagaactggtttgaaagagccttttacttatagtaaacagtccatgtgttatcagtgtttggaagtagcccttgaccctggccacggggagcacaattacactgaggacaagctgagcataaagtcgacaacacaagtgtatggcatgatctgttcatgagtcttcttaatagtagttattgctttttgacgcttcattgtgtggtaggcactgccctgagccctcattcgctgatttcatcatcggaaaccatgcaaatacgaattttcatggtctaaaagtccttctcagccaagcatggtggctcacctctgtaattgcggcactttggaaggcggagacaggaggatcacttgaggccaggagttccagaccagcctgggcatcatagtgagaccccatctctgccaaaaatttaaaaaatttgccaggcatggggccagtaccttagtgccagccactcgagaggctgaggagagaggattacctgtgccctggagtttgagactgcagtgagccatgatcatgcactgcactgcagcctgggcaaaagagtgagaccctgtctctaaaataactaaacaggccttcttttacttgtattttatttctattacccatttccaatgagttatagattggagtctatttcatttatatattcagcagacatttgtgaagtgccatttatgagccaaatactataaataagacatgtctagccttgcccttaagaagcccacatcctagggatggataggcaggaatgtaacaaggtactacagactataacagctgtgtgcatggcaatgggagagggcaaagaaggacagcattctcaccaatgaagagcatctctcagagttgtggagtattcctcaagccccatatgtctaaaataagggtagctttgggttgaacctatgaaattgctttttttgcaggtcaaaaatgattgtacattggctatttcctaactcaacctaaatagtttctctctcataactcagcttgtcctgtggttgatttatggacaaatggtatagttgttccactaaataaatgtccagccatgtcataatagatttatttgccatctgtttgatagtatatgggaatgaaaccgatttttttcaagtttttaagactctattttaaattacagatattaatgaatgtgaacatccagggctctgtggtccgcaaggggagtgcctaaacacagagggttctttccattgtgtctgccagcagggtttctcaatctctgcagatggccgtacgtgtgaaggtaagataaaccatacgaaatcatattgttgtgtgataaaagagagaggagattgctttcacttatacaaagacttgaagacactaagaggtactgcataattcagagcctcaaagcatgtatgcatcaaagtaaaccatatctgaaagcatagctcaggggttgctgggatttacgaagaggataacctaaggttatgatgataaaaacactcacagatggctccacgactggtactgaattaatgagtggaaatgtgcaaggactgataggagacatgtaggagacctaaaggaaaactgtggcaacttccctttcccctgggactctgcttcttttgattgtgcttcatgtagatcgtcttgatcattctgtgtgtaaaaaatgtcttgcggctgggtgcggtggctcacaccagcacttttggaggcccaggcaggtggatcacttgagatcaggagttgaagaccaagcctggccaacatggtgaaacctcatctctactgaatatacaaaaattagccaggtgtggtggtgggtgtctgtgatcccagctacttgggaggctgaggcaggagaaccactgtaacccaggaggcagaggctgccgtgagccgagatggcaccattgcactccagcctgggcgacaagagtaagactccgtctaaaaaagaaaaaaagaatgtcttgcttgatttttctgtatcactgtgaacagatcttctagaattcttcccctaatatccttatttccaaggcagtatatttacttacctaccagtatttattatctcctaaaagctaattaagttgtaagatgttaagataatgctcttggcttcctacttacaacctctgtatgtttgcaagaatacagcactggttattttcataagatttgtgttcttgatgataatttacctgaaccattttaaaagtaaactgaaaagattcccataatcataatttcagttgatctcttttgagaatctagattattgaaactcagctatattttaaagaagtaaattgcaaaagttttgttctgggtctaacatagtgcccagattctttgctctaaaaaatagtgcaacaggaagtatctgctctccttgctagtaccagaatggaaccaagccgtgtgccagcaaccaggttcatctgaaactaattattatattgggaggaataaactgatcttgtaaagagcagaagattgttgaaattactctcctgctgagcagacaaaacatggatgccagatttgactagaactgggagagagagagttcagggtggattgagcaaacagattgaggggtttggaagggataggaagttgggaaatggaagaaagcatcataataatgtgggtgatgagagatttagaagaaatccctgcttcagtggttcaagttttatgtaaattttatatttggggctttgagaccagagcttttagcaaagacactccatgaatgcatacattcttctgcagagattacagtattcctcagcttgagggatagggtgcaagcccatccgagtcactgaggaaacagatttgcagaattcctaagctctagaaggatgcaggtttgcttctttgcttagctctaaatcatggatggtaaaggcttgcttcctaagaaatggtctgtggtataactactgatggttgtgccatgcaaaattatattcagaaaaaaaaataagtgacctcaagtgctccctagtcaaagctgttgttccaaaagaatatactaaacataaatatattcacaattattttgtcttttgcacttactaatgatttaattctgtacttttttaacacagatttctgcaacttgagagttgcataatcactgtaatttagttgcagctctaattttgttggtcatttacttggcaaagacttgaatttaaaaatgtggttttaggaaacttgtaatgctttataaattactgtactcattgagtatactctttgtgacacctggtctgtactgccttgactccagaacctggacaattttataagtaatgaaatacaagttagaatattatgttggtattatacatggtagtataactagaactctccgtaattattatgcatgttattctctttctggagtaagttctgcatgaattttattttttatgggcttaatccaatattctaaattggtccaaatttccctttgttagactcagtctgacacttatggcagtagtgctatgtcctgatttctacctctggctgtgctgcaggacaaagccagctcatgtgatcagtattcagcagtgaggctgatgtgtgattgaaatttagcaatggagcagttgtacatagtacttgaattaacactgagaagtggctggcattcttatctcatgtccatttactgattttcttctgagcttctgtttgaggagctgaagcctcgttgacaccagggctgacctgcccggctctaagcagggctaaataactcccacatagctgaaggaaggagggcccttccctgatttcccgtgacttggagaagtgtcagcatctggtcgtagttaatgaaccacaatgaagaggcaaactctgtcaacatgaattgtctttaagtgtagcatggcagcttctatagcaataaaaatggcaccactggctccttcctttctcttacatgtatagattgagtattcctcatctgtaaatccaaaatctaaagcactccacattctaaaactttatgagtgcagatgtgatgctcaaaggaaatgctcattgagcattgcagattttagatttttggattagggatgctcaacaggtaagaataatgtacacattccaaaattaccaccaccccccaaaaaaaatcccaaatctgaaatacttctagccctaagcattttgggtaagggatactcaacctgtatatggtactctgggatagatagctgggagaggaaggagaaacaccgtggttctcccatgtaaggtaaagaatggtgtaattcacagttcaagtgaagtgggaagtaggtggtgggtgggcagctatttgtcatttattcactcacgtaaccggtatttactgagttcctatctggttccaggccttgttccaagggtaaaacatacaattcttgcctccatgaagccgacattccactaggggaattggggataaagaagccaatggtatgtgtaggatacattaagtgtttataacacagcatagttaccctttctggatataaataagtgcagagtgtaacgtgtcatatataatataatacacaggatatttttttcaaatcccagacttagatgtcaggaaattgcaggggaacaggactcttctgattgacttctgctacacttccctttcctctctcagttatagttcatctcctcctgccaccttcctttcacgctatagccagagcttttatcttgtgtattaaaacaaaggaaactttttctttcactcaactcgttgttttatggtccatttgatcatatccatttgtttagcaaaaaatcataattcttttgcctttttatttctgcccttttttattgtggaattttaattcacatgaaaaatactcatcatcaagcctgggcaacatagcaagactctgtctctacaaagaaaaattttttttaattagctggacatggtagctcatgtctatagtcccagctactcaggggactgagacggaaggatcgcttgagcccaggagttcaaggctgcagtgagctatggttgcaccactgtactccagcctgcgtgacagaaccagaccctgtctcttaaaacaaaaaatctgaccaggcacagtggttcacgcctgtaatcccagcactttgggaggccaaggcaggtggatcacctgaggtcaggagttcgagaccagcctggccaacatggtggaaccccgtctctactaaaaatacaaaaattagctgggtgtggtggcaggcacctgtcatcccagctactcatgaggctgtggcaggagaatcacttgtacccaggaggcagaggttgtagtgagccgagattgcgccattgcactccagcctgggcaacaagagtgaaactacatctcaaaagaaaaaaaaaaatccttatcattgcattcataagctgatttgagattcggtctcttcatcatcagtagaatgtgtgtgggagaaaattagggaaacttaatggtaatcagattcctaggggtcaccacgtctgtccccatggcccatggggaaaaacctcctgatctctgactttgtgtcacctcttttccatgcctccttccttgctgcacttggccaggaacaactgcgctctcccagtcgtgtgcccaggctgagcaagggcttgtgtgactgccgtggagtccggcacaccccccatctctaggctccctgtgcactctatcctgttcacatgatacagcggccatgttcatctagcagggaccccaaggagcccagccacacagagggagcaccagcagcttataggacctggcacttttccctctggtgttggccaggcttggttagtcatggctaattaggcctccaaaccatggccaaaatcactccctgaagtattgtcttttagaaagcatcctcattcattccttcgtttgacagatatttattaagtgtctacctgtgtgccatccactgttctaggtactggggccttgtcagtgaagaacagcaaaagatccccacttacttagaggcaataactaatagataactaagatgttagaaagtgtgataaaggctgggcatggtagctcacacctgtgatcccaagcactttgggaggctgaggcgggtggatcacttgaggtcaggagttcgaggccagcttggccaacatggtgaaaccctgtctctactaaaaatacaaaaattagctggttgtggccgtgcacacctgtaattccagctactcaggaagctgatgcacgtgaattgcttgaacatgggaactggaagttgcagtgagccaaggtcacaccactgcactccaccctggtgacagagcaagactgcctcaaaaagaaaaaaaagcgtgataaactctgtgaaaaaaaaaaaaaaagaaaaggtagagcacaatatgggggacctgaagggtagagaaagaagtggaaagctgctttgatgctaactggggtggtcagaatcggcttttctgcttctgtaagtgaaagaaatactgaaattttctgagtgaagaaatgaagccatatgaagtgcctgtcatgttcaaactggtcttctactggcgaagtgataaaagcccatcaataaataggtaagggagcatgagatggcagccgaggactttcttgcagctgtcaacatgaattctattgtccagacaagaatagaaaatcagataaagtacaacgccaagagttgtaaacacttgatgtaaactatggactttggatgataatgatgtaagagttcatcagtcataacaactgtatgtaccagtctggtgcaggagactggcagtggtagatgctgggggctggtgtgaggaagacaggatataaatgaaaactctctgtgtaatcttattgggaacctaaaactgctcttaaagtctttttgaaaactcagacatatttttggcattaccttttttttattggaaaggaaaaatgaaaacctttcattttattaataattctatattccactcctgtattttcttctcttggatgatgatggtgatattatttctcacttttcaaaataataccctggactgagtatgggatcagcagcttctcctcctagttttcaaaaatgattctactatttgattgaaaaattgagcactgcaagactggaagagggcttcttgtcacatctagcctgaactctgactcccacagtatacccaaagtattcaggaatcaagtcctattgctaaacatctatagagactctaaccccataaccttcttaggtatttactataaatcactccttgcttacacattcatctgaaatggaaaccggtaaaaattgccaatgcgttgacgtgtactgaaagtagtgatatcacaaccgagagaaggtggattcaaactctcaggctaattttgtattcattgggaaccagaaaacacaagaaagacaacattgccaaatcaaaaaagtaacaaattgggagcagacgtggggtttgttttcacacttctaggtacattttctatgaacgggggagaatgaaagcataaagccgtggacagtgccccaaggcagttggtggttttgtggcatggatatagaactttatatctgtcaccaaatagaaaatgcttttgaaaatgactcagccaagtgggatgctgaagaactctgatgcagtaatgtgttacatgtggtgtgcttagcccaagattttcaggtttttaagagttttcgggtctgaaactgaaaactgtactaagagatgatgattttagtatttcttagtagagagaattttaacaacagaatccactctcttccatgtgtaaaaagaaaaaggatcatacaacattctaggtaaagaaagaaagtggcttccagctataaaagctactgttcacactcactcttcctgtgaatgtacttctgcagaagtgagtgaaaatgaatgtttaaatcattagggagaaagctgaggaaatttttctggaatgagttgcttttggacttgaaatgcagattttccatgcattgcttgattgtcttccatatatcaacatttgtataaagaaattcataatagtagcaaaaaatttgagatctcttcctaagcctttttttttttttatcactgctgaccttttcaaaccccagagctatggaaatcatctgttcatagaaggagaagtaaacacttgccttgcagccaaaaaataggcagaagactgccagaaagtgaagtctgtgactaggctagctgaccttgcataccgtatgctgacatccactcatgctctggtgctgggcgtcctacatctgactcctttgatgtcaacaacccgagtcctttttagatcatggaaggttattgtaagcagtgtttttgtacttgagacctaaactgtaatgcttcatacacatattccagaaacagttactttttagacatgtgatagaatattaagcaactatcttggtctcccactatgagtggactggagatacattatatatctgattgcatgattttattaaaacagtagcaagaataatgtataatagcattcactgagttcttattacaagccaggcactatgctaagtgcattgcacctgtcttctcatttaatcttcacaataaatctgtaagtaggttaagtattaattggtttaattttggctgcaacaaacagcttagaatgagggcatttattatacgaatgagaagtatagtacaagattgttacctcttgcctcctgtaggtccgtatttaaatgctgtttccttagtgaaccggtttctgaccgttctttctcagattcactcaccgtgtaatgaatgaattaattcacttcctgttcttttttccttttgctttttttatttctttaccaccttattctacttctttaccttgtttattgttctttgtcacactccattgctagactttaaggccagtgagatcgggattgttttctgtattttttacagctctgtatgccattgggaatacagatgctactcaatttatgatagggttatgtcctcataaatggaaagtcaaaaatgcatcaaatacacctaacctaccgaacattatagcttagcctagcctgcttctagcacattctaaacgtgctcagaacacttacactagcctatagttaggcaaaaccatctagtacaaaaaaaacccgattttataataaagtgttgaatatctcatgtaatttattgtactgaaagtgaacagaatggttatatgggaactcgaagtacagtttctactgaatgcatattgctcctgtaccttcataaagtaaaaaaatcgactaggcgcggtagctcacacctgtaatcccagcactttgggaggccgaaacaggcagatcacctgaagtcaggagttcgagaccagcatggccaacatgatgaaaccccatctctactaaaaatgcaaaaaattacccagatgtggtggcacacacctatagtccagctacttgcgaggctgaggaaggagaatcgcatgagcctgggaggcgagtgagctgagatcacaccattgcatttcagcctgggtgacagagcaagactccgtctcaaaacaaacaaacaaacaaaaaatcataagtggaactatcctaatttggagaccatctgtaattagttggggcacaatacgcatttggcaaatgaatcaagggaggaagggacagtctgtagctcatcctggagtactaggaaacattcttaataagattactccaaactgaatgtgatgtacacttctgtgaagccttccctattttttgaagacttaattctctaatgcacaccctgcataactactgggtgtagtagtggctaagaagttatgctggtgagtttggctacatgggcttgaactcttgttccagcacttctaagctgtgtgaacttggtgagtgcttcagttccctctctgtatagtaagaataataatagcacctacatggagttgatgtgtgttggcaagtatccgccgagaatggagtagcccatagaacatactcaatgaatgtgagctattgttactattttagcatttcttatactggtaccttagttacagcagtccttccttatctgcagttttacttcatgtggttttagttaccatggtcaaccacagcctacaaatattatagtattttgagagagactacaatcacataacttttgttacagtatattgttataattgttataacaattgttataattgttataattttaattataatataatcacagtatattattactattaattcttactgtgcctaatttataaattaaactttatcataggtatgtatgtatgtatgtatgtatgtatatatatggaaaaaaacacagtatatatatatggttcagtactatttgtggttccaggcacccacgggggattttggaacacatcctccaccaatgaaaaggaatgattgcattgtcattggtttccttattatgtgagcatctaaaaggagggaaacatttaacaactattttatttttatattgtcaatgcttacaacatatataacatgcagattaaatacatacttgtgaatgaaattgtatggtatttccaagttcatgtcctgatattgatgaattactgtattctatcttttttttttttttttttttgagacggagtctccttctgtcacccaggctggagtgcagtagcgtgatctcggctcactgcaacctccgcttcctgggttcaagtgattctcctgcctcaccctcctgagtagctgggactacaggcatgtgccaccacacccgactaattttgtttgtttgtttttagtagagacagggtttcactctgttagccgggatggtctctatcttctgaccttgtaatccacccacctcggcctcccaaagtgctgagattacaggcgtgagccaccgcacctggcctctatttttaaaccccatatttattttaaatcatatagaatatagtgtagtaattcatttatatataatttgctttaattcttcaccctttgttttccctgagagtttcatatgactcttttccattcacccacaaagtagttccagctttaagtcattccctgtatcaagggctagtaagctgacagccagcactgatgcttgtttgcatttgagcattggagctcttatttctagaggtacactgtctattttctgtggttttataactgatctttcttggcctcctatttgaatatagaaagagaaaaattagaaaatatagaaaaaagtgagaattttttggctgattttatgttgcctctgaggcctaagtgtcaaaaagatgaatctggggtttgatatgtttggcctgtctgtagggctttctcccagtcctcactggcagcaccttttagtgtaagaaaagctgtatgaaaagagaaagcgtacagcatggatctaaatttagaagacatttatttttcttaatcccagatataaatacgtaaaactattacattaattccgagactatccagtggttatatataattatgtaaagacaaagtaatagagccttttaaaaacttagaacagtgtaaaacaaaatgtatatttcacatttatcttttgtgagtaattggaagaaatttacaaatgaagttaagattttcccttaatacctaaagaactgtttctgaacatcgtggaatttatttataatggagctaaaacactccacttttttgacattgttccttatttcatagtaaactgtaattctttacctacaggtgtagaaaggtggattttgggggctttcttctttttttcctttaaaaattttagaagtatttcttttctataacaaattcaaaccttcctcatacactttttctgttttataacactgtcagcccatggtagaaagaaataggaagaaaatgtctttaaatttagaaatatactttggttctctttttctgtaaagaatcacagatgacttatagtgtttatagtttttgcttttgttaaaaaaaaaaacagtgttttgtgtttcattaaatatatactacttttcagtctaattcagaatattgctttaaaatgtcccagatactcagttttgaattttcatgtataatatcaaggttttattataattgaacaaacatctggcacacacaatggctttctcacgcagcacctctcaactccaccccgtttctccattcatggagtggggaagatacatgcccagcacaaactgcgtgtttgcaaagctgttaatgacataaatgtcctttccagatacaaaacctgagctttgtgagctccctcaatgaggaaaactgtttgaaacaaaccactttccccattttcctggtcattcactgaatgagcttgttgatacagttcgaaatgtaaatgctggcatacttttattggattaaaaaaaaaacaatctaaactgacttcagtcatgaggatattcattcttgaccttatttgggatgataaagagagaatcttctatacatttaccctgcttttttgtcttcaaagcctactgaaaatgagaatgagggatataatttatttatttatttatttatttatttattttttggaggccgaatctcgctctgttactcaggctggagtgcagtggtgcaatctcaggtcattgccgcctccgcctcctgggttcaagcgattctcctgcctcagcctccccagtagctgggattacaggcacgtgccaccacacctggctaacttttgtattttcttagtagggaagggtttctttcaccatgttggccaggctggtctcaaactcctaaccacgtcagtctcccaaagtgctaggattacagacatgagccattgcacctggctgatataatttaaatactttaataattcttaggactcttggctgttcaaaaaaatcaagatgtttaaaaatgcattttagattttactcctctgtaaaaaaccatttgctgtttatttttaaacgtttgaaaggacatgtggagtggggaaaggaaccaggccttggagcccactctcagtggttcagatagactctgggaagggggtgagtccagtgaggaccctggagacctggactgatccagacccagtgtctccttatgaatgctttacagtaaactatgacctatcttttgaacatgaaataggtcttacttccgtcttctatcattttttaaaacattcataattccaaagcctgatgtcttagaattattactaggattgcattctcttctgaatatataacaatgctgttatacttctaagaaaacgattttttttaatgacataataattctccatcaccttctacaagactaaagaacaatagaatactgaagacagaggattcaaataactcccatgacatagagtgggtcatgtacaaatggagttgagtttttaaggaaagatatagtaaattacatatgtttcttatttttgcttatattcctattttaaaaaaagtagcttgacttcattttgcagttggagaaaaataagttatagggtattagaatgtcttccaataagcagataggaagtggtggtcaagatgactactcagagtgccttaatatttcagtctaatatatatgccacaatacctgtaacccatgggaaatagaaaagcaaagttagcttttgaaatggtaagagagtctctaaccaggaaatgcagcagtgtggattatctctttttttttcagtaaacattcaagttggtgtttaaaatgcatgtagagggccgggtgcagtgactcacgcctgtaatcccagcactttgggaggctgaggtgggtggatccgaggtcagcagttcgagaccaccctgaccaacatggtaaaacccatctctactaaaaatacaaaaattagccaggcatgatggcacacgcctgtaatctcagctacttgggaggctgaggcaggagaattgcttgaaaccggaaggtgaaggttgcagtgagccgagatcacgccactgcactctagcttggacaacaagagtgagactctgtctcaataaataaataaataaataaataaataaataaaataaaaataaaatgcatgtagaaaagtgcctaaatcataaggccaccacttgacaagcatttatagtgagcatacctggtaaccagccccctgaacctccctcaaacttcctcgtgattattccccaccctcatatccaatactcatacatagcacttaccactatcctgacttcattattgtagattcgttctgcctggtgtattagtctgttctctgctagaacactgctaggaagaaatacccaagactgagtaatttataaaggaaagaggtttaattaattcacagttcattgctggggaggcctcaggaaacttacagtcatggtggaaggcaaaggaagagcaggtaccttcttcacagggcggcaggatggagtgagcgcaagcagggaaaatgccagacacttaaaaaatcatcaggtctcatgagacttactcactatcatgagaacagcattggagaaaccgctcccatgatccacttgcctccacctagttctgcccttgacacatggggattatggggattacaattcaaggtaagattttgggtggggacacagccaaaccatatcacctgcttttgaacattagctacatgtaatcataatatgtactcctttgtgtctggcttcttttattcaacattgcatttgtaagcttcgtctgtcttgtcatgtgtagtagtccatttattttcattgctatatagtatttcattgtatactacattatgtatccattctactgttgatggtcatttggcatgcttcctatgtgaggctgttgtgaataaacttcctgtgaatattcttgaacatgacttttcatgggcataatcactaatttctgttggatatcactaagaagtataatttctgggtcataaaatgtatgtatgtttcactcacatatatatagccagtttttcagagtaccagtttacactgctaccagcaaagggttaagagtctcagatccacattatcatcaataattggtattgtcattcctcttaaggtttagccatactgagtaaaggtatctcattatggtctcaatttgtgtttcccttgtgaagatatatctttaacaacttatcatacctttattggccctttggatattgtttctgttatctaattctgcataagaaacttcttccaaatgaagtgctcaaaacaactattttaatggcaacttcaggtgaactcaagttgttaattttaatgaagtccagtgttttaattgttttatttcagatcagtattttttatgtccagaatctttgcaaaccctaaagtcattaaggtactgttatgttgtcttctgatagctttattgtttcacattttaaatttggatttgtaaggcccctgaagtttttttgcatatggtgagaaataggggtcaagatttcttcatttcctaaatggacatcaaattaggtcatcactgtttattgaaaagagtgcctttttcccactaatatgaattttttttattaaccatagagtcagatatatatgaatatatttctgcattattcatattatttaataggtttatctgtctttgtaccatttgtacattgtcctagttacagtagctttataataaattttaatgttttctgctgtcagttctaacttcttcaattctgttcttgagattgtcacagctattcttggccctttgcatttctatataaattttataatcaggtgatcaatttttacaaaactctgctgggattttgattggaattgagttgaatcaatagatcaatttggggaggtttggcattttacagtatttagtcatctaatctgtgaatacaacacacccctttattagggtttccttcatttgtcttagtgttttgttggagatttttgtataaagtctttcacagcttatttaagacttattcctaggtcttcaagatttgcatgtggttgtgaatggtattaaaatttttttacccttataattgtttgttaccagtatatagagctaaatttgatttttgtacattgaacttgtatccatgaccttgctaaatctgcttgttaattctagcagtttatatgcagatttctttgcatctcccacatatacaattatgttgtataagtaatgctagttttattccttctcttctggtaagcatacttttatttccttttcatgtcttactgtactgtctaggacctctactgcaatgttgactagaagtggtgacagcttgcttgtctctttcctgatatcagcagcaaagacatttaatatgatgcttgccataggttttttttttcttaatagatattctttatcagataaagaagttcccttatatatctagtttgctaatgttctttatcatgcttggttttgaattttaacagatggtttttctgcatctgttgaaataattacattattttcttctttattctgttaatgtggtgaattacattgactggattttaaaacaagataaaaatttgttttccttatagcagtctaagcttcagtaatctagggctgataatacaggtctataatacagggacccagacaatatctttttttttttgctttgttcttccggactcaggttttctctatcatggtctcaaaaaaaaaaaaaaaaatccttgaagaattcaccggtaaagtcatttgtgcctggaatgtttgtttttgtttccttttgtttttgtgcctatgcattataaacatttttaaattgcagttaagatttcattaatagataaaataatattcaggcttttgacttttcatgtcagtttcagtaagttttgttttccaaggaatttatccatttgggtaaaatttcgtttttatttgcacaaaattatttataatatcctcttctctgtatatatgtagtgatcttttttaaaatttcagtaatttgtgcttatgtttcgctcttgatcagttttcctagggttattagtcatttcaaagaaacaacttatgtggatttgtttcctttgttttctattttattaatttttgcttttatatttattattttttctatattttttatatttacactttggggtttaaattgtctttatttctaactacttgaagtagatctttaaatcattagattatcaatcttctaatatttgtatttataggtatatatttctttctaagaatggctttatctgctatccataagttttgatatgttgtattttgttatttacataaaatatttctaaagttcattgtcatttttttcctttgaccaatgaattatttagaagtatttcacttaatatccagatgtttgggtattttctggttaactttttgttactggtttctaccttaaaaccactatggccagagaatatactctaaatgacttcaatccttgaaatttgttatggcacagaatattatcaattttagtaaatagtccttgtctgcttgaaaacaatttatattatgcggctggacctatatgtcaattagggccagtttgtaagttgtgttgttaaaatcatctatatccctaccgattttttgtctgcttactatataaatgactgaggagtatgtaagaaaactacatgtatgtaagaaaactcggctagattaaaaagcattttaaagggttttatgtgtatttttttgttttgagagttttgggttttatttgcttgtttgtaattgcaattgttgagaattgcagtgacctcctaacttaaatatgtgtatactattaattaataattatcagtagcattttatcttacataatataatttcaagcaaaacacttcatcttaaaacaagattttattttcattcagaaaaaataaaacgttgcaagttttcaatattttaaaaatatttatgaataggtattttatttttgtttgtacagttgtatttcactcaaatgtttattcctgttagggtggaatatatatttatacacaagcaaaataattaaaatacttatttaagtatcctcaaatagtagattgcaagtatgtgatttttctgattttaagagtaacataagccaggtgtggtggtgggtacctgtagttacagctacttgggaggctgaggtgggaggatcatttgagcttaggagtttgaggccaggccagcctggttgatgtagtgagacaccatctccaaaaaaaaaaaaaaaaaaaaaaaaaagagagagagagacagagacactctcattatagaaaatttagaaaattctgagaaatataaagaaaaaaatcatttatcaaccagtgttaattaatgttaatatttgacatatttcttaatagtttttagcatttaaaaatgaaattatatactttatttatttaattttttttttttatatggagtcttgctctgtcgcccaggctggagtgcagtggtgctatctgggctcactgcaagctccacctcccgggttcacgccattctcctgcctcagcctcccaagtagctgggactacaggcgcccaccaccatgcccagctaacgttttttgtataggattaatgagagggaggaggagggaagactgttttgactgaaggatctctctaaagaaacagcatttgagctgagctcagggcaaagcctctgagacagagaacttggtgcactcaagggagtggaaaaggccatgcctggttctgagagaggaggtgtagtctacagcaatcccaccgtaaatacacctctcatctgatcttgaaagctgagcagggtcgggcctcattagtacttggatgggagagagaggctcagcaagggtagagctagggaggcaggtacagaatttgcaacttcccacaggaaatgtaaagagtttgggtgttattctaagtgtaactgaaatagactgatagattcggagcaggacaatgatatactatatttcatctttctaaaaagatgcacattttttcacctttaatactggggcacttcctacagttgaagtgatttttaaaaagcagtgcaaaataggttaatttgtagagtttttttttttctttcttagtggttcagaaaataattttgttctttttaatgagtggagtcttctatttgatttaattcagtaatttatattttttaagtacagtgtttctgttttccaggttgctttttggcaatggggttagaggagcaggagaaaactcaggatatcttctaggatattgttataatagctcaggccacacatattggtagctcaggctagagcagtggcaacatgatggagagaaatgaatgactccaaaaatgctctggagatagagcctagtgctagattagaacatagagttgaacccgatgtaggacatggaggagaactgttgaagaggggtcataggtcctggctttagcaagttggtatttggtgacactatttgctgacatggtaaaaaaacgaagcaatttttttgtaaagatcaagagtgtgagttggttatattaaattagagttgcctgtgaaatatccatgtgggtgtgtcccatagggaattggatcaagttaattctaatgttcagaagagaagtctagtctggagataaaaactggaagtcatcagatctagaccgcatgtgaagccatcagaatggatgagaccaccaagagagatcatagaatgagaaaaaaagaaggtctaggactaagctctgagaaatgccaacatataggggtcaagtaaaagagaccctgtaggaggagtccagggagtaagaggaaacagaggatatggtactgtagaatccaagggaaaagagttcttcaaggagagagtggtcaaccgcattgaatacaactgagagctctactaagaggacaagaagaatcctttgggttttacaaaatggtgaccttatcaggtgctgtttcagtggaatcttgaattcaggagccactcaagaatgaatgagaactgatggagtaaacacagcatgcgtagataagtcaagaaccttggctgttaaaaaggagtaagaaatatggaatgatccaatagagagggaaagaaggtgatgcaggggcagaggccacatggacaagcgcagacagcacgtggcaaaggcctctatgccattacccatggaagaaaactgaagaggtttaagcagagaactatttgattggactgtttcattaggtaaattattctgtcattgtgggagatgaatttggggtctttaatgagtgtctgaaagcacaaaactcagtttggaagccattgcaggaattcgagtgaaagataatgtgtccttgaataaggctggagaggaaaggagagactggagatacaaccaaaagataaaatcagaagaatgtggtgactggatgtggagcagtaatcaaggatgactcccacatttttgggtaactaggatgatatatgtgatttttaggatggtttccaacaggatatctttaactgtagatggtgaatacctgttgtctacatagtggttgacaaaaatggagcagtgttgttttagtttctctggaatataggattgaggcttgtctgggtaatttttacagaataatttaagtaggctgggcatggtggctcatatctgtaatcccagcactggttggccgaggtgggaggatcacttgagccgaggagtttgagatcagcctgggcaacataatgagacctcatctctactaaaaattaaaaaaaaaaaaaaaaaatgccaggcatggcagcatacacctgtggtcccagctatttgagaggctgaggtaggaggattgcttgagcctaggaagttgaggctgcagtgagctgtggctcactgtgagagccatggcactctctctcacagtgagagcatggcactgctctctagtgtgggcaacagagtgagaccctgtctctaaaataaataagtaagtaagtaaattttttgaaagtagtacatctccatgctggggaaaaaaaaaaaaaaaagatgtctcattggccagccttcttttctagaaggtaattatgggaaagttgaatttcaaataatttgttacctatgtcatttcttattgcttatcttaggctgctagctttcaaaacagacttgtgaccatcaaggtccccgtgtttttttcctgcccttctctgtcaagggatagcatggtagtcagactcggcccagggatgtcgtctgctgtttctggcctattcccatctcctagaacaaagttattttccataacacatatgggctatattccccagccttgtcgatgttgccagacctcagtggaccttttttaaaaggatctttccatatcctattgtattgcctggaccatctcccaatccagtttttaatttcctattggctaaattttattttctttctttaggccttgtgctcatcttccgcttaatgctggcttccctcctgtgctgtgagagagaccttaatcgcttgtgggccagcagccatgccattttaaaattcttttgggcagctattcagctggtttaacatctttcactcccacttgttggctgagatttactctctcctagccggcttccattcctttcagaaaggagtgtgagggctgcatttccattgtaagccccttttctttggatctgttttcctaagattctggcaccaaatacttaaccaatctcagttggttaagaagttctgagctaaaatagtgggccattttcttcttatgaagagttccaggagcaccgatgctagacatggtcctgtctaagtcctgggacctcctgagacttgcaaccatgggtgcctgatgtgctttcttccaagggtctcctacaaaaatatcctcttcatggcccacagtagctctagtgtctagatttcaagtatgatgatatttcttgtattaaaggacagagatgcctaagtcttatttaaggacaagaagacttgataaaactggaagccagtaggtgatgagtcaaagagtaacagatggtgtgttctgacctccatcttcatagtgggcaaactccagtgtgctttttgggctcacagtttggttagttctcttcatcatctaggactaaccttttttaactatcatcatggtgacaggtaagagaatgtgatggctagaaccacagacagattcagaggattcttctgtgaccaggccctgttcctctgccagctctcccgctaactgactatgtaaccttgaggcaagtcacttcccctttctagccctcagttttccggttattaaaatgaagagattgaactggataatcttcaggtttccgttaagtcaaaatggaccatatgattcatctaaaaatgttctaagacaggaagcccgtttcttcacaactctcagtagctttggagattttcctatgaattatccattaccaaaaaatgacacccccattcccactatccacttctctggagcgtcctggcagcagacggaaagctcattagtgagctgcttcccctaatagatgagtacgttttgctcagaataaggaagaaggaagtcaacaaaataagagaaggagatgttaagaaactaagaagaagcactttcctaaaaatgtaaaaccaaaaactgaagaatatatctgaaaaaagagcaccaaatcattttactaatgaaatagacacaaatacccctttctttccaatatacatcattttcagaatatgtacagatacacatagacttttctgcatgtaatacaagacacctaatggaaccattgagatttgttgtgaatttttgtgttgagttcttaaaattaaaacgattttaattttttggttcttaaacaagatttacatgaccccaacctcttttagaaaaccctgccttctttccatacttgttatttatttcatagttcactttacataaatgagaaggtgacacaggtgtctggccttacacctttatttgagaattcgggagtgcatgggttcgagttctactctagtatgtagactccctgaatgcagtcagtaggtttttaaaaacttttggttcattgagaaaatgtcttaagtaaaaagcatctgggcaaggaaaatggatctgccaagtagatcaataaagaccctcaaaagcgtggatctattagtcattgacaacattgctactttttaaatgagccactggtagttcccgtcacccagaactatgttctatttttctttctgacatttatgtaattttttattgggaaattcacatcagggatcgattctccttggtttgcataattctttcttgactttatttccattgaaatatcaatatttatatctgccttcttcagtaaagtgtaaatagcaacacttgcgtgatgaatcagcaacttttataataccacacctgatttttctggattgacaattgacagttgatcactagacaaatcacgcctgtaatcactaacccattggatagtattaccaatgatatcatgcatggcccttacagatcactaagcaaaattgcttggtagttttaacagaatcacccttcattaagtgaaaacatatgatatttggatgattcaaaatatagtttcatcttccaaattcaactttagcaaaaaaggatgactttcacttgttcgtttagtcttgctgggacttctactctaatgtaataaattttcttaacatttagctttatttctctagaattactcgtatttgtagcagttcttttcattgtatgtatatacgggactaacaatggaaaaatatctcagagagctcacatcatcaaagaaaattctaatgaaataatgttttttcttgtagaggtcattaaagtgaaacaaatgtcctcttattaagctattacctcacctcattgttgaaaacatgaaactgctgagaattacattatatcatttttataaaatattagttgctgaagagctagtttccagcaggcattccacgttattttttcctattcattcaaatccaaaatattgctcatctaaactttctcggttaatcactgttacagtaagtctgagactgcaagacgcccagtaattcataaccagcttggggcttgttcaccttcaggtcaattatttggttcctgtgcacagtaacgagaaatcatcatctgctataattgcatagaattaataaaaaggaaagcaaggatgttccttcaggaatctggactgaaaagccaccaggtttctagtacataccttctctttctcctccttagctgtccttccactcattttagtagggaaataagttgctgatgaggttaagttaaaggttcctcaccctgagaaggagccctcgataagcacagcagtggcacaaaatgctctgggactggagaggagaggccctgagatctgcttgtggagtagttaaaggaggtgctgcagaggaggtgtctcttgggctgactcctgaagggccaagaggcatttctaagtaagtccaggggaaaggggtggcatggagattccagagacggaaggagtggcatggagattccagagacggaaggagtatgcaccaagtccatgaaaaattaaagaccgtaggttttcaaagacctctagtatgctaattgagccagagtgcaaattgggaaggaggttgtctggaaactgtggccagacatataggcaggaggcagatgaggaagggtgctccatgccctactaaggagtgtggttaccctttagccaagaggagattctgaacactctgagcaagggaatggtactggtgagtttgcattttgcagagagcacattggcagttttaggtggagaatggatagagggagggaggcaagactggagatgggaagatgacccaccaagagtatgagtatcaggaaagatagtaaagacggcatgacagggaaggacagagaataggagaaagtgaagggtgatattaagatttctggcttgggtgacagattggatttgctgatgaaggaaataggagaaatggagttgagatgaggaggggagtgataataaattcgtttattatgaatatatccaataggtattagataagtggttctaaaggacagaggtaaatttttgagagagactgggaaatcatcagtatgtaaatggtaattgaagtatttccgagtttctttccagcccttaaatcctgtggttcaatgaataacataaataatctctttgatgtacgcccatctcagaaagcctacctttagcagtggcctgtgttaagtgatttggtgacgcgatgcagttcctcctcaagttgtgatcagtaaatagtgatctcagcctcatgctgacattgaaaatcaatcagaacagatttattgagtgtcttttttgtgtttactgttgtaagggagattcattttttagactggaaataatttcattgatttgtcctttttttttttgagacggagtttcgctcttgttgcccagtctggagtgcaatggtgtgatctcggcccactgcaacctctgtctcccaggttcaagcaattctcctgcctcagcctcccaagtaactgggattacagtcatgcaccaccacacccggctaattttgtatttttagtagagacggggtttctccaagttggtcaggctggtcttgaactcccgacctcaggtgatctgcctgtctcggcctcccaaagtgctgggattacaggcatgagccaccgcgccgggcttcattgattttttaattcaagtcaccaaggtcaggaaatggagtttagtaggaagacagtgaatacagttttaggcttgataagtttaagttcatggcagaagatccaatggaaatgattaagaaatgtgcttgcaccccatctctactaaaaatacaaaaaaattagccaggcgtggtggcgagcgcctgtagtcccagctactcaggagactgaggcaggagaatgacgtgaacccaataggtggagtttgcagtgagcagagatcgcgcccctgcactccagcctgggcgacagagcgagactctgtctcaaaaaaaaaaaaaaaaaaaaaaagtgctccgtagaagaatcttggctggagaggaggatgggggatttatcccaaggagcatggtcactgaaactgggagagtgtgggaagggtggaggagaggagtgctgagcacacagcagatttcaggcagggcgggagccttggcagacacccactttcaggctgccaaagggcaaggacaagctcaaggcagaacaagaagaatattccgtcactgaacgtgggaagagagtgttcaaggagtgggcattcagccagactcggaggtcaggggtgactgaccggaagatgatcatgagatttagtgatgagctggtcactggtgctttttctcataggagtctcagtggcataaagagttaggaagtaagattctaggtcattgaggaggaggaggaggaggaagaggaatagtagtaataataataaagttgacatgtactatattggatgtctccctacgatacatgccaggcagtcttcaaagcactttgtacgtgttattttgtttaatgctcacagtaattgtaggaacttaccaatgttattaatattattcatattgatactattatttccatttacagatagactgtaataggaaataaagacaatgagtatagacaatcctttgtgacattttgcagtgatacaaaaagtttaattccccccaaactaaattctgtcaagtgaaattgaacttgtcattttctttagcatttgttgtctgatttcattatttgaacataaaagtacaatcttcacatatatttggatgctgttacattttcttaattgtttctccaaatcttacattttggcgtgactgttaagtccagggcagagagagcagagtaccaggcgtggctggtgtgagatgtggcagtgcccaaggagaagaaaagcacaatgggcgatgatatgatcaggtgaaaactattttcaagcaattttaacatttttgaaggcagtgagggtaggatccaggggaggaataactgaagatgttggagaaggatgagcaggtgggaccttgaggcagagactggtcagggcgggagaaggagccccacccagaaaggagaagggatgtaggttttttgtttgtttgttttgagttgagaaaataagtttaaaagagaaaatgcggccaggtgcggtggctcaagcctgtaatcccagcactttggaaggccgaggcgggcagatcacgaggtcaggagattgagaccatcctggctaacatggtgaaacaccgtctctactaaaaatacaaaaaattagccaggcgtggtggcgagtgcctgtagtcccagctactcaggaggctgaggcaggagaatggcttgaacctgggaggtggagcttgcagtgagccgagattgcgccactgcactccagcctgggcgacagagtgagactccgtctcactcaaaaaaaaaaaaaaaatatatatatatatatgtatatttatatataaaaataataaaagagaaaatgctcaattttattaatagtaactctccccaaactaaactctgtcaagtgaacttgaacttgtcattttctttaacagttgttacctgatttcattatttgaacataaaagtgcaatcttcttcacatatatttggatgctgtcattaacattttcttaattgtttctccaaaaacttgcatgtggcatgactgttaaatccaggggcagagagagcagagtaccaggtgatgggtggtatagatgtggcagtgcccaaggagaacgggaaggaaagaacggagaaggaaattagtaaccgtaagaataaagaagaattctatctaaaagtctgttgtaactttgcaattgaggcatcacttttataagaacatttttattaatgagaaaaaaaggcagaagatcactctcatcacgtttatggagaacaaaatgaattggcaagtcagccaatcagctggagcagcctggacggttaggaccttgaatggctgtaaattggtggcatcaaatcttttcttttggcactgggactgactggctaccctgctgacttcatcagactctctcttgacttcctgaggatgttgtgtagtctggatcaaggttatccacaaggttaagtaaactattgctcatttccacctgtaactatcagatgcaaatactattagcatttactgcaactaaaacaagtgacaatattttcacatgttttctctgtaggaatataaggtcccttggaaataaagagtcgagaacgtttaggtaatactgggcgtggcacttgcagccatcatttcagtctaaaaacatttcctaaggaaaagtactaaatgtttttttcatagaacccaacattttggctgttaaaccattttcatcaaaacattttatttatatgtaaaatattttaaaagctgttttctgtgtaaacatgttcatctcatcatcacacactaatcaggatgtgttgagtgcctctgtttatccattaatatctggtgtttgtcagcctgtgtttgttttgtgtctgatgttccatgtcttttttgcagatattgatgaatgtgtaaacaacactgtttgtgacagtcacgggttttgtgacaatacagctggctccttccgctgcctctgttatcagggctttcaagccccacaggatgggcaagggtgtgtgggtgagtttttagattttttcccaacgtgtttcacatgtccctagggaaaagaaatcacagtgaacaacaggagcttttaagcaggtaatttgggtagagctttatcgtaatttgattttgtcatacaatttgaggatgtgcaaaaatatcctatgttggctgggtgcatggctcacggttgtaaccccagcactttgggaggccaaggttggagaattgcttgagaccaggagtttgagaccagcctgggtagcatggtgagatcttttctctatgaataaaaattttaaaaaaaaaattagccaggcttgatggtggatgcctgtagtcccaactacttgggaggccgaggtgggaggatctcatgtgcccaggagtttgaggctgcaataagccgtgatcatgccactgcacggcagcttgggcaacagagaaagaccctgtctcaaaaaaaaaaaaaaaaaatcctatggcttctgaaattgttagggacattaagaaatataaaagtatgactttacatttaaatgaattttaacaagaacatctgtttaaactctaactgagtatgcagaactctagactcccttcagcacaggaaatagagtctggtgtgtggtatagattgtctgtctttgaaatgcatccccttagacagtgcgtttaaggcaaagtattgccaggagcttcagtgtccaggaatgatacctgtaaaaggatgctttgaattgtgcaactgtatttcctcagtctgttccgggattgacagggctggaaggaatcttgaatatcatcatatgtcctggaatatggtccaacaaatgctcacacagaaaataatttgtatttcattgtctgaccaagatgtgatttcttcacgtcaaactcattatgaaacatatttgcaattagagcaattaaatgggaaagagaagaaaggttatcaaattcaagactttatagatagcaagacttttctttttctttattcttagagaaaaatagccatgttcactacatggcaggtggaacttgaggagtctattgcctatttggtttgaaaatttgcaattaagacattagttcatttgccatccatattaaacttggaaaacaagatttttaaggtttaatgataatgtcacttaataactgcttttgtggaattatgaaattcagttaattctcaaccaaaaattatttacaaagcaatggtgtggtttcatgcataagcagtagctagtcaaaaacatagataattattcaagaattattcacaacaagacatagttatttaataatatagctaagactatcctaatcttagttcaaactcctgctttggccacctttccaccaaaatacagttgtttgacgtttggataatattttcaccagttgggtcttgtgatgtggcccctacttttcatcttaactttaccacttccttcttcacctgttgtttccagcaacgtcagactggttgtggttgcccatgtcactgtgcaattatttgactgttgttcactccttctgctgggaatatcctcctgacctctccttccctgagccctggatttttctcactcgttcttgaagactgaggttcagtgtcatcttccagacaccatccctgctccattcctcactctcaagctgagctgtgacctctgcttccagagcaccttcagcaaattctattatagcacttacaacctttgggggaataatttaataatgggtataccacctgcagaccgcttctgcaaggctatgacctctatatgattgaaaactttctcacttctccctgggcagggcacgatgcttggcttattataggtgctcagtaaattttgtttaactaccaactgtttaaatatcagatgttgaaccatacctggaaaccatgtcagctatctggagtccacatagctccagagcccctgcttaatgttcatttctaaccagccagatgagcacaccaaacccatgctgacatttcagcttggcacacaaaacaccacccttagagaaggaatatttgttatcattttggtgaactcaacaaatgccattttatttgtgtttgtatttattatttcaaaaatatttactaagcacctatgatacgcacttcacactgggtgttctgtagagctacagggatgagtgagcacctgccccattatcacctactcatccttcagctatttgctccagtatcatttctctaacccacccccacatttaaggtctgctgttccatgctttcactgagctctgaacttttcactcctcacactcactgaagcatgtacaattattttgttcatttccctaactcgtctgtaagctccatgaaggcaggagttgggactgctggctcatcattgttaccccacatataggccgtacaggcctgccccacagaagtaagctaggaaatatttcttgattgaattattgcagtctgatgggatagagtttattagccatgtcaataatacatgttggaaagtacaaagttccactggacatttacctaaaattgatcaatgtgaactggcaatttcttaagtttttctggtctcaatatgactgtcggttgattaaatatttcaactctgctttatgttatggtatttttcacaagtgaaaccagttcattggatttatatctctttatatataaatgaaatggaaaactgaggtaattatccaaataagtcaagatgtataagctttttgtccaattaactgggtataccaggtgaaaggacgatttttttttttctggaatgatttagataattgctcaaatttttaactttgattaagccatctcaaagtatgctcatgaaagctgatgtttatacacgtttaatgcataagacatgtgagcatttcagactttaagtcaggtgctttactgaattggatacccatgaataaaatattgcaggaggaaagagggtaaaaagcactatgggacaacatcaaacataaaattagcctttctttagggctgtgtacttgcaaaatgttgaataaagtgtacttgtcactgagattccttcactgtattttaattatgtatatttaagtacagaagaaaaacatttagcaaaatagaaattacacagtggaacatcaacagaatttgaaaaggtgtcatgagatcagtgattagttattggaccaatttgtttcacatgaatgattaatgtagcctgatgagtatctataggagtctttccttcatttctcaaaggaatatgtaatctgaattctattgataattatggatgctttggctaccagagaactgtattttcagatatttaagtatattttaaaagtttttaagtgaacttaattctgtggttactgaagtgtcagtgattctaactttgcttgaattaagaactgagagtaggccaggcgtggtggctcacgtctgtaatcccagcactttgggaggccgaggcaggcggatcacttgaggtcaggagttcatgaccatcctggccaacatggtgaaatcctgtctctactaaaaatacaaaaattagccatgcatggtggtacgtgcctataatcccagctactcaggaggctgagtcaggagaatcacttgaacccgggagacagaggttgcgagtgagctgagatcacggcactgcactccagcctgggtgacagaatgagacgccgtctcaaaaaaaaaaaagaactgagagtagagtgttgcgtcatttaagacttcattatgttgaaaagtcaggaatgataaaactagatggtcagtgggcacatactagttttgcagtacaattccagagtatcttttaaaactagattgggaattggctgggcgcagtggctcgcgcctgtaatcccagcacttttggaggccgaggtgggcggatcacgaggtcaggagatcgagaccatcctgcctaacacggtggaaccccgttgctacttaaaatacaaaacaaattagcggggcgtggtggcaggcacctgtggtcccagctattcaggaggctgaggcaggagaatggcgtgaacccgggaggcagagcttgcagtgagccgagatcgcgcctctgcactccagcctgggcgacagagcgagactccgtctcaaaaaaaaaaaaaaaaaaaaaaaacctaaattcggaattgtcttgaattttcatagtcctttcgtacagaccaaatctgacagctctaccttaaagagccccttccctaaaagagcagaaggggtttgactgctctctggggatcgccttcttttcagcaagacactattagccctggcacagctggtaaaatagagagctgtcgtgaatgaggcacacatctcacttggtctgtgctcccttttccagatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacaggtaagtcccagtgacactgtgcaagggaatgacaggctcctctcaaagacctgcacccacacagctttgggataaacgctgggagtgagataagaagcagccagatgtcctgacacagtgctgtctctggaagcttccatgatcttctgtgcctgccttgtcagtggaattaagatgtgggtgatgactctttgggctagatggcctctaatgttctatccaaaccagagatgcctccagtaaggtaaaggatccaaaatgatgaggacatttgctggggattgcttaaaacttagagagctatcagctcaggatttaatatggcaccatctcattaagttgcataatcctccatacgttcttggcccttagagaaatgtgtcttgacacttctctaaattaaaagcaacatataggcctcttaggatctacaaagacttccacttggaattcttaaggtgtttttccagaatttggcctagagagtagctatgtttgcattcgcttaaaatttgatttaggctgtgtcgtcactgtgcaaactgaaatagagagttggactgttttccagataaattaatcaacttcccaatcacccttttaagtttgtgccatgtagctatagcttggttgtattttagggaaagcaaaggcccaaatggtcctttgagagccaagtaaaatgaaacatagaccatttttttttctttctcagtcagttttatccatgcttccataatagctttcactactcctctggaggatacacttgttctgtgtaaaatagctatctttgcaagtaataggaaatgaaatatgaaaatattttcacccacacatatttcctcagttattaaatatagaaaggtgaagggtatagaattaaatgaacaggctataattcaaaaaccttgtgaaagagaagagacaggttattactggtgggaggatttctcttcattcaagtgaccaccacaacaatacatattccataaagaagagacttttcattttaattggatctacaatagcaaaaaacaaaccaaaaaacaaaaaaatctggttggccactaacagaattggttaactaagtgtctttttcttatttttgtttggttccatagggtagcacctcacctatagtgttattttgaatgaattaattcatatatcataatatatagccattaaatggtctgggtgatgcttagatagtcatgataaagataaatgtatgtgatacaatgttaagtgaaaaaatacaggatattccaatgatcacactctgtagaggaagggagagtgagaatacataaaaaggtaattgttggaccgaaccaataactaattgagcttattcatttgtatagctcctggcagcttttccttttatcatgcctcaatttgtatagttgatggtgaactttgattatatggagtcttaagactgtcttatgacagtcttcatttttaaaaaattttctagcagtatcctgagagactgagtttagccataaacttcagcagaagccttctgtctgatttcatcagagtcaataattgatcagttatttgaaaaaggtgattaaaaactagaaatcataaaaaggtaacatcttctaaatttaatttttaactcaaaggatataagtacatttggccaggtgcagtggctcacgcctgtaatcccaacactttgggaggccgaggcaggcagatcactgaggccaggagttctagaccagcctggccaacaaggtgaaaccctgtctctactaaaaatagaaaaattagccgggagtggaggcatatgcttgtaatcagtaaggcagaggcatgggaatcgcttgaacacatgaggcaaggttgcagtgagctaagatcacaccactgcactccagcctgagcaacagagccagattctgtctcaaaagaaaaaaaaaaaaagtacattcatacaccaatctttgaagagaaaggctgtggtctttttttgtgtagaggttcatttgtggagtttgtgtggctatcctgcataaaccccatctgttatgtattacttacactttctttgtagaagggagtgagaatctaaagcctttttcaaaacaaatgaatgtaaaatccctctaaatttttacagtttttctcaattttttacacttgtccacacctaatttgacagcatttcttttactgaatcaactttatctaatctttctaaagctttaacttgccctagaaacagctcttctggttacattcatattgtactggttgatgtaatatttaattaaattatgtaagtacagtaatcaatacactgacacagaatgtttgagtgtatacctaggtgagtcttggtttgtgtactgcacagcctgtaggagcagaagtgtgtggacctctgcaagaatagccgtctggctctgagcattctcccttccatgagcatcagcagtgatattttacagagggcaagaaaacatcagttaacacaagttggttaaatgtaggccagttaagagagtttgtaccctgtccagtaaaagaatctgctattccacagaccaaaacattttaaaccaaatttaaataaaagtttttagactaggattcaaattaatttcattatatgcataatatactgaagctgagagctcatccgtcctgaaaagtacttaggaagggaaagataaatttccagtataggctatcacatttttattcagctataaaactcccccaggacaatctatattccaacaatgagcagtagcatgataatctgatgtggtatcatactgaaggcagaactagggttatggggtaggatattaggaaggcaggtttcaggtcagtatccagaagagctttccagtaactaacaagagctagtcagcaaaaagctgccccagaaaatactggagtgcttcccgcggaggcatccaagaacaggtgggatacccactggcagaagagcacccacttccagcagggtattgccccagatgaacctttaaggtactttggaactctaatgtcctagggtttttatttctaaactttcttgcttcccacatatatattttttaggtctgccttaatgttttttactgcctgggcctttggccactaatttacattgctgtgcattgcctaaaagcatctgaaaaagaagtaactaaaaaatgtccataccaggccactcatcacatttaagaaggtatggatatgaaatatagtctgatgctattatttccttagtgcctgtgataattgctcaataaaaactttatgtctttgggcactctaagggaagcagtaaatatttaatcttggcaactgcagccttcagaccttacccacaaaatgctgttcttttccttgattggtgtacagaggaaattctgtggtaggaactgcatcttattcttaaaacagaaggtataatgaaaagaatacaatgaaaaatatatatatattataatccatacaggtattctccactttaagacaagcaaacaaaatcaggaagtataaagcatataggttggggtggttagttatattataaagtaattcttcactttactcaataatttatcataggatttctttaaatatcagttttcgctaatacagttcgctaatacatcttattcccacatcatgagctatatcctagacttctgcatttagaaaccaccttagtgattttccagctcaacttttttatttataggtaaagacactgaggcccagagaaacatctgaaatgtcattcttaaggttatatagctaatgaatggcagaattggtccaggaacccaactcaggatcttctcacttcaccatttctaattttagggctgaggacaacaagacatcaaattcttctcaaaattggcttttctcattttgtttttcattattaagataatacacattaatcatagaaaattggcaaatacaaaggtaaatttttaaaaagtctcctgcagtatcaccatccaatatctgtcaccatgttgacctctggactctgaaaggacatccatattcccctgtctcaacagaaccgttttccatttgaccttcagtgcactgaaatcaggccctctgacttttcatctaagtgagccgtcagtgagcttctatatggtaaactccttagtctcatcccagagtcgtcttctgaaacatttgacagtggtttttcatcttttcccccgtctttgccctgtgattgatttcatgacattactgttccctgcatcctcctgcatcttggactagtcttttcctgtctcattctcaggttcttcttctcctgtccattccttaaataataacatcccaggcagttacatgcttagctgtcaaattatttatgttattcccctgggatatttcatctgctttggagtcaaccattacttatatgacattgcctgctaagtaaatatcttctgcccccacctctgttgtgagtgtcatgctcctatttccagctgcctattggactttttcttccagggtgtcttgtaagcctctctggctgacagttattcaaacctaaattaatcaccatttcctctccttgtgtctatttatttatttatttatttttatttttgagatggagtcttgctctgtcacccaggctggagtgcagtggcgtgatcttggctcactgcaacctctacctcccgagttcaagtgattctcctgcctcagcctcctgggtagctgggattataggagcataccaccacgcccggctaatttttgtatttttagtagagacgggatttcaccatgttggtcaggctgatctcgaactcctgaccttgtgatccacctgcctcggccttccaaagtgctgcaattacaggcatgagccactgcacccaactctgtctatttattaattgctagacatcgatactagaaattctgaagtcatacttttttttgtctccccattcgtcatccaagcagtccatcataatatcctgccagttctacctccagggtgtccttcaaatctctccctgttgcggatgctacttccctgggtcagtctttcagcatcacttacctggatcattgcagtagcctcctaccttctctcctcgcctctctcatcaattcctgctccacactgctgccagagttaatgttttcaaaacatagatatcggtttaaatcgttcagtctttcaactgcttaccactgctttatagcatgaagtccaaatgcattagcagggcagcaataccctttatcttctgtaatgtaaatggattgtttagctttccgtcctacactcctcatacctacatccaagcccatgccctgctcatggttaccccaaacaattacgctttcccaagatgatgactttgccactactaactcttctgcctactgtgccctcccccttgtaagcctttcttttttttttttttttttttttttttgagacagagtcttgctccattgcgcaggctggagtgcagtggtgtgatcttggctcatcacaacctccaccttctgagttcaagtgattcttgtgcctctgcctccctagtagctaggattacaggcctgtgccaccatgcccacctaatttttgtatttttagtagagacagggttttgccatgttgaccagcctggtcttgaactactgacctcaagtgatctgcctgccttgtccttccaaagttctgggattacaggcgtgagccactgtgcccgtcttcttgttggcctttcctgaaatatctctcaagcctttttaaaagtctgcttgactgtcaccgagttgtcacacattccccaaatccccaagatggaattacaggattctgcctctctgctctcaacacgccttgcttttgtggctaacagtctctgcgtcttattctctctgcatccactgcaaaacagctcactgctgagcacggcgcctgatggatggtagacactcggtaactgttgaataaattgcctctccacattagaagcacatgtccctttcataacccatccctcccattcctagctacttctacagaataaaaataatttttcatttttttaaagatttaataggggcacacttaagtggggaaatgtctattcacacttccgtgtaggaagtgctgcttcagattgcttgagttaaattagaagaggttaaattaaaagaaaaaaagaacatctccccactgtcaaggaacacagaatacaactcatcttggtagttctgacaattgaactcaaatagcatccctgttcccttcctagagaggtacactacaggttttgtgcatgtacgcctttttttttttttttttgagactgagtctctctctgtcacccaggctggagtgcagtggcaccatcttgactcactgcaagctctgcctcccaggttcacaccattctcctgcctcagcctcccgagtagctgggactacaggctcccgccaccatgccctgctaattttgtttttgtatttttagtagagacggggtttcaccatgttagccaggatggtctcgatctcctgacctcgtgatcctcccacctcagcctcccaaagtgctgggattacaggagtgagccaccgcgctcggccgtgcatgtacacattttttaaaggcaggaagccacatgtgacaatcagtcaactgttatatttggcagagtctgttttttaaaatgtgtttagttaacctgttaaataaatttaacattgaaagacttataaaaattatttctgattggaaaaacaagacttttggtaggaaaaaaatattaaagaaagtaagaccacagtatttataatgcaaatattgtaaaaggccataaacctcctgaggtcgtattgtgtttttgtaatgaatctataccatatatgtaggtaaggctgaggaaaatacgttcatttgtttaaaaaaaaaatatctagtcaagtttcttcccacatccagcgatgacaatgagaaggtatcatctttttggtataaaagccaaactgcttttttaagattttctgcttgctatagatagtacctaaagtcatatctgagtttctgaaaagagatatcagtgttttaatgaactgacatatcaatcaaagtgacaaactaaaactatacacacacacacacacacacacacacacacacacacacacacacaccattgtatcttcatttatttttatttttttgagacaggatctcgctctgttgcccaggctggagtgtagtgtacgatcatggttcactgcagccttgacctgctgggcttaagtgatcctcccacctcagcctcctgagtagctaggattacaggcccacgccaccatgcacagctcgtttttaaaatttttttgtaggacgaggtctcactatgttgccgaggctggtctcgttttatcttcttaatactacaagatatactcacactgttgcattagaaatgcattttggatcctagaacttgctataaactaaacctgacgaggaatggtttgtacatttccttttaaacgtttccatacactttgtgtgtcactttggatgtgctttactcatgcatttatcctcgcaggccctcatgacgcccgagtgtcaggaatgttatgggtttgtgttgtgtgtcatctgcttgttcccccatctccatatgtgcttcctattctgactcatctcagtgtactattctctcgtttttctttctctgcagtacagctatcccttggtatttaagggggcttagttccagggcccccactgataccaaaatccacagatgctcaagtccctgatacaacacggcgtagtatttacatataacgtatgcacatcctcctgtatacattgaatcatctctagatgactcataatacataatactatataaatgacatgtaaattgttacactatactgttgttttatttgtattatttgtttttgtatgttttttattttttcaaatatttttgatctgcaattgattgaattcacagatgtgaatcccatggatacagagggctgggcccactgtactttatttggcttccaggagccccttcattcatccatttctgctcatttttcttccccctgcttttccactctagagtaatatccccgactttttcttctcctcaccctctcactgtcccaggctcattttctccaatctcttgtaatgccttcactagatgtcagctccaccaggcagccttccctgatagccttgtctacccatccctctgcagtgaggcctaggtgtgcgtgtgtgtcctgggagtgaagcctccagttcactccttaagacctctttaagagcaagaactatgtggagagatcctcttttaaagtgtttttatttttgtgcttttttttttctaaacttcactttgactgctttggcatgttttaccatctgaagttatccactttctgttaccgaacaccaggggtttggtctaggttctgcagctcactgcacagaaaaccaatcaccgagaccacaagtatttccaaggaagaaggctttaattgggtgctacagccaaggagatggtagctcagtctcagatccatctccctgatggactaaaactaggggtttatgtaacagggaagaaatgtaacaatgtgtaagaaaacaggagcaagggagggacagggaagcaatcgtgatgaatcaggggtcagcatctggttgtcaggatgtggtgatctggtgagtttcagttctttgatactttctttgagaggcctgaaagtcatttcctgagaaaggaactcagataaaacagatgttaagtttcaagctttaagatcagaaatgtctgccgggcgaggtgactcacgcctgtaatcccagcactttgggaggccgaggtgggtggatcacgaggtcaggagatcaagaccatcctggctaacatggtgaaaccctgtctctactaaaaatacaaaaaattcgccgggcatggtggcaggcgcctgtagtcccagctattcaggaggctgaggcaggagaatggtgtgaacccggatccactgcactccagcctgggcaacagagtgagtctgtctcaaaaaacaaaaaacaaaaaaccacatttctcattttccgagttcttgtgtgagaaaactcgaaacaaggcatatgaatttctaagttttccttgacatctccttgaaatattacagaattctttctcattaaaacattaatgcctgtagcatttttaaaataaaaaaggaaataaagtgtcctgggtaattctgctgaaagtaatttactgaacatcatcacacacacagagttttatccattgatctcttttcaggactataggcagcgtttctttgggggtaactatttactcatgtgtattagcagtgttactcttgggtcattgtaataattctgactgttaggaaaaggtacagagaagattagctcataaaaaccttcagaacacattgtaaatggaaagggagagcccatttaaaaagctcatgtccactttgaccaactacatgttgtagattttctcaccccaacagtaattcctaagattagacatgtatggggaaacactaaagatggaaacggccctacaagcaaatggcccacaccctctttaggctgatgaaccaagagagaaggagctcccagacagggcttggtataggtggtgccttcagctcaaacctactccttcctattcagagccaggggacatgattgcactatttgtggccttgttgctgaacccccagcagcagagattatctgcggccctcttcccatttatctcaaagatgaaaaaacacagagaataaagggcaaagcagaacaaacccatgctatgtgagataagaacctgagctccaaagaagggttttggggaaagtagtagacataggccacttggaaccgacattagttttctcttccgggaagtgaggatgctgtatttaccagcaccttctatctcatatagttaccctctggatcacatgaaaaggcctctgtaaaagttcctacagaaaaaaacatagaaaatgtccaaaaccgaactttcttgttgttaccggccacacctctagaataaaatatgaaaaacttgatctttttatgcaaatgtgaagccagcctcttcatgcaaattgaaaacttaatctgaaaatactgaaggaggagtaatatattttttagaagtctgtggcatgagatatgtagtacagctaatcttactcaaaatatctttaagaaaaagagtattcattttttagtgcttgccactttctatagctattgatttgaccttttaaaattagtttccaatatagaaaccctccacccctggcagcaatgaactaaactcatgtaggagtttctttaagaaattacattatcacatatttactgaccagagttttatcccaatagaaaaatgctctaggaagttaattacttaaagactaggaagatagggaaattgtagcttttcccagaatgacctttgtggactagtttttagaaaataatttgcatttctttccaaacagggtaagtcaagatgagggcttgactaaccctcagtttcagctgtataaacattgaactttcaaatgtcttagaaaataagaccaaaacttataacaaccagtgtaaaaaataattatagttacattattgattatttcccttatgggaaataatctctttctccaaaaaggcaaagattgttttatttcttagtttgtatgatgtgagtgtaacaaacattttagtaaacaaaacaatgtttaccatatatgtatttgtctatatatatgtgtgtgtgtttaaaatgcataaaattatatttaaatatatttcaaattttaaatttatatatatttataattttgacatgctttggactcgagaagcctatagtttctaattacctgtgagtataatcttcattgaggccttattacaaagtattccgttttgtaataaacaccatgacatacttacaactttgtacatgagggaaaaaaatctgaggcttcttttagcacaaaccatagaataaacccgattaccaaaaccctgttgcttttttgatttgtatttctcactattatttattaatagctagctacatttttggaccagctgaataaaataattgagcggaactggtagtagtaacaggctgacaatttattcaccatgttgagggagagattctaaaattttctatagggctcataattgatttaataacaatttaaaatacgtactcttagttttcctaagtaattccatgtctaagagcttggaggcccttctaacgaagatccgttccgttaagagtacgcaaagtgaatttcagtcctctgcacacttgaagcaagctagaccagatgagggaagtggcaggttttacccaatttcacacacaaggaaatgatttaaaaccacttcgtaaactgctgcatagaaatcagcatttgagtttttcctggacgcttgttctaggtttgcatttgtcatcagctattaatgctgacttacagtccaagctgaaatctgtcaaagacaaaataatcagagaattggccagaatcaactggatgagggatctttatattctcactgatgctctgtgttctgagaggagtatatatttcagaggtttgtttgctgctttgcttgcttttaatgccagaagaggaaagagaaagggcagtagcttttcggatagaattttatgagtttatattttagaaacacgtttactatttaatatattaataaaatttccattgtcaactaggccctgcaaaaataaacatataggaagctattgtaaaaataatttatttaatttccttgctaatataattatctactaacttcaaaacaaaggtaagtgtaagtatgtgtggacattaaactcttatcctcatcagtaaatgtcttccttttgaccttagagtttgagtcccaagaatctggaaatagtagagttctagtggcaatatttcattagaattaatctaagtaattattatgacagtagtcagcttcttatttgatgtggcattaaataaaaacagttaatacattcaaactggatcataggcagtaatttgaactccatagtatacaggagagaagggatgtgactactttccaagtctagtcacaaaatagtgatcattttttaaaagcacagacttgttcaaagatttcgtatctgattgaattcaatcaatttcattattatctgaaagtgggtggattttgttcttattgtttgtattctttcatatcgccttgttcgtgttttatcacacagagggttaagctgaatctgttagaatatgttttcctctaggacacagttgagctgggactagaacccagatttgaaattctaccctgaggcttagctggcactcattatgtcattcagtcatatatttgcaacaatttaagtagttagatttttcagtgatgaaaggttatttaataggctgcaggttacgacagtattttcctagttatcttctgtgcagtcttcagaaaagattgggagcatggttgattccaataactacctaagggttaaatattatgtgtgggctcagacccgtggtcaagtatttgggaaaatttttattgatttaagtaggtgttatagctcagtaacaaatggccctatgtttggcaagaaaaggagatatggaaactctactcacagccaaatctgcaagaataaaataattggttcacgtaaaaggaaatggttttgacagatttacactcttggggtatgttagaattccaccaaaactaaggattcaagtgcatttttatctcaaagtggaagaatctgacactgaaagtggaaagcattttctataaagcaaatgctattgacacggtcactctttcccccattgcattctctacttgttgtcttaggtagttctgatgtgtcctattgtcactctactttctctactccatttagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactggtaagaatccgcttagtggtagagtcacacttgtgtttggtcacatggtgtccctgggccttgaaatgataacactcattcccacagccaactcaaggcgacttaccttatagtgagtttcattcagggctagagccagcacctgcatcccatcttaatatgaatccttgaacttctcttcatcatcgtgtactttgacagtcaggttctttgtgatattttggcagaaagttaattcagttttattccactttaaaattaaaatcagtctttgttgctgacaatgatacagcattattcgtaactaaagcttgtgtattgaagctatgatttcgtgtaattgattcttactaaacctttaagatactatacatcacagtagtggaaaaataatagttataatttcaagtaaagcatgagtaagaaaatattagtgaacttggaggttttttaaattaaaaagtgtaagaaaacctatgaagtcattagatttctttgcacttaatccatcattttttgagattgtactaaatttatttgctggaattgccttaaagttactgagtctgagaaagcaaaactgaatttgaaacatgcattcatggaagatgttgaatcttttttttttttttgtctcttctaaaatcagctgagttcactgaaatgtgtcccaaagggaaaggttttgtgcctgctggagaatcatcttctgaagctggtggtgagaactataaaggtcagaatcaagtggaaacaaattttcagcacattgtgtacatgtcagatattcaagtgaaaacatggcttgggtttcacagaattagagttctttttagtcatgaaaactgattacaaagtccttaattctaccattaaaagaaagtccccatggacttgcagtcagaacacaaactgtatgatgctcggagtttgacattgggaggtgaacttctgagtttctgtctcttcatccctgagataggaataatttctcaaaggttataatgattaagatatatatctgaaagtacttaacaaattctgtacctagtagatacttactaaatattttattctagatgcttaatagaaatcatatcaattatgatcatataaatttgaccactgtttgtctttatggtcatcaacaaagctaaggttcttgtatttttagactttatcctactgttgtggggccttttaccagtgtgcacaagttcataatgagaaatggaagagaagacaaccaaagtagacatgttttatgtatttgatgctacggttatataattctaaaataaatgtgcggccttttaattttggtgaatatccacatgtatgaatatttcctcattaaccactcacttttgacattttcatgatagagatattaccttttatatacaaagtgattttttttcctttatagtttaatactgaggactgctaagtagctgggaaacacactgtaaaatcatttttattgtccatttttggaaaactagtgtttgaataatatggtataattcagtagctggataagaaattccatttgtgttcttttaaatacatctatgatttggtccaattaaataatgagaagatttggtttataatatgtgttgaatggtttccaaattcacaaatatacattactatgtttttgcagggatgtagttaaatctcacttcatattaaggtacagagctttgatttcaccataaattcatcttctcttttatatcaaaataaattccttgtcttcctattttagcagtgctgtaaatggttggaagaagattggattcagatccaaccagccatatgttctaggcttgactttgccattttccatctgtgttaactttaagcaagtcatctatggagtcttcaggttgtaaaatgaggactagatgaccttagctctaaaatgctagaactaatgctaataatagcagtaaaagcaatagataacacttttgagtatctgcttatgccagagcatataccgagtcctatccatggattatctcatttcatccttcctctcttattaggtagatgttcctattgtctccaatttatcattgagtaaactgagatagcaaaagctattaattctgtgggggaatgggtctgctaaccccctcagcaacttgtgctttcttttatcctcaagaaagacttgcattcaagttccaccaaactttattggaaactttctacatctcaactagtgaatgggccagaatatacattacagaacacatttcttaaaaggtatatatccttttgttgatgccactatggaaccatagaccatttcatcaaatatgaggtagcatctcagaaaccatatttacaaatacacttctcctataatgttttgggcattgcttctcaaatatcacagacaaactacatctgtttatgtttttatgcctgccaattaggccttattttaagaaggttatattgctgtttgtgtaggattctttggaatgtaaatattataatatctaacttaaagccccaaatctggttagactctttttaattgaaagatcaaacctaactcctttttgtatttctcaatttttttccccgtagatgcagatgaatgcctactttttggacaagaaatctgcaaaaatggtttctgtttgaacactcggcctgggtatgaatgctactgtaagcaagggacgtactatgatcctgtgaaactgcagtgctttggtaagctttagggggatatagtatggtgtactgtgaaaatatacagatggaaaaaataactatgctatgtagtaaaaacaatttccttgaatctaaatcatgtgttgaaaagatgtgtaaacgttttagggatctttttcttaagcacaattgaagaaaataaaaagaaaaaaccacctccatactactgtttgaatgtatttcaaacaaagagttaatattcactgtggaattatgattcaggccactggtataactgaagtgttcttttggtctgtggaacatcctgtttcatcactcataccgtgcaagtgacagccattttaaatactgacccagactttaatgcttaagcagaaaaccatatacactaggcagaaaaacatagcaaaaggaaataattttaaaagttatcataaagagccatttaatcttaaatttctaagcatatcctgttcatggatgttttctttccttatttaatgtcagcagcagcagcagcaatgttgtttttcagtcagagcagcttacatttttatagacagagccactctcttttggatgataatgtgtggttaattaaaatttggcagcacctggaatctggactaaatatagcaatgtgtaaagtttgggaagtgtatgaggtacaactgatggctgattttctttagtaatacttttttttgctcttaagatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacggtatgtttccaggagatgcaaacctgtgtccaaataactatcataagattttccttttaactaaaatgtgaactattggaaaatagaaaaatggattccttgggtattttgaaataactaaaatgagatacaatgagatacttacagaaatagtaataagatgcatatcatcagtatgtaggagatttaatagcctggacatactcattaagtatggactatggagtggctgagcagatggcagggttgttccatggcttagggttcatcatccctaacctgcagaggcagctgagggaaatgtaattcagggaaagataattaggtgcactcagcagagtggaggatgtggataaggctcagcagaacagagggtggagttcaacagggtggtggagagccccgaagtccactgacaaactcctgtcctccctgatgctactgataattggcaaaaagccgctgataattggcataatctgtcattcgcctcaggagactgctttggatgaagtcaattgaaaggtaggaattaaagactctaggatgaagggtcactagtccagggctttggcagattaaatggataagaaggcatgaatccaatagctgttacatggaaagaaatggtagggtttgacaggagtaaatgaaaaagtgaagattaggagagtgagaagcctgatggcttatgaaggacaagcaagatagtgggcattttatataaaagtaggaagctatagagaactattgtgtcgggaccggatgggcagctggaatttcaactgatggaatgacacccagttggagatgacagagaattgatccattgaaagaccagactggattcagacttttacttggaagtcactcttagaaatagagatggaaactttgagacttgctggcttccaacacagtgtttataaataggaataactgtgcgattttcatggaactatgtcttccctttcagaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcaggtgagcccatatccaattccttctgcaggaggcctttggggacaagttcatctcacctcctttgtagcctgacatttctcttctgtatctttgccttcactcctgatatcttactttcatcccgtgtgtgtgtgtgtgtgtgtgtgtagggcagaactgcataaacatttggctcctggtttacctctactcccgaccctgtcgttaatttttgaaactctcattccattaccccaatgaatgataaatgacccaaaaaaacataacttagcaatcagtggcataggcttagaatttatatttcctggcagttcattttttactacaattcttctcattcctaacagtttctacttagaccaaaatgtgtattagagacggtagaaaatcattctaggtcaaagtccaaattttcatgtcaatctctgtatgtggagatataagaaacgggttacaacaaaaagggaaaagtacagaaagtaattgaagaagtatttcaacaaatctcctttcctttcaagttctagatctatctgggtttaaacctttggtcaaatggaaaagatgagacaggctaagctcccagtttcatcccctctcccagtttggaggaggcctggaaggtgctggctttgtgcttcctggctaggctgtttggtgaccgttgagttgtgcactgattgctaatttcccttttttaccatcatagcaccttctcattaaaggaaagcactcgaaagtgtccagtatatccttttgtaaagttgacttgttaaagctagaaagatcatgtgcaagtagaaagcaaaggagtttattatgaatatattctcagaatggtcgagaggggaaaaattgcttgaaaagaggaaatgcattaatttttagttaattcaattagaatatttctttcaagctctttagaaaattagctttgcagcttagaaataacttaaaaccaacgtagcatgaaagagaaaataattgggaattcccgtaagaagaaaatgaatagccaaggataaagagcaaatacacaaagcactagatggcaatgatagcagcccagaattggaaagagggcaggtctggggccagttggcactgagtctggaatccagcactgccatagcagctgcatgacaaggggaaaataacttcaccctgtacagctcatttgtaaaacggaggcgtctacatctgtcctgttgggttgttgcaagggctgggaggatgtaggtagagcagggggtaattactagctttactggttgtttcgggccctggaagcagatgccacggggagataaaagtgaaatcactaagttaatgtgagttcagtgaggcttttgagtcattttctcacaatgctatactacctcaaatcttttttatttatgcagtggttttatattgtctaatttttttccaaaaatcacatgtattcctcctaaagtattaaaataatcaaagaggttatattcccctccacctaccccatcacagttgaactctgctccttaaagacactcacttttgacagttgggtttttatcatcctagcattttcttatatattaattatcattatatattgatattagttattgctgtatattaatatatttatatccaacagagtatttataactgaagtctatgtcatcaatctaagctacactttgcttgttattttgcacttcagcatccctgagattggggtcatctgataattatgacatataacaatgtccacgggttatttttcccaatttttaacatctgttatatcaagatacattttacaatctaggatctcttaaaatagatgaaagttagaacttaaaatttttttatattgatatatttaggggtgcaagtgtagatttcttacctgcaagtattccatagtggtaaataaagtctgtgttttttgtgtacccttaacaatagcgaacactgtgcccaataggtaatttttcaacccttaccccacttccagactcccacattttggagtctccagtgtgtattactccattccatatgtccatgtgtacccattgtttagctaccatttataagtgagaacgttcagtatttgactttctgcttctgagtaatttcaattaggatagtgacctccagttccgcccatgttgctgtaaaacacacgattttattcttggttacggcttagtggtattacatggataaagaaattttcttactgaggcattcctacaggtgcatatgtggaggttcattgcagcattgtttataaaaggaaaatcaggactggggcaagatggggcagggaaaggttaggggaggaagaaaaacaaatgcccagcacaagagatggctaaataaatcatgtacatctataaaacagattccatgcagctgtttaaaaattaccatcttttggccgtgcgcggtggctcatgcctgtaatcacagcactttgggaggccgaggcgggcggatcatgaggtcaggaaagatcaagaccatactggctaacacagtgaaaccctgtctctactaaaaaatagccgggcctggtggcgcatgcctgtaatctcagctactcaggaggctgaggcaggagaatagcttgaacctgggaggtggaggttgcagtgagccgagatcgcgccactgcactccagcctgggcgacagagcgagactctgtctcaaaaaaaaaaagaagttacatcatttgaatttaaattagtacagcctttatggaaaacagtatggagatttctcaaagaactaaaaatagaactacccggcgatcccactaactgggtacctacccaaagggaatgtctttatccattcctccattggtggatacttaggttgattctatctctttgctgttgtgagtagtgctacagtaaacacacaaatgcaggtatcttttggatataatgacttcattccctttgggtaggtacccataaacaatgctgcaatgaacctccatgtatgcgtctgcaggaatggcttagtaagaaaattttgacaaataaaaataccaggctaagtgtgtacactttaaatttatgatattattctggctggcaccatggcttacgcctgtagtcccagcatgttgggaggccgaggtgggtggattgcctgagctcgggagtttgagaccagcctgggcaacgtggtgaaaccccatctctacaaaacatacaaaaattagctgagcgtggtggtacacacctgtagtcctagctacttgggaggttgaggtgggaggatggcttcagcccgggaggcagaggttgcagtgggccaagatcgcaccactgcactccatcctgggcagcagagccagaccctgtctcaaatagataaataaaattatacccccaaaatactgtaaaaatttacactcaatttaattgactaggtttaaaaaccttcaagtattttgttatgagaaatgaatttttgaataatgtagcaatattctaaaaatgaattttattttaaatatttattctaaaaatatggatttcagaatattgcataaattgttttcaactaaagttttcaaaaaacattttaaaaagtagattagaacaaatacatatgaagtacatattatataatatttttggaaaaatacagaatatcaggggaaaaaagataacacatgccaaatttaaaaaaaaaagattagcttcattgctatactgtttctagtttgtatatccacagttattatgataaaatgtccaagaagaatctctagtgtacatggtcagccaaaccaaaatcagtgctttccaatccgttactttttaaaaaacaatggtagtttttttgttaactgtattgtaattttaacctccagcatacacattcattgacattaaagatgctgggtgggctggttggcgagaacaactacttaggctcttgaggcccctgtgaaggaccccagggttccaggaaacgcatgttgaaaactgctttcgaaatatatctgttggagtatataggaattagggaggtagccccaaaggaactttttttattttttgacagagtctcgctctgtcacccaggctgaagtgcagtggcgggatctcagctcagcgcaacctccacctcccaggttcaagagattctcccacctattacaggcgcgcaccaccacacacacaaaaataattttttgtatttggtagacacaggggaacttttcttttatactaccaaaattacggacctagaactaggcttatggatcatctattctgaatccagagagaagtacacagtgaaattaaacttttccacaggtcctatgattagttggcattcccttcattggcacctaatcatgtagtcacatttacacaaaaccatctcttgttgcaaagcacatgtttgctggagtggagtgaactaagaggagccccagggcatcagggttagcacatgtgccccagaaccaggttgccctgcctttgcatcctggtttggcaacttcttttccccatgaccttgttaattttctctctctgtacctcagtttctcatgtgaaaataatatctgcctttcagggtggttgtgagaattaaataatacgtgaacacttcaaatagtgtttgacacatggtaagttttcagaagatactaacaactatggctgccactaataggcgtctcagatcaaatgcattttcaaatgtaattaaaatccaaaggatcttataaaatctacagttacctaatagcatgtgaacataaattaagcgtagacaaatgcagaaataattgttcttaatgtaagactgtcttttctagaccactgcttcgtaaacattaatgggcatgtcagttacctgggggagcttatcaaaaaacagattctggtttctcacttgcaaaagatggggcggggcgcgagacacaggattctgcatttctgataagtcccaagctgctgctgctgctgctgcttcctctgaggaggaagcaaagctctagagccatctaatagcatctaactttattttgttaaaacctacgttaatgctggtagttatctatcataaaggaagcaaagaatatgtgaattttaaaactagtttgttcatagtttctgccattgaaccttttaaatatactgttcccggatatcttaatcgttgagaaggaccacgttgtctatctcttcatctaagcactggactaatcccagcctgtcagacatcatgcatcccattttccttaggagtgcagtactgctttggggaacaattcgttactgatggaatcagtgctggaggaatttaaggaataaatcgcaccacttgtcatcagctttaagcattaaagtgcagtgtaaaataaagctttggctccagagcgagctttcacacttctggtccaacaggtcacgggcactaattcttgctaaagcagcaactacatctgagagtactggtaggtgcaggaggtaggagtggctgcttaaatagtgttctctgaagttagatggcatcttgcatattggtaccacatgcaggggaaatgagtgtgatggattgtgtcaggggagctttacataaggagaattgcataattgtagaattcatacatttctggggctgcttaggatcccatttcaatgctccactacagaggccagaccgcagactgcactaggaggaagttcctgatttttccttcaccatggatgtatcatggactgactgtctccccattcagacttctggaggccttccttgccccattgcagcccctgactcctcttctccttcccctttcacagtacccgctgatcctgcccactcttaaaatgatttgggtggctaaactgttttgggaggatcctcaaatttgtggtctttattgtgatgtcatgtcagcctctgagagacagagctgtttgggaaaccaagtcaggaaaaacgagccattgtatccatttcataaatgaagacagagtggtcattgtttgatcttgctgagaatttctagcgctgtgagagaagaaagtcatagagttatcagaactttgaggcctttggttgcatatggagtttattggatatagattttttgttgcttggtttttctcagtctaagtgataataaaaatgataactaacatatacatagcacaatgcctggcattttcaacatgttttccatctactgagatatttaacttgccaagccatcttaggtatacagttacagtagtcctctgccttatctggtttcagttacccacagtcaaccacggtccgaaatattaaggggaaaattccaaaaataaacaactcataagttttaaattgcatgcagttctgagtagtgtgatgaaatctggtggtgtcccacccagcacgtggaccatccctttgtccatggtgtccatactgtgtatgctacttgcccattagtcacttagtagcagctccattatctgatagaaatcgatcgtatatataaggttgagtactacctgcagtttaaggcatccactgggggtcttggaacatatccctagtggataagggagaatactacccctcctttttctgacagaggatctgaggcacagcaagcttaagatgcctgtcagtggtcacgtaccagtaagtggaagcttcaaatccaggcacccttgctccagaatctacgttctaacctcttcagtgttactcgagtctctttccatgatcccaaagcacatcttaaatagtctcccttagaacagaaaagtaacaaagtgaagaattaaagctgagattttaaaattgtctcacacattgtgtgctaaaagaaaaactgattttagagctaacaatgagcataataagaggcaatgtgtcatcaaatctgtagccacagacacattggcaggaataacaaaaaactatatattcaatggactaatgaactaaagcaagtcaataattctcagtaaataaaacttttagtgatgcctatcacttaatctaaaatgattttttaatgtttttattttttgctactcttaaaagtataagcttaatcaccgggtgtggtggctcacacctgtaatcccagcactttgggaggcagaggtgggcagatcacttaaggtcaggagtttgagactggcctggccaacgtggtgaaaccccatctctactaaattagccaggcatggtggcgcatgcctgcaatcctagctactctggagactgaggcacaagaattgcttgaacccaggaggcggaggttgcagtgagcgaagatcgtgccactgcactctagtttggacaacagagcaagacttcatctgaaaaaagataacataagcttaaatgttctggaaaatgtacgtaagaatcacaagatagagggtgccattatctcatggaaatcaaaatccgttgatctgcaaatgaaagaaaattatacatatttgaacatttgaatcttaagtacccagggatcccagtgtctttttatattgttaaaataattagatttctgataagtaaattgttaaagtaattagacattgtaagtaaacggaacaaagacttgataaacgggacaactagtgtgttgggagaatgccacctattggcgatgtaatgtactacagcacaggtaatttcttgactactcaggtgtagaaagatggttttaaaacatgaggtcccaaaggaaacagaaggtgccacaaaataaattgaaaaatgttaacaaagtttaatgaaacacgaacattgatcaacatacagaggcatggtcctctcagtgttgctaagagagcagtttgaagagacagacttacacatctgaatcaaaaattctagttctgggactgatgaaagagcaaatggattttgtttaatgcctattgaataaaagaataaagcacaaaggcatgatgtgaataggcacttagtgaggatctgttgagtcaaagcaatgtcagtatgtatccaacttcctttgagaaaggtagactgtgctataggggaatagaagatatttgtcagttattcatactcctttaaataatgctaggaagaattatcattactgtatataaattatatacagcttgtggtttataagaagagataagtaaatgatctgaaatgaaatctaaattatttataacttacctgttttcagttttagttaaattacttacatgttctttattttattatttattgaatgcctactatgtactaggcaaacaattctggaacaggtgtaaagttgtatttaatgaaatgcataattagtataatttattcctaaatattatgtattttaaatctgcaaatgatactttaataaattcaccatttgctgtgacagaaaatttttcaatccttcctaatatctaacctacccaagtattcatatcattttgcaaaagtaaagaatttggaatgtcttcaaacaattcggctagtgatttcttccatatctgtgcatggctcttagacgctcccaaagatctcagggcaagaagtttcgtaatgcccttggaggtgtgaaggaagacagggatttgactcatggactaaacttgaaaaaatattgtaactgggccatagttgcaaaaggcctgtcagcagtcacggtttaaaggcttttccaagaaatatgtttccaaagaatgttaataatcactttggaacaccctacttgtgaaacaatgagtggtcactgcctttggtttaggcaatccagggatctctttctgcttttggtcctggctctgtgacattgcactgggcacattacttcaacctcctttatccaaagttgagacctcttcgtgaggttatgataattaatacaatcactatgaaagcatttatcatttcaatcatagatcctgaacattataattaaagaaacaataaccgctagtcacttacaatggaaaattaaaatcaaactagaaagatacaaaaggaaatcgagtggccgtcatgcgggcacagagaatatctataaaacaggcaagcgttccagttctgtgggactgaactcttggtatccatggaactagattgaatggatgttatatgaaatggccagtaagccagttatgttgttcctcattgaaaggactcttggcccggcacagtggctcacgcctgtaacctcagcacttgggaggccaaggtgggcagattctgaggtcaggagttcgagaccagcctggccaatatggtgaaacctcatctctactaaaaatacaaaaattacctgggtgtggtggcgtgtgcctctagtcccagctactctggaggctgaggcagaagaatcgcttgaacccgggaggtggctgttgcagtgagccaagattgtgccactgcactgcagcctgggcaacagagcaagactccttcccaaaaaagaaaaaagaaaggactcctgtatttatttagaaagctttctctcacccctcccaaagaaaggttgaaaatacttttactactctcaaaagattattgcaaaataaaattcattagtgaattcaaactgaaagtagctctttgatgtaatgtgatccgtatgttaatttcctcacttgaaatcctagtgatttcttccatatccatgcatggctcttacatgctcaagagggttaaatgtgataatgcatgggagaggattggcctacagtaaatgcgccatagcgaaaggcgttagcaattattatgaatcaaatccagttctaggaaatgagtcaacgttcatcatgcactgctccctggttatccagtgctagaagtctctttgaaaggggccaagaatcaaagacaatgagggataggagggtgttcagggaattgcacagacccgaatacccctgtgtacttgcagagaagctccacctgtgcccggccaggctcctacagtgtaagttaggaagtcaaagagaggctttatgcacacaaaggaccattatgttgagttgtttgtttgtttgtttgtttattttgagacggagtctcgctctgtcgcccaggctggagtgcagtggcacgatctcggctcactgcaagctctgcctcccaggttcacgccattctcctgcctcagcctcctgagtagctgggaccacaggcgcccgccaccatgcccggctaatttttttgtatttttttttttttttttttagtagagacggggtttcaccatgttagccagggtggcctcaatctcctgacctcgtgatctgcccgcctcggcctcccaaagtgctgggattacaggtgtcagccactgcgcccggcctatgttgggttttaatgaacattcaatgtactcaatttttaaatgttaaaacctagatattcctaagaatttgatttcaactttcacattttatcatcctatttataagtccaataaccttctataaaataagatcaattttatttgttgactgtttatatgtctcaaagaacggattaaacttaaaagttatttctacatataaattctattaattaaaattttgaacactttggtctccatctcacaatcctaataagcatttcctcataaatatttaattagctcttataagtctaataaaccaaacttaaaacacaacaaattgaattccctaataaatttaaataatgtttaccaacctaatcaaattctcctaatcctcattcaacttaaaatccaaaatctaaattcagttttgagttgaagttgcaaggcctgtcaggttctctgatgatatgattctcttaggcactaacacatgtacaataacaagaaaaagccctcaccctaagacgtgtcacagaaagtgttaacattctaagcttaattaacttcattatttctgtagcagaattactgtgttaggccagctgaggttagtggctgaaaaaattcaggaccctgattgccagttggaaatgagagaatgaaaaccaggacttgggacctgcatcctctcagtaatgagtctgccctgcccaccataggatgcggagcaccttcttgcttccgtgctaacgggatcccaggtgtttctcatgtgtgtttttttataatcagtatcttccattgcagtgactttcaagggaataataggacagaaaaaataaataggaccttttatccaactatacatgccctcccgtaggaatcagataccttctcctaaggggatatcctcaccccactgagattccctagtagatcaatagctgccagcaggatggggcttttatggatggtcagggcctcctttactaaactggggaagaggtactggatttgtgaaaggggccaaataagcaggaatgaatggcagagaagccaggtacaaaaagcagggacagtacgtacataagaggaaaaatactagatgctaaattgtgtgtttttaaaaaataaccatgtttgggcaggtgcattggaaggaaagaaagcaatgggcaaggaagccacattccagttatgatcctattgtagtcattgaaagcagaagaaaagcaaacatggtttgccgcaaggtgagaatagttaaaataaaatttttaaaaaccctgatagaggggaaaacttactccttcatttcttgctaaactgctgaagacagagctctggaggagtgtcctggaacaagctgccattcccaaaccccaaatccctggattgcgggtgagtcagcaagtatttggaacgccgaccagggaggaccagtggaccttgctagactgcactgtagcatgaactctctgttttgaaagctgattgaagctactgcctcagtgtcctcaccagccattagagaacagttcaaggcgagagaagtttgattaatgggttactcgttggtgacatgagcacttctgaaattttacttcttgtacagcttgagccttggagtgtcagttgtattcatggcacttttcctaagagctatactgcatggaagtgctagggaaagtatttggccactctctgttataaaaaatactctgaatagaaaataaatttcattatgataataatcttactgatgtcctattaaaatctttctagtttgagcgaaaggagagaaattcaggcatgcatgtaaacaatctgatcctaaaaagcaacacttatttttagttaacaagtgtatcagtctgtttttacactgctataaagatactacctgagatgggtaatttataaagaacagttcttcatggctggggaggcctcaggagacttataattgtggcagaaggcaaagccagacacttcttacctggcgacaggacagaaggagagaaagagcgaggaagtgccacacttgaaaccatcaactctcctgagaactccctcactatcatgagaacagcgtgggggaaactgccccatgatccagtcacctcccaccaggtcgggattacaattcaagatgagatttgggtggggacacaaagtcaaaccatatcaacaagcaatcatatttatctcaaaagtaaaagtcttagcagttttacctttctcctgtgaaatcagagattatgaataggcattccgttttctagaatcgcccattcagtatgatactaaatgatttggtctagtgaacattttactttcatatatatatatatgtgtgtgtgtgtgtgtgtgtgtgtgtgtgtgtgtgttttgtttgtttgtttgttttggagacagagtctcgctctgttgcccaggctggagtgcactggcacgatctcggctcactgaaacttctgcctcctgggttcaagcgattcacctgccacagcctcccgagtagctgggactacaggctcacaccaccacacctggctaatattttttattattattttagtagaaatggggtttcaccatgttgcccaggctggtttcaaactcctgagctcaggcaatccacccgcctcagcctcccaaagtgctaggattacaggcgtgagtcaccacgcccagcatactttcacatcttttaaataaaatttgctcttctttttttccttttgaaaatagggctagttgaagcatactctaagaagcatgaactgtgatgagtctgactttgagaaaatcactgtgcataattgcttaagcactgttctaagtttgaggttttgaattcaactaacgtttgaatttcttttgacctcttcttaacgaacctaataatacaactatggctagaacaaagctgctgactgcccatgtctgttaaacagtgacctcatggccagagcaggcaagccgggcagaggagggatgaagtaaattttattctccttttatgccgcagacagattgtgccccttatgattgggagaaaaacatctagaaagttcttagaatgaccaggttcttgtatttacaaatctgcagggagcagaagctagaaagtaattgttctgctaagcatcagtagccactaccttaagaaagaagcagattacaaaacattagctcattgggagggcttctgacacaacaaagccttctttatgcttccttctgggcttcaagtctcagtggcaggctgagctgttttgagcagttgtgctgattgtacactgctcatttcaagaaaatactaggttggtgcaaaagtaatttcagtttttgccattgctttttttttttttttttttttttctttttccaagacagagtctcattctgttgcccaggctggagtgcagtggtgcaatcttggctcactgcaagctccgcctcccaggttcaagcaattctcctgcctcagcctcctgaggagctgggactacaggtgcctgccaccatgcccagctaattttttgtatttttattagagagagggttttaccttgttagccaggatggtctcaatctcctgacgttgtgatccacccacctcggcctcccaaagtgctgggattcataggcatgagccaccgtgcccggccctgccattacttttaatgcattcatgtggtaatctgtgagccccttccaaagaaatcactgccagaggcagaagttgctaggactgtatctgatagtgaacagatccagaggggaaggaaagaggagggtcatctcagattgaagtaaatggcagaatacaaagaaatcataaaacagaatcaggatttcaagatagtccatcttttactttgcagtgatgtcttacttcctgttattgaatgaaatacattttcatgactagtcattgactatgtttagtgttattttcatattacattgattagaacttgctcttccaataatgttaatggatagtggtatatctttgttattcagaaccttgagatctgaacttctgaatattaagagagttttaaatattagaagagctttctctgctatgaagctttaaaaaaataagcaagattaaaatacgttaaaacacaattttctttataatttaatagcttattacttttagtaaaagaaaacaaaatttatcctggcttgacctttggaatatcataaaatttctgtaaacttcagtttcctcagcaaaataatacatgggaagattagatgtccacgcttacagtttgttaaattacatgtttgtcatcattctgaaaaatatctagatgggcaccacctgcaggtaacagcgtcatctagtggtgattaccttatattacagccacaggtttcaaagacaaattgtctttccaagagttttgcagcccatgataagaatgttttctgctcaggccagatgcagtggctcacacctgtaatcccagcactttgggaggtcaaagcgggtggatcacctgaggtcaggagtttgagaccagcctggccaacgtggtgaaactctgtttctactaaaaaaatacaaaaaaaaaaaaaaaattagctgggcgtgatggcacacgccttctgaggcaggagaatcacttgaacccaggaagcagaggctgctgtgagctgagatcacgccattgaactctagcttgggggacaagagtgaaactccgtctttaaaaaaaaaagaatgttttctgtttaaaatcatagaatatgcaagctagaaaggaccttcgagatcatctagtcttattgcctcattttgccagttaaagttagttgaattccagagttaacatattaaatattttcccctcctgtattttttgtttctcttgactttttaaaaattgcagtgaacttcacagaacatgaaattaagcactctaaagtgaacaatttagtggcatttactacgttgacgatgtaatgcaacctcccctttattcttaagcacatgcttagttcctgtttttaaacaattcttacttggttaatgaagaaaaaaagttctttgtatgtataacttaaaaaaaaaatttcagcttgtcagattgttgcttcagagtggtatttaaagagcaggaaaggggaaatgaagtggtttacctgtccttgcagctgaaaaaatatgaagtagatcagtttggaaatttaacatgctgaacactcttttcatttgcctctttgtttattgtgttgttcagtcttgtctcttatcaattttagaagcctcattcctgatttcctatgaaattgcttggatgtaagacttaatatatttcctatgccccagatacattggcaatcattattttaaggttattgtgtgtggcataatttaatactattacagtagtataaatgtttggatccaggttttaaaatgcaaaggaaccactatttttttggcatttctacccaacaaatctcttttttcattttgtcttgctaaataaacagcagtctgttgggaaactctgggagtaactaaaatgaggagggtaacattaggtgaaggttgggagtggggagaacgtggttggtctatggcccgtgagtctccttagagtattaacatttacaggagtcccacagaatataaaccttgccaagactttagacttcattacttccctgtcctcgacaagtacaatttaattgaacattaagcaatttgatctctttcacctaataaatcgagcaaattcaataaacataaatcctgctaatgatggagctgcccctggtggagctgagctcatcagcattcatggttattactctccctggaattttagtcacaaatgcttattgctgaactaagtgcttacctgatgcttaaggtctagggagtgtatttaataatttttttcccagggtttcaaaaggacagctggggagtagaaagaacatggtttggcagatagaccactttgggttcaaatccctcacctgaccttgggcaaggcaagttatgctattaaaaagtgtagttttcttattggaaacaaaaggagctaattacaattatttcatagagttctgagttttaaatgaaacagtgtatgcaaaagtagtgtctggtgcgtaggaacttaatagtgcgtgttagctaactctcttgtttttaattgttcagtagcctgcatctacagcagttagcgccctactgcttcttttttttttttttttttttttttttttttttttttttgagacagagtctcgctctgttgcccaggctggagtgcagtggtgcgatctcggttcactgcaacctccacctcccgagttcaagcaattctcctgtctcagcctcccaggtagctgggactacaggtgcacgccaccacgcctggctaatttttgtatttttggtagagacggggtttcaccatattgttcaggctgctctcgaactcctgactgtaggtgatccacccgcctcgggctcccaaagtgctgggattataggcgtgagccacggtgcccagtctagcttccctaatgctttcttatctattatacatgcttatgactctctctgagttaccttccttcctcttctacctggttaacctcctggctacagatggtgttttcaagctgaagcctttcccagctcttccaggatgactttagtcatcgtctctgtgatcctgataagttattgcatgtgccctgattgactatcatcacatctttccgtactctcaggtcccaccctgtccgtaatgaagcaatgaatgaatcacttttaatagagctaaggcaaagagtaccttaattccgtgcaataaatggagaaactaaggctaaaagaaccgtgtccagaccaagaaactaggaagtggagaaacaaggactagaacccaagtctttggattccaggtgtttgcagtgtatccagttttgcatcacaacaccacatattttagttttagggaaggagggttgctgcctgttcaccagagactgtaagcagtaatgtattccgggataaagagcaggacagacacccaggcagacatccagtctcacagtattgtggcaatacccaaggaggtctctcttccacctttctttactggtacagagtggaatgttctgtaaatggccaccgtttttctaatttcataacttttactaatttcatttaaagaaaagtgcccattggctgggcgcagtggctcacgcctgtaatcccagcactttgggaggccgaggcaggcagatcacgaggtcaggagctcaagaccagcctggccaacatactgaaaccccgtctctactaaaaatataaaattagccgggcatggtggcgcacatctgtagtcccagctactcgggaggctgaggcaggagaatcactcgaatctgggaggtggagattgcagtgaaccgagattgcgccactgcactccatcctgggtgacagagcgagactccgtctcaggggaataaaaaagtgtctattacaatgctggcttatcagtcactggaggagacagtcatttcattctctttatctcctccctctgtttcctagttgtgtgttttaaacaccattgtcgttaatccatgtttaaacctgtaagaaaaatacctggtctagaaattgtagtagcatgtgacccacttttctgcttctttttctcttttttttcttttctttctttttttagatagggtctcactctgctcaggctggagtgcagtggcacaatcacagctcactgcagcctggacttatctgggctcagatgatcctctagcctcagtgtgccgctatgcccagctaatttttgaatatttttttgtggagacagagtttcaccatgttgcccaggctggtctcaaactcctgggctcaagtgatctgcccacctcagcctcccaaagtgctgggattacaggcgtgagccactgcgcccagccctgacctgtttttcttaatgcatgaaaattggtccttgtttctcttatatttgaaaataacacagttcaaacttcagagcgttgcatttttagccctgatgtgtgcaaaacgaaattgcaacctctctaccatttctaaaaacagctgaatttaatttgcctcagtcagaactaaaactttacctcctggtctcctcacatgccagggtagcattgtgacatgtgactgtccagactgccctgcacatgtgtctgtcatcaagaatggagatttcttatagtaaggatatggtaatgttccttccattgctgccaacagcaggggccccacacccacaggctccaggggataatttttaaaccttttcttttttcaatttaagatgaaaagcaacagcatttgtcatatgaatcagccatgccagggaaattaatgtgatcaatggcctggatcttgtttagactacttagcgacggcgtcccatagcatcccttatgtatctttcatagctttgatcaagagctaagcatttgcgcttggggcatggggaatgcagtgggtcggggagggtctttgaggtgtgactgtttccatttcctgttcatttcacattggtatttggctagattccagatggacacattgtatggggtctcaaatgggattgcctccaaagtgcacctctcagggcaagccctgctaagcaaaaacttttcctttgcaccgagccccagacaaggaggtgactattgttcttgatgcacagaagtcaagggtgttttggagaaagagaaagattctaaggacagaaaatgtgttcatctccacatgttgagctggataaagtagcagccaagagtttcttgtgggaagttatggaaatagtttagggatctgctattcttgggctctgtactctcagccaaccacagttcatgcagttccccaagctggactgtagcagtgacctagtcatcgagataaccaaggccaagcacctccaagctgtaatgggttctgcttgtggcttggggtgcccagaggcccagcacatgctagaaatttgcctgtaccgagatcctaaagaggatgacttgcccaagtcctgatatttccattgctttcctgaaagatggtgaaatccacttctataaacctattctcttctgttaacttattctctatgtaagacatttctgatttaggcctatattaaaaattcttggacatcagtttttcccctgtactttgagttctgatgatctaatgttaaaatgtactattgttcatactttatcactgcacaaccaagtaatgaaatttaccaaggcagtcaacagttttgtgccttgtttgagaggaagtctaggaagacttctctatttactgagctagtttccctctacctatttaaaaactccaaatagtcttgaaacaagatttaaaaacacctgtggaccgttcttccattgctctttactgcacaattatttgcctgttgatcactgcttttacgttttgttaacattaaaatgtaaatcactcactcattataatactgtctttaaaaaaaacttcatttatttccaaatgttcactagggacttagtgatgtcacccacaggaaaaaattggattctccattttcttgatgcttcaaatttttaaaatagtttcacaacattatctcatttttttacatatcagtaacacagatgtagtcaaacaagaattcttgttcctgtgttacagatgtggaaactgaggcttgcccaaaactgctaagctgggaagtaagtggtgcagtcaggacttgagcctcagcttccacctctgaagcccatgttcttcccattaccccacgatcctggccaagaatcagggcagatgtgcatgatgggaagggcggcgtggatggattaggacagacctgtgcaggctcccagaaaaataattcaaaatacatttcctggtgatgacgggactttagcacatcttcagatacagaagagaagacatggtgcagaaaggatgttttgatcactgaccaaaactgtcttggagcttggaatgtgaatgtgttagagaaaagtgaagcagcaaagggcaacacgctctagcattttaagaggaaaaaacgcatggcaggggaagaaaggaaaggaaggaggatgtggaatatcccagaagtacctcccccaacccattaccctccactgcccgcttccctagccttggtctagtcagaagacttctttaggaaccatttggtagttccaaaaaacaacttagttttctttcttgatgcctttgggtacgtgcttttaaaaactaatccaaaattctgcaacataattcctacatacctacttagtttcagttcaggtccaccttttgcagggagctgttcctaaacattgcataggaacaggagcctgcccttcctcttcaccctcaccttcagtcctttcctctggcgttgctgtagagtgacagcttagagactcaagcccatctcatttctttggtggaggaagcatgtctaggggagtgcactggattgaaggtggctgccctggccagcccctgatcatggcattcgacatccccggacctcaagtctcagcaaggcttctctgacagccaacaggcatcagcaggatgctcagccatctctggatttcactttataaaataagtaccttggccaagcacggcagctcgcacctgtaatcccagcacttagggaggccaaggtgataggatcgcttgagcctagaagttgagaccagcttgggcaacattgtgagaccctgtctctacaaaaaataacaaaaattagccaggtttggtagctcatgcctgtagttccaactactcaggaggctgaggtgaaaggatcgcttgagcccaggagtttgaggctgcagtgaaccacgataccacaatggtgccactgcattccagcatgggtggcagagcaagacccttttttttttttttttttttttgagacggagtctcgctctatcacccaggctggagtgcagtggtgcaatttcggctcactgcaacctctgcctcctaggttcaagcgattctcctgcctcagcctcctgagtagctgggactataggtacgtgccaccatgcccagctaattttgtatttttagtagagacagggtttcaccatgttggccaggatagtctccatctcttgatctcgtgatccacccaccttgacctgcgtcatgagccaccatgcccggccgacagtttctttaaaaataagtaccagaattaattcatttttaacatctcctctagatcacaactgtggcttcaatataaaatatggaacaagtctgtctttcagatgtacaacaaatgtatataaaaaataatgggagaagatgacctcagctcttgaaacttgtaaacatttcagcaatcttgctctcgcaaagaaatccttaattctgcgttttcaaactttaagcagaactgacagccatttgtgctctctctgtttgaagtagttcttttcttttgagtcaagaatctttttccaggttcggctatttccttaatgaaattaatatttcacacagaatggtttcatgcaaaagtgctgggacgcctggagtctggatgttgttcctggaatgcttccacataaggagaattttagacaggggcagccagaatcctaccctatccagtggttcaaggtcttttctggcctcacgcttgctttgggcagttctcagaatgtgtgtgtgcacgtgtgcacatgcatacacacacacctttgattcgtcaccctcattcctccagtcatttaagtaggagctgataaaagaaagccttcagggttcacagtattgccttggtggggttttttttttttgtatgttgcaagaataaacacaataggggaaaattccaggcaaacgtggccattgccttgcgcgacaatagaggaaaattccaggcaagtgtggccattgccttgcatgacaatagaggaaaattctaggcaagtgtggccattgccttgtgtgactgccccactcatgtccatctggtcctggggcctgtagcctgcctgcacctcacagtcctaacagagctgttgacatccgtggagccccagaatttcaccaactgctagatgtatctttgggaagtgtattttgtggaacatactcagaacatgaggctgtcctttctacagctttcctccctagaccttctcaataactctgttcttaaatgtagacaagagcctgggatcatgaaaagcattgaaacctcagtaaccccgggacaaatggagaaccaaaatcctgtgcactggtgggtccttgggggaggagtaaaggggagtctaggagtcagggggccgtggggctgacccagtgtggaacagcaatatggcctcaggaggtgaaaaccacagatgggtctagctggggtacagagatggtaaggacaggaattccaaaggagctgagatcattgcaggggagacaaatgtgaaaactgtacactctggagcttcgtttctgacttcaaatcaggttctgccacatggcagctgtcatgtaacctctctgtgcttttgtttcctcactggtaaaatggagatggtagaacataggatggtgtgcgtcttttagtgcatcgatgtgtattaagtgcttagaacagtatctggcatagagcaagcattatatgactggtagctgttgttattaccactaccacggctgttcttattatcgtgattattatgactctcagcatagctataatgctatccatagagactgtagagttataatcgtgactactaaatttaagcagcatccttgcctggtgctgtatcatttttggacaccagagatatatttattcctgtctctagagagcgaaaaagcacctctctgtcagaatgactactttctactttaaaaatgtttttgatgataactcttgatggctttagataaagccatccttccaaaaggcctgaagcactctcagatggctccgttttgtcagccctttactgctctgggatgtggtctacccactgttaagctaatatttttgatcttcaatttggaaccttaattatgctgtacagcagtcgttgtacgtggatgcataaaattcccatcaaaagatattcagacactttccaggctcagtggtacgcaggagatggagacacacgtggaagggtgtgctggcagattcccgttgctctgagctgcgagggggtggggcaggtgcgagctaacagtggtggggcctcatgctgcttgtctactccttagatgactatgctcagctgtgtaacatccccgtgacgggacgccggcagccatatggacgggacgccttggttgacttcagtgaacagtatactccagaagccgatccctacttcatccaagaccgtaagcaaaataaccttgttcctttgatactaagttgtggttgaagattaatcagtggtcctcaaaatgtaatggcaacttgttagcaatgcagcatttctggtcccaccccagacctgctggtcagaaagtctagggtgggacccagccatctttgtttcacaagggcagtccttctgcgtgggtgagtctaagaaccactgcatcattcgtgagccgagatcacaccactgcactccagcctgggcaacacaatgagaccctatctcaaaacaaacaaaaagaaccattgcatttgatgaatagtcttgctggtggggatactgttatatttacttttcttaaagttttgagatggagtctcgctgtgtcacccaggctggagtgcagtggcacgatctcagctcactgcaacctccacctcccggattcaagcgattctgctgcctcagcctcccaagtagctgggattgcaggcacgcaccaccatgcccggctaaattttgtattgttagtagagactgggtttcaccatgttggtcaggctcttcttgaactcctgaccttgtaatccatccatcttggcctcccaaagtgctgggattacaggcatgagtcaccgtgccctgcctatcattataatttctataacaaaatcatttctcttctctttaagtggtggactagtttgagggccaaggtttccatgagagcccagttgtattgcagcctttttttcctacagggaaatgcaaatgttaactgtacaagttgatcattattataagtgttttagagtaggaggtaagagaagaattgcccttttggtcagaaatgactttttaaaatacattggtgaggggatttatggagtaagaaataatgtgtgccaacttttcctggattagtgagcacagctttcatgggggaggtgggagtgtgtatctgcaaattgtgatcccctttagaacgtaaatgttgtgtgaggaagcctacaaacacacaagctcaaatcagacttttcaaatacagacaatttgaagtctgaaacagcaggaggtccacaatgaaatattagtagatagtagatagtctcacttcaagaacgagaacaggaaaacgcccattttgagagcctcgtccacagctcacagaggggccatcctcacgtgtagcttcaccacaaatttttttttttttgagatagggtctcgctctgttgcccaggctggagtgcagtgccatgatcacagctcactgcaactctgcctcctgggctcaagcgatcctcccaccccagtctcccgagaagctgggactacaggcacgtgccactatgtgcagctaatttttgtattttttccgtagagatggggggtttcaccatgttgtccaggctggtctcgaactcctggactcaagtgattcatccgcctcggcctcccaaagtgcttataggtgtgagccaccatgcctggcctgcaccacatttttaagataggtaattgctgccgaccgaggagtttgacttaggactttagagaaaaatgcagtgaagcttttttctgtcctgggccctgtcacctgtgcacgaagcgtcctagccaggacccagttctggggcaacagcatgagatttctagctgaatttaggatctatttcagttctgcatcaagagcttttattttttttttccttctcttctctttctcttttccctttctctcccttcttcattccctccttgtccttccttcccctccacctttttttttttgaaggatgtagtgtattgatcatctggtagaattaaaaatgttttaaaatgtccatgataagaacattctattaatccagctaggctgcttaacacacgcctgtgtaactcccacccaggccaggagcagtgccagcctccagaaggcccctggtgccttttcccacccccctccctagggtaaccactatcctgactcctaacaccatagatgaacaacactctttcttttcatccacagcacataaccatgcagctctttatgaaatggaccagaatgcactcacagctacaagactgtgcacttagggtttgatgcttctctgtatatgttacgggtcagtaaacgtttacttaagaaaaaaggaagggagaagaattattaaggttgaaagaaagcccagcttgccccattaatcaggaataccaggttaagtctatatgcaactctgacaatcccgtggcttacagctttcctccctagacctcctcaataactctgttcttagatgtaagcaagagcctgggattatgaaaagcactgaaacctcagtaaccccaggacaaatggagaaccaaaatcccaggcactgatgggtcctgagagtctaaaagtcagaagcctctatggcattatagtttggattccaggaattttcatgttgaaatgtctggcttatgtaccttctttttaatgctggcattgctttaaagctcttttttttaattaactacacatgttaagaaataaacatgttggtgtcacatcaatctcttatttagcaacataggaaattgagatgcagttccaagacctccagcttggacgatgtaatggcctttacatttcttacaagttgcagagaaatatttcccccttcccagccagttttctgacctccagcaagggcttttggagcctgctgcaaaaatgattgtgttgggtagatagtaacatagacggaggctgagtgaggtttcttatcgcctttatggttcaccatctctgttacctttagggagagcagtacttctaaaactggaatttgcttgagcagagaataggcaaacatttgccctttataagggccaggtagtattttttttttttcttttttgagacagagtcttcctctcttgcataggctggagtgcaacggtgcaatcttggctcactgcaacctccacttcctgggttcaagtgattgtcctgcctcagcctcctgagtagccctgggattataggcatgcaccaccatgcccgactaatttttgcatttttagtagagatggagtttcaccacgttggccagggtggtcttgaactcctaaccttgtgatccacctgccttggccttccaaagtgctgggattaaaggtgtgagacaccgcaccgagcccagatggtaaaatttgtaggctttgcaggtcatgtggtttctgttgtaggtattcaactctactgtagtttcacaaaagcagccctagatagcacagcagcaaatgggcgtggctgggtttatttacaaaaataggtagcaggccagatttggaccagagactgtagtgtcctgacctgttttagagtcctgcagaagtattttggggagcctgcctgatgtgtggggagtttcaagttttactttttatgttttaatttctgtaataataaaaaaggtattagatatgaagtagaaatcattttgctgtgatacatgggatctgaaaatattgtcgtagattaagtctttattttgtgtgtttcttaactggctttgagtatgtggtgtcacttttttttttttttaaattggggtctcactatattgcccaggctggtcttcaccccatgagctgaggagattctcctgcctcagcctcctgagtagctgggactcttgttctcctttaaagttttaaaatgggcctgccatggatgtattactcaattttttttttatggtacaaatttttttaacttttaggttcaggggtacatataaaggtttgttacataggcaacatgtcatgggggttagtggtacagattattacatcacctaggtgtgaagcccagtacccaatagttattaccttttctgcttccctcctcccaccctccactagtgtctgttgtttccttcttcttctttttttttttttttttttttttttgtggtatttggttatatgagtaagttctttttttaaattttttaaattatactttaagttttagggtacatgtgcacaacgtgcagttttgttacatatgtatacatgtgtcatgtcggtgtgctgcacccattaactcatcatttacattaggtatatctcctaaagctatccctcccccctcccccaaccccgcgaaaggccctggtgtgtgatgttccccatcctgtgtccaagtgttctcattgttcaattcccacctatgagtgagaacatgcggtgtttggttttctgtccttgcaatagtttgctgagaatgatggttttcagcttcatccatgtccctacaaaggacatgaactcatcattttttatggctgcatagcattccatggtgtatatgtgccacattttcttaatccagtctattattgatggacatttgggttggttccaagtctttgctattgtgaatagtgccacagtaagcatacatgtgcatgtgtctttatagcagcatgatttataaacctttgggtatatacccagtaatgggatgactgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattgtaattggtgtgagatggtatctcattgtggttttgatttgcattcctctgatggccagtgatgatgagcattttttcatgtgtcttttggctgcataaatgtcttcttttgagaagtgtctgttcatatccttctcccactttttgatggggttgtttgattttttttcttgtaaatttgtctaagttctttgtagattctggatattagcccttttgtcagatgggtagattgtaaaaattttctcccattctgtaggttgcctgttcactctgatggtagtttcttttgctatgcagaagctttttagtctaattagatcccatttgtcaattttggtttttgttgccattgctcttggtgttttagacatgaagtccttgcccctgcctatgtcctgaatggtattgcctaggttttattctagggtttttatggttttaggtctaacatgtaagtctttaatccatcttgaattaatttttgtataattttgtaaggaagggatccagtttcagctttctacatatggctagccagttttcccagcaccatagcaccatttattaaataggaaatcctttccccatttcttgtttttgtcagatttgtcaaagatcagatggttgtagatgtgtggtattatttctgagggctctgttccgttccattggtctgtatctgtgttttggtacgagcatcatgctgttttggttactgtagccttgtagtatagtttgaagtcaggtagcatgatgcctccagctttgttcttttggcttaggattgtcttggcaatgcaggctcttttttggttccatatgaactttaaagtagttttttccaattccgtgaagaaagtcattgctgtttccttctttgtattcataagttcttatcatttagctgccacttacaagtgagaacatgtggtatttggtattctgttcctgcgttagtttgctaaggatgataggcctccagctccatccatgttcctgcaaaagacattatctcattcttttttatggctgcctagtattccatggtgtatatgtaccatattttcttttttatcccccaaacttatgccaaatctcatttaatctttacaaggtagaaaagtgttcattcattacaaaatacttctactgagtgcagacattgtgttcaatgttgggtatgccattctacatagcatcgtttctctatttttaaatgaggaacctggtttcaacaaaatcaagtgacttggccagggtcacaggcatgagcagaagaccgagttcctctgattcaaatcccatggttcatttccacaaaataaacctataactgagtggggctttagagatcctaaaattcagtgcttttacttcatacgtgagaaaaataagctttctgcccaagtttacaaggtacacatagggaaatgggaatgggaactcaagtcccccaataccagtgtattgttcttacccaaacagataatttaagattcacttattgtatatttttcggtcatctctaaaacccactttcttctctgaagggcatgctctaaagtttcttcttcacctatctcccctcagggcacctaatcttagaatgtaagagaaactctgaccaaatttgtcttcatgttgacctcaggcactttagtcattgttgaaacttcttttttgttgtagttaagagaagtaacaagtaagtctttatttccttgtttagaaaaaaaaaaaaaaagctggctaagttggttgctttttggtgatcaaggagaccaaactccatatccttgtccaattcctccaagttagaccttattgccctccataagcaatgatattttgctgcctgctgccccctgcagttccactggagaattacttcaaaggccagatagaaagttctagccatatattttttttttttttgaagctactttgtggtactattgggaagagacaggagatgagaggccacatgacagtgtgttgggtcactgtggatttatgtttagaactttcctctgcaaaatgagagctaaacactcttgatgcctggctaaattgtttttacatcacaaaaactctaaagtctagctctgacttggtttcaagagatctaaactataaaaagagccaaacaagagtttctttgtttccttaaaaaaaaacttttggttctgtttttttttggtgtgtgtgtgtgttttgttttgttttgttttttggttttttgtcttttgtttttttgacagagtcctgctctgttgctcaggctggacagtggccgtgatctcagcacactgcatcctccacctctcaggctcaagcgattcttctgcctcagcctcccaagtagctgggattacaggtgtccaccaccacgcccggctaattttctgtatttttagtagagacagggtttcaccatgttggccacgctggtcttgaactcctggcctcaggcgatctgcccgcctcagcctcccaaagtgctgggattataggcatgagcccagactttgggttttctaaacacaagtatgatgttctttctcattcatcaggatgttttgaggcccttttactgaatttttcctttgatcccctgggagcccttttgtaaggctcattccgtagccagagcaaacaaacacatggcagagccagcctgcttctctctggtcttacaaacgccggctgaaaacgtattgcctcacactcttacggaccttcttagcaaatgcttactagactccgatagtgaattctgttggttctgttctgagagtctgacacttgccctactgcaaactcacgaagtttggaactttggatgaacacttttaataattaagagcaaaaacaaaaaccatacttgctttctcgttttatgtgattttaacatagaatatcagaattcaaaatgaggctactctgcacaaaatatacaagttttttatttttatgctattttacacagcaacattcagtatttctaatgctaactttaagatgtctgaaatatgtatggacatatatgtgtctatttggaaaatgaaccatcatctaaatatcatttacaaaatgatataggaagttgagaagctctaacttagcttctgccctttcctttccaggttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcggtaagaatgacgtgtgttttatgggacattaattttttcctgacaccccgtatctcagtcagtagagaacatttaagatagatttgctgagtttcagtttgagaagatgagaaaagttctggagatgtacattaagtacagtatgaatatacttaatgccactggactatatacttaaaaatggttaaaatggtaaatatgttctgtgtattttaccacaattcttttttttttttttttttgagatggagttttactcttgtcgcccaggctggagtgcagtggggtgatcttgactcactgcaacttctgcctcccaggttcaagcaatgctcctgcctcagcctcctgagtagctgggactacaggcacccgccaccacacccggctaatttttttttttttttttttttgtatttttagtagagacgggatttcaccgtgttagccaggatggtttcaatctcctgacctcgtgatccgcccaccttggcctcccaaagtgctgggattacaggcgtgagccaccacgcctggcctcttctccatcttgaagcagtccttttgcccactttgcttttgttagttttaatccatggtgtgtctgtaaaataggtaacctagcttcttaacagatgtttcaagtgagtgagagcctaaatgggtctcatgtagaaggaggtctgtgaatgttatggaaggctttagacaggctgtatggagaggcctctgcgtaggtatctggttcctcttgacaaatctagcagttcctccatacctatgggaaggaatttggaagtaatatagttcctccaacttccttgaggttctactagaaaatgtcaagctcacaaaatgctcatgttttgctagataacagtgaaagaagttctagaacctccctgataatctgcctctttaagatctcaaaaaagtcatcttcgtcttgtctgtgactgaagcaatgacgagaaagcttccttggggtggtcgggggaagggcctcaggtaagcctcaggttatgtgtcctcacagaataatatccaagattgtttacctgcatggcttgacttattgcagatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaa

SEQ ID NO: 931 - DNA, 264912 bp, Homo sapiens
gagacaccactgaatacagagcagcgagcactgaaggcttccctctttccttaaacctgtcgggttgtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtgggtgagttcctccacggtccctaactgtccttactgagtcgagttttatgagattgtagcatttagacaccccctccattcacactgctgtctgcttcaatgggtgtctgtctatgagtacgagtatgtttctttcatgggatcttttaaattgcttttggaataatttttaacctgattcttggtttcttaggggaatggcaactagaatattttcccttattgcttagcatttacacagccatgtggtaatgggaatatatatagtagaagagaagagagtaggttttagatttagaccctaaggcatgacttgtgctgataagcttcaaattttatcagcccagtgataagtggaatttgtcttagatttgactcatgtaataaattttggaaggtggtgatgaaatttgaagtttttacttcaaaaatagccaagctctaaaacaaaactccgaggattgtcaaaaacctgtacttggttgtagaaaaggatacagagttgcatcttttgccacgtttctgctccgtctcacaagactgaatataaattgatatataacgtggatttggggaagacagactggtagattactctcagtactccttttttacgtggatttggggaagacagactggtagattactctcagtactcctttaagttaatttaaatatgaagtagtagttgctgtctgcaagaaagccttgttggttcattttgaatttttgttttttacttttttgcaaatggagaaaggattgtggtccacggaatgctgtcatgttgccatgttgtcatgcaatacagtatttttgtcgcagaaaaatgtcttttattattttttgaccaattatggtttgccatgtgtactcaaataatcgcagacacccacgttactttctgagttactcacaagaataacccaaatgtcagacagataataacactggctagatctggtctttttatggaatattgctgtttagtcttggaagtgtgtgtctgggggggtggtaggagaaggggtgtctgtgtcaaactgatttacatcaagacaaaataaagggacagcttgaagttcttattagatctttgattattctgctgttttattgtgactcccaatccttaggaggtcaaagcatatttttgatcgtctgtacttggaaaaaatatgtgcccatagatacgatttaaaagggcattgtgagtttcctggctatgataggggtactctgggcatagtttttaaaagaatttagccattaggtgccaaatggcacattatgctttgcagggcagggagccaagtctaatgggaagtgaactgatgatcaggaaactggattctggtcccggtcctgccactaactagctaatccgtagggcatgccagttaatatttctgggcctcagtttttctcattcataaaataaatgggattgtatttaatgacctctaaaatttagtccatctctaagatcatatgactttttatcagcaataagtaatactattttctggcttaaaaaaatttttttttttggagggccacagacaaggaggggaaaagaaaaggcaattccagtagactatcatgagtctgatggcttttcaccactttatctttcttggttgccttccttactcactgctcctttccctccttgtgtttattgtaaatctttacagtagcaatgacaaaataatcaaatgggtggtaattttttggcttccagtgtattcattttgaaactaaatattttgaaggctttgagaaacagaggaagtctacttgttgaaacacaccacacactttccttgctggcactgaaccagatgtttaggaacagaatatacatagcctactcaaaatgcaaaatgaagcaaaattatttacaaaagcatttcaaaagcagaactccactctccatataggatcggcagagcagtttaattttttgaaaagtagaggatggggtgagaaggacccatagtaataaatagtttcacattggaaattgtgggaaacatttcatttatattctgagctatttccctctcctgtttaacgttttatttcaaatattggatagtttgagggacaatttttatgatatttctttctttaagaatggtaattttatagaacttatagactgtgatcctttgaaaatacagaaaaattcaaaaacgtttatgcatatatctttttgggactttactggtttagtgtaattttattatttgcaaaaagtgattttctgatttttttcttctctctttgtacttgtttatagaatactaaatcttttgacaaaaaagacctatttggaaaatagtttaaaatttgggaaaaattcaaaatttactgtcacttgtcagctactccctttgatctctaatatttgttggtacttaaaggtgagggctggcaaactctttttgtaaagggccagatagtataaaatatgttttagactttgtgggccatacagtttctgttacagctactcaaccctgccatcatcgtgtgaaagcagccagagacaatatgaacaagaataggtgtggctgtgttacaaaaacatttgttgggctgaatttggcttgagtgccattctctaaggagtcaacataatccagggaaaattatatggacttcataattagttttgataatcagaataacagaaataatttccaacatttgcatggtgatttacagtttttgtttgtttgtttgtttgtttgtttgtttgaggatgtggaacagacatgatcatcaccattttttcaatacggaaacttaggttcagagtgttaattaagtgagcttgctttagtttcttggcaagtcagttagctatgcctagaacctagatatccttatgccatctgttttcttacctacctggagtctgcccatgatgtataagagggacaaggtgaaggacctcatggagttgtgtcttgtgggaaggctggctgggataacagagagagagaaagcaactgagagtccagcataccggggctgaatcctggggtaacattggctctatgtgctctttgggcccagctcacctcctccacacagtgcaggtcctaatagatatgtggaggttgttcttttacaggcttgtgggataattccttccttccttcatgctgcttctgtgttggtcttctggtctgtgatgagggtgagtctgggctttccaggtgtgaaaggcagcaggtattttcgcatgactattgagcatgcagtctctgttcttgagtattcagtgggagaaataataagtataacttctgcttaatgcaactctaaaagtgaggcccaaatgaatatggtatccaaaggaagcactctgagattctagaagagcccatttttatggatagtgattttgatatggtttaacagaatagttactttaaatggtacttcctatgaagcaggtttctaatgataatgactttttttttttttgagctcagccttgctgtttgccccacccctgcctttttaaaaatggaaacctatcccttgttgggtgggctgcaggttcaccgttgttgttttaaaggattcttaacattttatagggctaaaatgcagatgaccttctgggatttttaaattgtttataaagccttaagttcctctgacaagaagaacatataaattcgtgtcacaactagaatatttcaaacacagtaatactgtcacttggtataacttatttgtggagacattgaaaagcagtcatgatggtcaaaataacacatttggtttatgtgaatctaaagactcatgttctattagcaccaattgaataattataaaaaacattggaccatttaaaaagtatgttctcttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctccatctcctgacctcgtgatccgcccgcctcggcctcccaaagtgctgggattacaggcgtgagccaccgcgcccggctaaaaagtatgttctcatacattatttcatttgatgcttactgcctcttcggcatatggtactatccataattggcaaatatgagccctgttgctttactggcttcattaaaggtggtttcagccaggttttcttatcctagagtcacaatacctctggctctcccatgttgcctcctatgaccatatattaagtgactatgtataaaacatggtagtagattttctaagataagcaaatcataaagctgccttctaacagcttatactttgaggaagagatgaagggtatatgtaaataaccctaaattaaggtagagagctgctagcaggcgcccagagaagggaaataccacttctagctgagggaggatgcttagagagaaaagagatggcatgcagcttttatgtttagttcaccttgctgtccctgcctagaaagcgtgttgtatcatggtgaggggctgagtagataaatgcagatggcctgattgtggactgaagggagacgtggaacttgaaacattggtaagttccaaagtaaagatgcatgggggagtagagggaagagagaagcaaagttgacatgggaaagaagaatttacccccctagaattgggcatggagatgtgaaagcagaggtggtttctgggaattgggaatagtttcacttaaatgtgggacacatgaaaggtaataatggtagatgacaggttgggaaggcagattggtgcaaggctgtggaacaccttgaatttcaagcttaggcatttggattttactctttgagaatttactaaagttctctgaaagaagttgatacttgtcattttgaagaagagagaagtgctttcagttttttagctaggaaactcatgttttaagaggctaaataagtttctgaatgaatgacaacctctggcatcctgtagctgttctggggcttgtctgatgctctgcactgaaaatcgccttggagatttcacaaaaccgacctaatactgtggtgctgggatgaagagcagaagcagttcgtgctgctaagctgactgtgtaggttctcctcacaaggagggaagaaaattttctctcgttaaggcattaaataatctgacataactgcttaagaggggcaagcatatggagttttttctggaaacttagttcagtcactgagtttctcatcctttgccattcgtcattgtttggactccttaatgtttgtctcacacagaaaccaatgaaaatgccatcgtgtctccctttcactggagaatgtattttcccattaatacattgtgcaggtatatctcaggttttaaaagatgtttcaatacaatagtaaaagaaagtggttgcttttcctccaggcaatttagaatgcctaagaacttatcaaagaaaccacttccacatacatttagctatatcaaagaattttattttctaatactgaataaatgtcataatgtagagcattttccttttatttatttattttattaattaattaatttttttttttttttgagatagagttttgctcttgttgcccaggctggagtgcagtgccgccatctcagctcactgcaacctccgccttccgggttcaagtgattctcctgcctcggcctctcgagtagctgggattacaggcacctgccaccatgcccggctaattttttgtattttcagtagagacggggtttcactatgttggccaggctggtcttgaactcctgaccccaagtgatccacccacctcagcctcccaaagggattacaggcgtaagccaccacgcccggtcttttcctttttattttatttaagctgtagaccacctttaaaaggctagtattaggaacagttattcatttaacgtgcatttattgagcacatactatgtgccaggtatgggggttcaggcaatagcagtgcactaaataaaagtccttgccctcctccggcattacaaaaacagtgtggctacaacgtggatgaacctcaaagatgctaagtcaaataaaccagtcacaaaaaaccaaatacagtatgagtccatttatatgagatgcctaaagtagtcaagttcaaagagaaagtagaatggtggttgccaggggtcacccgggtggaatggggagttgtttaatgggtatagagtttcaattttgcaaaatgaaaaagttctggagatttgatacagaataatgtgaacgtacttagcactcctgaaccacagcacttaagaatagtaaagatggtacatattacatgtattttaccacaattataaaaacacattttaaaaatatagtatatgtgtacactactgtcaaatagatattaccaaaaatatactgtaagaaacgtatatgaactaatgtcaggaagtgatagacactctgagggaaaacaaagctgagaagggggatggagaatggggagtgttggtggaaggcgtggttgctattttagagagctcagggaatgcagggctgtctgatgagataacattggagcagggacctgatgaagtggtgatgagtgttgtgaggaaacatcgcttacattgtcatcagactctgaccctgctttttattttgtctaaaccgtggagcaccccccaaaaaggctgacatttggagcattcttccagacttttcctatctcccatcttgagtttgggttcatcgacctgctttgtatcagggaatcaaattaatatctgcagataaagagccttatacacagaggaaagaggcaaccaattcttgttctttgggtgaaaaaaaggatacagtcctggaattcttgcaggagtcttggtgatttataataaaaagtaaaggtcttagatttaaaaaaggttatcaagaaagtagtgtcacctttcttcagcattcttttttttagacggagtctaactctgtctcccaggctggagtgcagtggcgggatctcggctcactgcaagctccgcctcccgggttcacgccattctcatgcctcagcctcccgagcagctgggatcacaggcgcccaccaccacgcccggctaattttttttttgtattttcagtagagatggggtttcactgtgttagccaggatggtctcgatctcctgatctcgtgatccgcccgcctcggcctcccaaagtgcttggattacaggcgtgagccaccttgccgcacggccctttcttcagcattcttttatggagggcagatcacatgagtttggtatggagcttgcttttaattaagggaaataaaattggttcttgcttgtgagtggtgtagagggtgcgtggtggtggtgggcagagggcaggaggaccctgggtagacgaaggggtgcgtggaaaggtgattccatgggttacttggaacaagaagggcaataggttgaccttaagagccagaatcaggagggaataaggtccttttggttgaagaggaagacaactgaggcagagaagggcagtggggcggggggcagagtggttgtataagaacatatgtctgtagccaggacagttttttaaaaattaagcttaactaaaagaggggtccgtggtttgccagatctgtgagaaaggcacatgtgatagattgctccttttaagccattcctggcctgtatcttgggagtggatggggctccttgaaagggttgtgctaggccagcctggaataaataacctttcaaaattccttggggtctgtaacacaatgtcacaaagtgtgtattctttcctaggctgtcggcttgagcatacggagtgatctttggaaaagtctaaactgcttagcatagcatgcagggccctgctgcctggctccacggcattcactttggccctgccccttcttccaccccaatcctctacttctgccaaactgagcctccagggataccaaaggtccccaagtgctccggggtgtcttgtgctcctgtgtctctgtgcacactgctctctctgcctggagggtacatttccctacccattctgcttgggcaatcacccacttctttttcaagactcagccaagtgacgatcatgctacagagcctcatttcccttatttgttgacttgcctgtttcttccactacactctaaactgattgggaacaaagacttgtccactccatcttggcacctccagtgccagcacagtgcctcgctttggagatgctgaatgcatttttgttgacaataaattgtttatgcggctgcctgggctgtgaggtgtacacagaatttacctgatacagcttcatcattagttctcaggcaagtaaaatcacagaagtaaaataattaactgagaagactatgttagagtttaggggcataggaaataggatattccactgaccacaagatgcatgaaaaaggacaccctggtagcaatttacatggagctttaagtttttaacactgacttcactgtactttctactcatgggcaaagtgcaattagatttccatacctttagtacagctgttcctgctgcacagaattcctgctcccgctcttgcatccatgtaaatactgacagtcttttacggaagaaccttaagttccatttcaaacagttctgcctgtgctgttttttgttgttttttttttttttctttcctattatacctctagtcattactatgtcatttgacacttggttgtctagcttcaggtatattgactggctccaggacccggggttggtaatctcacctctctcattcttgacttccctgcatgtaaaacaaatcatatgatatcctaaccttccttggagggctattctgaggctcacaagaagtggcagactgaaggtgcatatggactccttggattgactggaagacctttgtctctttctgaagatgacaagtccttttcttaattctcaaactccatctcgtgtgctgtggggtagaggcgttgagagagagtgtgcttatgtctcctggagcttggtgctccctgtgcaccccagagacagtggttgctttatttactgatcctaacagcacaatagcatcaagaaggatatagaaggacaatttctttaccccttcactttggtgctccggtaggagcgcacagaaggttctgtacttgtttacacttaagcttgctgtgggtaggttagaccttgcacaaaaataatatcaggcttcaatatcatatggccaagacaatattgtagcaccatgtcctctctgccttggatcgtgcttcttcttgagttcacttgcttacacaggaagctgttgcatgttgccaagccttctggcaagggtaaaagcatttaaacagtgtaatacattttggaaccaaaagctgtggtcaggaggaaaagtaatcatcttgagtagatgggggcatctccagtgatgtatgattataacatttgatcctactttgtgctattcagtttgctgttggttgtgtaacttacctctgggctcctaggttagagtaaatttaaggaagctggacttaaaatagatatttgtaatcacatttatgcgatgcagtatatatacctgcaccatttattggcatatgagttgatctcaattttgcatctgtagtataaaagtcaagtatttgtaccaacttttaactatcaagaggtgtgtatatgggtgtatgtaaatatgtatttccaggtggagaaagaataattaatttgtctattgttggaaagcttcctggaactaacatcacaaatgatgtgaaaatgtttttgaggtcagccacatagtcatcttcatgctaagcagtccaggaaaataaaataactaccaaatggagaaggataaagttagtgagcattttaagattcattctccaaatttatatcataaagaaagaaaataagaagagtcagatgcccttccattgccaatttaatgtgatactgtcattgatatacttattaaaacttgattttctatttagttgaagggtatgggcctaaggaatggtttactgttcaacctcattatcttgaatttagactcatgcaatacttactgaaagactggcatgactgagtgttggcttttcctaagatttggttggggagaaaaaaaaaaactttatgcaatactgagagatttcgttactctgagaccaaacttcattcagatgcccatcagcttcaataagaattggtctggattatggggactttataagttttcctagtgtagagattcagcccaattttcatcagattctccctagaagaggtaaaaggaaaacttgttgttagagtttactacagtgaggaaagcagaccactgcccttctcctggcaagttaggaagtatcctagagcattcttagctaaagtcttatttagcaagattagaatatgtcacttttcgccactgcattgtccttttctgaagaaaggatgatttatgagtcctctggatcttcttgtattaataacatcttgagccagctgttttattgggtgtacacagagggtaattagaaacatctgagaatcccatagcgtgcccagaaaaccatgacgctgtgtggaaatgaaaaaaaataacattaatgccaaaattgtgtacttggtaaatagatgaataagtattcaacaaaatttcctttgtattataccattttccaaaaagaagctaaagtctaaaggctgaaaatatccttttattgaaatacactcactgcagaaatcataaccttatttggtaaaagcctactgactctgctgttcatacagtaattatcatttcccttctgtcaaagtctatcatattttggaccattttgtgccagaagaagtatttcttctttttacctggcagttacttgaaaattttagacttctgaaggatctcatttaaggaaattaactcttaaaagcactaaaaggactaatagtgtccaatttacgtaatagtctatcctaaaaatcgggttgggatgtaggagtttgggctctatttcagctggttatttgaaatttgatctgctgcagtggtggctgagtttgaagtatttgtggatgcagcagcaacagccactaagttcttggggcttgatttaaatcaggcactgctcttcttactctcaagacaaaatctagacaagaaaacctaacaatttggtggtggcttgtgaatggttcctttcattttcattcacaaataacaagcccctatgagaagtcaatgttgagtcacacagacatagcccaggcagacatgggcagagcggagggtggaagcctccagtgtctttccagcctgtcttgctttgcatgtccctattcagtatgccatttttattctctttaattgttttgaatggattcctcattgatcacatgtattagtccattcttgcattgctgttaaaaactacctgagactgggtaggtttcaaagaagaggtttaaggaactcacagttccgcaagctgtacaggaagcatggttggggaggcctcaggaagcttacaatcatggtggaaggcaaaggggaagcaggcacatcttacatggttggagaaggaggagagagtgaaatgggagatgctacacacttttaaacaaccagatcttgtgagaactcattgtcacaagaacagcaagggaaagttcgcccccatgatccaatcacctcccaccaggcccctcctgggcccggggattacactggggattacaattttatatgagatttgggtgggaacacaaatccaaactatatcattacagagatgaagttgtagctaattgtgtgttttgctagaggttatcagtgacttaatgaagcccctggaaggagaagtggattcacctgtgtaaaaatgtttacagggtaggatataattagtaactcagaaatgtgacttcaaatgcctgccttcttcaatccctaaatcagagattctcagtactggtaatattatacaacagaatctaggaatgctcaaaaggtacagatgcccagcctgcaccccagggtctctaaatcagaatttctcagtgtgctttggatatgtgtattttgaaaacaaataatgtaggcaattgttatacttagctttggtggagaaccaatagtctaaaccagtgcttattaccctttaatgtccgtaggagtcattatggatcttattaaatgcagattctgattcagaatcagaattctgggtagagcctgagattctgcatttctaccacatgctctgaggatgctgtgctgcccacctgtggatcactctgtgagttgtaaaggtctaaactattattaatccactctgataaagctatgtcatcaattaatgatgtttattattgagctcttaaatgagcctgatactatattaggaaatgatttataaatgccaaaagagactcaaccatatcatcaaatatgttaacctttttcaaatctcctacctcaggtcctgctcctgtgagggctgaggtttcctcattctgcgaggcagcgtctcaggcagagtcctaccaggatggcttaagcctgtggaaaactcatgcatgattgccatatgaaatgccgggagggcaggctgccttcttaattcatcctaccatttcagctcactccagtctgccttgtcttcagaatttttcaggggatggtgagaaagtgtttttgttcacatgtcccctaaattccaagggatatgtgtcaagccctccaaagaattttcaccttttttgctccagtggaacagacttggtttctgcaagcacagccagcgtcccaggaagtgaaataacagatactgccttttgtcttcagctttgggatgtagcccaaatcccataacaggagttcaattccatagtctgcacaatatctcagcaaaacattaccagctgccaatagtgtggtggtcttatctgcaaggatgatactcttggtttactagtaataggacagatatttcgttgtctttccaggaaggtggaaggggagatatatttgcgtaggtccatccttattcttgttaagccctacttgggattgatgttaagcattttgacgatatttgaggataccatctttaatttgagacaagagaagctacacttgaattaattgaatgatatcaattagtttaaacctgtcatgtagccatcattctttctgataacatatgttctctatgctgataacatacgttctctatgctgaacttgcctacctgaattgtccagatttgacttatgaacatgatacttgagagtactttgagcacagagttgaattaatagaaaataacatagagtgaagatgaattcattcactggtatcacaaaattgcaactttcccttctgtgtgtcatcaaaacctcattacatttccttcacctcactctggcctctcctctttcccacatggtctactaatacctagcttctttctcttattccccatctccaattctcttatttcacttgcacccatcaggcatatccttagctgggtgctcacttagctcactctgttactctgaaatatttggttcacactcataatgcagaagtgaggtggaaaaactgtttgtctgtcaaatagttctcaactggggcagttttgcacccccacctaagagacacatttggcaatgccggcaaacatttttggttattcaaatttgggggtgctcttggcgtatagtgggtggaggccggggatgctgtgtgtgtcctacaacgtacaagagagctcccatgggctgggcgcggtggctcatgcctgtaatcccagcactttgggaggccgaggtaggcggatcacgaggtcaggagatcgagaccattctggctaacacagtgaaaccccgtctctactaaaatatagaaaaaattagctgggcgtggtggcaggcgcctgcagtcccagctactctggaggctgaggcaggagaatggcgtgaacccgggaggcggagcttgcagtgagccgagatcgtgccactgcactccagcctgggtgacagagcgagactccgtctcactcacaaaaaaacaaaaaaaaaaaaaaaaaaaaaaaaaaagagagggagctcccatggcaggtaataatttgggcccaaaatgtcattagcaacaaagttgagaaggcctgctccttagagcagccttctttccattgccattctttcctatcagacaacatcttagaccctgtttcctattttgtccaggtccttggaaaaccctccctcttaatctcaagattgttctgtagatgaaatctctagccttctgtcacaaatgtcttcctttgatgatggtgccagagcaaacccacagcttgcctttcagctgtccttgcacatgtgttgacctagtcaactggacccaggctcctagaggcttgatttacatttgataatttgtatgagatgatcacattggattttagagggtgcaaggattgagatggtttgggatgtgatgggccttcattctgaagattctctggaaactgaaacaagaaatgacaaatgggaaaccgtttagcacaggaggcattttttttgcacgtctcagaagtgatcgtataacagaaactgcttttcagcactgaccattgctactgtggatgctcatttgcaatgtgtctgagctatggctgttggaaaaggagggaattctgagtgtgtttatttgaacgatagcatcatcacactttcaaataaacataacaccttgggagggtatgggtttgttatttctaacccaaacatctttacacatgccctttgaaggatcattttgccaagtttgaaagaaaaaactattcaagcattaaaagtctgacatattatttaactcattgaaaaaagaaaaacctctttggggccaaaacactctaggtcagctggacaacaatgtgtatcacgtttttaaagcattcacttttggaccaagaaatggccctagggagcaagtaaaagacattgccctcacctgcatataaagtcatatagcagtcttccgttatgttttggtcatcttgcctgggagacttggaattttcacagttatttcttttgtgcttttttacttgaatgaaatgcctgttcttaattccctcggtgtgtaggggggttatattttattgcttatcttcatgagaccccccaaacccataatttacatgactgattttttccccaattgtatcattttttagttgtaaaatatacataacacaaaatttattatttaagctgtttttaaatgtatgttttaatggcattgagtatattcataattttgttcagccatcatcactatccatataataacttttcatcatctctaacagaaactatacccattaagtaaaaattccccattcctttctcccctagcctctggtcacccctgttctactttctgtctctatgaatttgagtattttagagacttactatttgtccttttgtgactagcttatttcacttactttgctttcttttcttttttcttttttctttttcttttttttttttttttttttttttttgagacagagtctcgctctgttgcccaggctggagtgcagtggcaacctccacctgggaggcggaggttggctcactgcaacctccacctcccaggttcaaacgattctcttgcctcagcctcccaagtagctgggattacaggcgtgcgccaccatgcctggctaatttttaaaaatgtttttagtagaggcacggtttcaccatgttggccaggctgggctcaaattcctgtcctcaagtgatccatctgcctcagcctcccaaagtgctgggattacaggcgtgaaccaccacacctggtctcacttactgtgttttcaaggttcattcatactgtagcatgttttctttttaaggctgaatgcagttccgttatttgcatacactaccttttgtttatgcattcatctgtcgatgtatatatttaggttgtttctacctttttgctattgaaaataatgttgctatgagccctgatgtataagtatctgtttgagttcctgctttgaattttttggtgcatatacctagaagtggaatttctgggtcaggtgataattctctgtttaacattttgaggagctgccaaactgttttccacagaggctgtgccattttatattcccaccagcagtgtgtgagggttccattttctctacatccttgacaacacttattttcccattcttttattgtgcttcagcttaccctttttttttgtattttattttatttttcttcccataggttattggggtacaggtggtatttggttgcacgagtaagttctttatggtgatttgtgagattttggtgcacccatcacccgagcagcatattctgtaccctatttgtagtctttcatcccttgccccactcccacccttccctctaagtctctaaagtccattgtattattcttatgcctttgtgtcctcatagcttagctcccacatatcagtgaaaacatacgatgtttggttttccattcctgcgtcacttcacatagaataatagtctccagtctcatctatgtggcaaatgccattaattccatcctttttatggctgagtagtattccattttgtgtgtgtgtgtgtgtgtgtgtgtgtgtgtgtgtgtgtgtgtgtgtgtgtgtgtatcacagtttctttatccactcgttgattgatggacatttggattggttccacaattttgcagttgtgacttgtgctgctataaacatgcgtgtgcaagttggaaaaacccttctagacatgggcttaggcaagaattttgtgactaagaacccgaaagcaaatgcaataaaaacaaagataaatagctgcaacttaattaaactaaagaacttttgcatggcaaaaggaacagtcagcagagtaaatagacaactcacagagtgggagaaaatcttcacactctatacatctgacaaaggactaatatccagaatctacaaggaactcaaaaaagcagtaagaaaaaaacaaacaatcccatcaaaaagttggctaaggacgtgaatggacaattctcaaaagatgatatacagatggccaacaaacatgaaaaagtactcagcatcactaatgatcagggaaatgcaaatcaaaactacagtgcgataccacctcacgcctgcaagaatgaccataattaaaaaatcaaaaaacagtagatgttggcgtggatgtggtgaacagggaacacttgtacactgctggtgggaatgcaaactagtatagccactatagaaaacagtgtggagattccttaaagaactaaaagtagaactaccatttgatccagcaatcccactactgggtatcaacccagaggaaaagaagtcattatacgaaaaaagatattttctcgttttttaataaagtaagagccatactagtgggtgtgaagtggtgtctcatagttttgatttgcattcccctaatgattgatgatgctggcctcttcgtgagcttattagccatttgtatatcttctttggagaaatgtctgttcaagtcctttgtccaattttgaattggtttgtcatagttgatttttcaagaaaaacctgggatttccatttaacaagctaaatacttaactacagcattatctctagctgataattgattgtgaatctttagggagacctgagttttaatagtggtgctgctacttggacaagactcaaatttttaagtcttaatttcttcctctctaaaaggaggagttcaggaagtagatgttcaagatcctttgcagccctaaaattctatcattttgttgaatatgaaacatatctacgcagagaatgctagagtgtaaatgagatgaggctctctttgtgatgttttactctgaaaatatttactgtgctttccaaggatgtacagtatgttcccctttgtacttttttgggctctgttttccactttgaatcaaaggatgattttgtacaactccagtgatacattgtgtggtgatgtgtcatcagcttgacaagtttcatcagaaaagttaaggcctgaaagatttcgaaaacttgtaagtgactctgtattttccttgcttggtttataaaatcaaagttcttagaagagtttggctagaaacagaatgactccttggtggcctgaaggaagcacagcttgtttggagcaggatgaaaggatggagtcaggttgggccaataaggctgcagaggacaagtttttagtttagtttttttaaaagaaaactgaaatgagagcctgcaagccttagaatgcgctggggtcctgctacaaatgataacaaatggatcattcacattaaaaatctgagccgcgaaggatctaaattgcctcactgtggggaaaaagtcaaaagccaactttaaacttaaggaaaatcatttttataataaacgaaaaggtagtttcctaatacatatttgaattcatttatctcttgccaattcctggtaaattctaagtgaattctgaatttatctagattaacagcatcttgaattttttcttcacatggaattaaagaaaaggccagacatgtgagcattctttagcagtcaaaatacagccttgagtggcacttgtgccagagatccacccggctccgtgtccccagagcggcatcattggcaccattttcctttaggaaactggggggtggaggaaaagttggggttttattcccccagccccctcctgcagggtccctgaaggtggtttatgttcctctacctcaggccacagcgctgtcaggaggcacttctctgtgccagttctttgcttttgcaaccccagggttcttgctgtgggtttcccagaactctgcctgtacctttgtcaagaatctctttattaaactgtattaaattttgcaccacttgaatgtgcctttctttcctgactggcccttgactcataccaaaattacattagctaggcctgtaggtagattttttttaagttgatctgtatggcatctttaaaaaaatggaattaggtttttcgaatatgtaacacataatgcaaaatttagaagggacaagaggacctgctgtagagtgaagagtcagttttcttcccatttttgtattccaaacactcatttctccttcccagtgagtaatactctttcccatttctgtcttctcccagaatctgaatgtactggcatatgtgtatatatatccttgaaactgctagaatattttatttattgtattgtaccatgcgttgttcagttagcagtccttatcagcacaaataaatctgccttgttctttataaaggctgcatattccatcctggcatataatataacttattgaactggactgaattgttgggcagttgacctttctacttttgctgttatcatccaagcgacagtgaataatgaaagtcttagtatacatttgtgaatatctaggataaattcttagaaacaaaattgctgcatcaaaggttatgtgtttatttaatttgaataaatatttgccaaattatctaccataaaagttgaactaggccgggcgcggtggttcacacttataatcctagcactttgggagagcgaggtgggaggatagcttgacgtcaagagttcgaaactagcctgaccaacacagtgaaaccccatctctactaaaaatacaaaaattacctgtgcttggtggtgggtgcctgtaagtccagcgacttgggaggctgagtcaggagaatcacttgaacctgggaggtggaggacgcagtgagccgagatcatgccattgcattccagcctgggctacagagtgagactccatctcaaaacaaaacaaaacaaaaagttgaactaattagttttcccagcaatatatgaacttgtctgtatcaccataccctttctaatacagattattatcattattattattattttgagacagaatctcactcaagattggaactacaggcgcgcgccaccatgcctggctaatttttgtatttttagaagagatacggtttcaccatattggccaggctactctcgaactcccgaccgacctcatgatctgcctgccttggcctcccaaagtgctaggattacaggcgtgagccaccacgcccagtctctaatacagattattaaacactttgaactctgcttctctgatagattggagtttaagttgcattttgcttgtgcatgagattaagtttcttttcatgtgcctaaaacagagtttctccacctcagtgttattcacatttgggtggataattctttgttttgagggtttgtcctgtgcattgtaggatgtttgtagcatctttggtctttacctattagattcaagtagcaaccccccatctcaccaccaccaagaagtctctggggacaaaaccacccctgattgagaagcattggtctaaaaacttttctcctttgcctgttttcctttcccactgcacttctggtgtttcaactttgcttatggtgtttttgctatttacttgtttatttctttttaggccatacaaaaattttatattattttatgtagtcatatttgtaaatatgctgcttctcagttcatacaattgatagagaaattgatttttgataacgttttgttaatcaaataaaggtaccaaattcttcttcctttaatcagctgtgatacttcccttcagtgctagacagcaaaccaagggaaaccagagtaagccctgaattttattgatgactgctagcacatagatgtattggagaggatcagaaatcttaaattaataacaactaccactatcgagtctcttccgtatgcccagcactgtttaggtaccttgcacatattatatcttagccttgagacagagccctgcgtgatcaggatgtataatcattttaaaggtgaggaaactaaggcccgaagaggttaagtcacttggccaagaccacagagcaagcaggtagcacagctaggttttgaacccagatccttcagaatcccagggttgtgctttcacctcatgtgtgatgttgtctcatagctaactctgtgctggggttgacattaagcttcaagggaattctcagggaaaagaccatattcgtcgtgcttgtgagatccatcttacttctctttggcttggacagatccgcagagtactttcttccatcgcatctgactcaagttgttcactgaatcttgggtcttggtctgagttttgtattgtacttgtgcaactatttcctcctcacctgtagaatgggaaggataatacctgcctcataagatgttgtgagggttaaatgacagcatggtttgcaaaaaggctttgtgatctgcagaataatgtccatatataagtattattattgttactgttaattgcttgcttaccatacttcatatatttgattacatcaaaatgcaactatataactatacaactatatatataacaattgaacatattttaacatattataaaatagaagacattggtattaacacatgtaaccagtgtatacttaatttcttgagtatattaaacatcaaatattataaattgatagcattgcctagtacttcaatatttttatgtcatttagctataatttcaagtctgagtcaaaccgattatcttactgtatatatatttaatgaattttaagagaattcaaagaactttgattccatttgatttattatttcgggttttcatgaagaaatttacaaacttgacaggtctgcaaatgacagattttacacacttggccattacattggtgactgaagagcagaggttttgtttggactccaggcatgcaggggaggcagacataattttccccctttctagagttcttggccttggaaatttaatatctactttaatcttaaatgtagagatgctgaaaatcgtgtaagtcaaacatcaaaggtgtttagaacctagagacttgttattgtctgtgattattttagatgtttagaattgaaatgtggctaatgcacggatgaggattaagagctttgaaggctgtaagcagttaaggaaggaaaacctcatttcagtggctcatttactgtcattggcatgtttctgaacagttgaaagctgatttaccaaaggatcctgcgtgcaggaggagtaagcattttgtagaaatcagtagggaactgttttgagaagtgaatgggaagcccttagagctgaaagtagcttggagagcatctcattcattcttttcattttatagatcagaaaattgagacccagacagggaggttatgacttcaaggtcatagttggtggcaacgctcagatgcagacccaggcttctgactcccattgcatttccaagtgagatggtttttgcaagatttttatatccagaacattttaaaattggccatctataggatgatggtgctgtactggagatttctaatgcagtttgcatgtgtacgaggagcatcagagagagatcttgccccagctgaaaagccagtatctttttcccactgacctgtgcccacccaaataaggtgaggatgagaatcactgggttactgggaaaagctggaatgaccatagtcaagagaaaatataggccacatgcggtggttcatgcctgtaatcccagcactttgggaagccaaggcatgtggatcatctgaggtcaggagtttgagaccagcatggccaacatggggaaaccctactaaaaatacaaaaattagccagccgtggtggcatgtgcctataatcccagctacttgggaggctgaggcaggagagttgcttgaacctgagaggcggtgattgcagcaagccaagattgtgccattgcactccagcctgggcaacaagagtgaaactcttgtctcaaaaaaaaaacaaaaaaaaaaaaaaaaagagagagagagagaatatatatgcataaaacagagtattcctcagtcattttgtaaacctttgttcaacaaaagaatgaatacattgtgttgtgtaaacttcagatagagattgagagactatcaaacccaaatatccagggattaagtagttacatagaagtaagtagttacatagaagaaatattctatgtaactggggcactgacaggccctcccatcccagacacagaaggctacttactgcccaccggagcttctgcagggcctgataatgatggacatcacagttctgtgccactttttggaattaatctagagaaagaattgagacagggcatcccagatgaagccaaataggggtgacttatagttccctggttaattcctggagggggtcctgaataacaggctcttggatcatgcaaaggaagtagagtaataaaggacctatgagattcattgacattgtggttgtcgaaggaggcaccttctagccagaaaatggaagatttctttccagtgattcatatgtattacccagaacactttgacttcctggaatttaaaatataaactcaagtctcttggcaataacttttaaacactgcagatcactggcttctccactcctctcccttttcccctaaccccgatcctttaaatagatagcagtatacgtacatgttaggtagctgtgatgacaaaaaagttcaaaatgatgcacagagtgtaccttctttcttttctgtgatactgttgacacattctcagtccagcacagtataaccatgcaataggaaacacagttctttggagagctcagttaagtgagatgaaaatacctatcgtgattctgtgtctcatggccaggcaggatgcaatgacatgggaatgcagggggcctagggtctgcctaatctcagccctgtatgtgcttctgtgagtgagggaacaaagtacctgcctagcaagctgtggcctgggtggtgacagctacattttgcttgcttccctctcctaagtgagcagtatacttgctgctgtggctccgcaactcaagggcgtcctatcacaaataatgaaaaatatgggtcctttcagcatacagatgacttagtggtaatagtcccttcgaaccttgagtgcttgcttataaagtcaaggcccagccaatccagcagccacttcactgagctctggagtttgagttatcaaaaagctgtcacctcttacacttcctgtctagcaccttttaaaggtaacatcactgcctccacttccaaaaaagaatttctgttctccatctcttctatttcttattctttgtgtccaattcattcaactcttaaaataatactttcaaataatatccagaaagtctggtgattgtgcttctaacccccaccctccccaaacctagtgaagctgcttatttctctgcctcttggatctatgggtggtcccatttaggcttctttagtttcctatgtcatcatcttcaggattattagagaagaattcccagattaaaagtatggagaaagatttgattcggagctggaaggaaaggaaaagtaatgttcactgagtaccttctgtgtactcaacttagttttagccattgtcacatgctatttttctgcatcccaagaccaatgggtatattatttccatgtaccgattagaaaactgaggcctagcaaattcattttattttattttatttatttttgagatggagtctcgctctgttgcccaggctggagtgcagtggcgcaatctctgctcactgccacctctgcctcccgggctcaagcaatttttctacctcagccgctcgagctgggatcataggcacccgccaccacacctggctaatttctgtatttttggtagagatggggtttcaccgagttggccaggctggtcttgaactcctgacctcaagtggtccgcccacgtcggcctcccaaagtgctaggataacaggtatgagccaccgcgcctggcctcaaatttaaatagaatattcaatccagagaaagaattcaactttaaaaataacgattatggacaatttccatttctgtagccacgaagagaaaatttattaggggcttgaggagacttgccccttttaattgttggtggatgaatcgcaaaacttgaatttaatggaatccaagtgccttggactgcttttgagcaggtcattcatgtggttagagcaacgctgcttccaagggaatgttttgattgattgtgtcagcgtccttgggtggcccttccaggagcttgaatgcctgtgtaagtttggtttcctctggctagcttctaagctcctgcagatgaggtaccacatcttctttctattttgttcttctaataatgactagtgtaataaattaatcagtatggaaattcagcacaggtaggttgacctactatagaaagaggctttttcagctctgttgagagtcactagatattatagacaagtactatcaactaggtatttgggcctcgtgattagttgcagttatttctgcctcattattactggtcattgtggttcttaactcagggatagaaggtagattttattttatgtacccactctatctgttgctgaccagcacagtatgctgagaattcggagatgacatctaggcccagcaagaactatgataggttaataatttttgttagaggagaggagagtgcagcacctaccctataggtgctgctgtcatggttgttgccagcagtccagcagttatctcaatgaagactgggtctttcttgcccctcttgaccactccagaagttattgggacaatgtgtacactttggagatagcatggtagactttgagtattgactctgccatttattaatagtgtgctttgagaagaatactacatgtctcagaatctcagttttcttctgtaacttggtgtaaagcgatgtcattcacaggatggctataaagagtagatgacataatagctataataccctgtaaaatagaaatccaacaattgttagtatctttcccttacgtagaggttaaataggaagctttttttttttcctttttttttttttttgagatggagtcttgccctgtctcccaggctggagtgcggtgacatgatttcagctctgtgcaacctcccaacctccacctcccaggttcaagcagttctctgcctcagcctcccaagtagctgggattacaggtgcccgccaccacacccagctaatttttttgtattttcagtagagatggggtttcaccgtcttggccaggctggtctttaactcctgacctcgtgatccacctgcctcagccttccaaagtgttggcattacaggcgtgagccaccacgcccggccaggaagcttctttatagagactttgctgttcttaccttctgcaaacaaatgagcacatgaaagaatggagaatgttaatattagcgttaaagtagatatgttattttcttcacttttgtgtcctaaattgttagctgcaaaagattaatatattttaatttattaacaaagaaagtagaaacttttcaacaggtttattttgggcatattaaagaacctgcattgtagactataaacattcatgatcgcttttattgatgatcagtcttaggaattatgaatcatttggttagtgagtaaataaatgagaaatacagttctcatttaactctgtatttatcccccatggcttttgaattgtttctttcagatgggaaccaagtgacttgccagaagtgggcatgcttgctagcattttgtgatagcttcacacgagcttgagaagcacatgctgaggaacttacttgacactcatcaattttagaatagagtgacagccatagataaataatttctgtgttttgtcttcctcaaaagagcaaatttggagggagacagttgtatcatcttaactacctttttgtggctgaagtgttgaatctaaggtaccagaataaagggtgaagtttttaaaattttgcatgtttatttaatagatttgtatttgttcatatgtatgtgaataggtttatacataataaatgccacagtgatagtggtcaataccttaaaaataaaaattagttcttccttaatcattatttttcttgtttgctttaggaattctgaatggatgtcatgactatatatctaataattacttaggaaatcctctcaatctctgggcatggggtattaggctatgaaaaccagaattttccattttaatcataacaactctgaacatttttatgctaatggtgaaagcagaaactttgttcttgtcctcaaatcaaatttaagctttcctgttgattacacatatccttgacgagtaagattcactctctttcacctgcctggttattgatcagctcatgagcagatggaagatctaagcataaatcactcatgaagatgatgaataagctgaaagtttattcatatgtataccctttcttatccagtgatagtagaagcttcatatttaagaaggggattaatgacataatttattattgtttcttgttcttttcgttaaagggaataaacaatataagtgaataattaattgaattttgtaggaagggttcagaaaagacctgccagatacagacaggaacccttgtcattaaacccaaggccagcagacattgcacgggtgtgtgttagaagcaaaggcaaagggctctgggaaagagagtaagaaagtgttccttttagatctgagaaatagtaagctttaagaggctggctttattgatttatttattgagacaaggcctcactccatcacccaggctacagtgcagtggcctgatctcggctcactgcaacttctgccccctgggctcgagcaatcctcccacgtcagcctcccaggtggctgggactacaggtgcatgccaccacgcctggctaattgtattttttatagaaacagggttttgccatgttgcctaggctggtcttgaactcctaggctcaagtgatccacttgccaaggcctcccaaagtgctgggattacaggtgtgaaccaccacacccagcctttaagaggctttaaattgtcacttgacattggtaatattccagtatgctagaaatgatggcaagagtacaaaacatggccttaaaattattctggacatgatattaaacgtggtaagacaattggagactgtgactaaggtggcagaactgttcagtcttttgataattgccatgatcttatggtagaaaaagcactggaagcaagagcgagtggggtaggatgatgaaaaatggcttaaaggataaaaacatgtgattattaggtagaaggaataaattgaatgtatgatagcagagtagagtgactatagttagcaaaaacgcattatagttagttgctggacaccctaaataccccgacttgatcattgtgtgttatatatatgtaacagaattttatgtgtattcatacatttgtataaataaaagaagcagcacctggattttaggactttcaaataaaacatataaggtttgggggagaaaaagaaaataaattaacctacgtcaaaatcattgatttctagttaataaagatttgataattgtttcagaaatagactagaatggccatatcattaactgggtcataattttatggaaaaaagcttatttcatgtctctcctttttatcatagtgctctatccagaaaagatgctcagagaaaacaggtgtattgattcttattttttttttctcttaatatgtctagtaaaagtcagggtgcacactcactataagaacaatgattattaagttgacttgttcattaagattaagaataatgggccgggtgcagtggttcatgcctgtaatcccagcactttgggaggctgaggtgggcagatcacgagttcaggagttcgagaccagcctggccaacatggtgaaaccccgtctctactaaaaatacaaaaattagctgggtgtggtggtgcatgcctgtaatcccagctgcttgggaggctgaggcaggagaattgccctgaacctgggaggcggaggttgcagtgagctgagattgcgccactgcactccagcctgggtgacagagcaagacttcctctcaggaaaaaaaaaaaaaaaaaaaaaaaaaaaagattaagaataatggcccaactatgaataaatctgaagtttggttcccataccgggaaccaaaagagcattaatgatattgggtatatattattttcttaagatgtgtttaggatgtgggcctatcttgctaatgcttatttatagtattttagtctatgctttgactttatgcaagatctacaaataaatatttctgattacagaaaaaagcatcatttcttattttgatgtcatttggaataaaaaatgacccaaaaagctctactgggaaaaatactcttaattgatccgtgtataaacccaaagaaagtttaactttgagtcttgtggcctctgtcaggaggctggagatttggctccactgaggttcattccaacgattgacattcatttgtcacctacttagggcattcacagcagttttctaggtattgatgagaagatacatacctttgaagtttgtatacagacagtttccttatgatgcatatttgtgcaaatgtgtactgagaagcaggtccacctgaaccttcagggagcagtcaaaaggaagcttcacttaaagcaagtacataagagtggtggtgggcctcaaaatcgaaagaaggaagagtgtgaagaggaattctttcagaatctagccaggaggatggcatgtgcgttagtatacatccaggatagggagtgtggtatgttccagaatcacagatcattcagtttcatgatctaaatggagagtcatagaaaaattctgtagggaagtgaactgattggttgaatatgcatatcagaatgtccctcctggctatggtatgaagaaagcatattggagggattatgaaaagagggagagggactattgagaaggctctgctgtagtctgtgaatgatataatagcttgaacttggacaaaggcattgaagaatggagagaaagaaataggcgagacgctgaagagagagaagcagtagtacttagctacaattggcatctggttatgggacagagaagaatctaggctttgatgtttatggttcataaggaatattctttaaaatttaatagattataggaccataaaaacttagaactgagaaagcaattatatatcaggcctttcattttaccaactagaagagcaagttgcagagagctgcactgaattgctcaaggttatttagctttgcggtgcagacctacaacggaactgagatctcttgtctcccagtatggggaccttctgatacactagactttaaacttgtacagtaaactctctgtggaaaaggtgattttgttgcacccaggaatttatcatcatcattattattatcattattttagcagacggagtctctttcttaatgaatataatggacttagataatgtgaatcacctagtaaagtctgcttaaatgcatcagttccatgaagagaagaagtacagttttagaagtgaattggtgaaaatgctttattccaaatggcttgtgaaaataaggatttaaaagctggtaggtttccagctttgatggtatggagcctattagtacaattaaaggtgtaaaatgcattcttctttccccattagcttttcaagtttctaattcagttttggaagtcacctcttccatcatagcctaactttaaaagtagatacacacccctctatgagtaatgtatgtttttttttttttttcttgtttggatcagatctgctataaattatacaactttatgttgagatcaatttggtaaatttattagtttataagaattagataagtgattgtattttgtaaaaatatttcattatatatcggttaaaaaagtacatataaaatgtatggtacattttcattctgaattaaaacctcatagggttgccttaacttcagtatctagccataaaaggaaaggagaaagagaaacgggaggaatactagggaaaagttgctgaaattcttctttgtatacccaagtagtttctctgatgatacttggtttatttaggagaattgccagaaggatttagaaatgtttctagtccttattagtgatggtagttttaatttacttttcttccatgtctctgattcttatcctgtacagaatctagacctccaattgttttattgtggtaactgagtattagcgtgtacacaaggatgtttcaaatgtcaacttagtctaattctgagctacatctcgagagttaattagaaacatactcatgggccaatactgaggtttagaaagaattatcttaaggaagtcagttttgatacatattgtcttgatttaatggaatgttccagattcaggaagtatatatggagccctgaggaatgaataggcatattttaataacctgaacttgacataccaagttatttaagttaaatggaaggagacatgttggctcatctcatcagtcagtaatgaatcacgtggccctgaatagcgttagcatttgattctggaaggctctgctgtgtgattttaagcagtgtgcagtagaaactccaaaattacctccatgtaactgactttccaaattaaccaacaccctctactcccttttaaaaatatgctgactgatgcccatggtgtgccgaatactcctggctgatagctactccggggttgaccctacacatgacaccacccagatctgagttttgtttctactaagagtcagttcttttgtccctgcctgaaattgcattatttaattaaatgttatgtaaattgattaaaaagtgagtgccaaaaaaagaattatttgcatgaaaattaagatgaataatttggaaagaatcaataaaagtgaatctctaatataatattgactgctgatttagggctaggcaagacaacattaaaactttggaaagcaaattataaaaatcagaaatttggcattcaaacgacttcccaattaaaaaaagtttcataaaagcctcatttgtacattcaaaaaaaaaaaaaaaccaaacatatattaggtaccgaccatgtattaagcattttgctaagctctagggatgagcaactgaaaaagatgaggtccaaaaactgtttctttctttctggaactcatatgcttttggagcagtcagatgtgaacccagacaattagaattctgtctgtcctgcacacaagcatttgttgctttaagagcatgtggcagggagtgggagcttccagctttgccctggcatcttcaagaatggccttaggaaagaggtcatgcttcagcagaggtgtgggtggaagtagtaaggtggggaggtaggttgggatgaagaggaaagaggctgtatacaaccgtgtatggaggaatgtgcagtggtcagaagagtccaagtgttcaggatgactgagactaaaaagaacatgatgacagcagcagagagagatgagactggataggttgcaagaactagatcaaggagagcccttctgccatgattaggtttagatttcttccactggtggtatagagaatctctgaattagttaagcaggaaattgatgggtgtggttttcagttcaaatgagtctgtatcttagagggaatgatccagttagaaactatttgaggacctttttgctaccatcgaagtttatgataatatctaaaaaccaccatctagcccctgttagacattcctatcactctgtgcatagttgtaagaacagaaaatggaggctgagcacagtggctcatgcctgccatctccacatcttgggaagctgaggcgggaggattgcttgaggccaggaatttgagaccagcctgggcaacatagtgtgacacatctctacaaaaataaaaaaagaaaattagccaggcttagtggcacatgcctgtagtcctagctacttgggaggctgaggcaggaggatcacttgaacccaggagtttgaggctgcagtgaactatgatgatgccaccactgcactctagcctgagggacaaagtgacaaagtgagaccctgtctttgtctcaaaaaaaaaaaaaaaaagaaaaaagaaaaaaaagaaaatgggtgttgtgtaaaataagcaatctggatttttaatctatcagattataaaaatgaaacttgtgatgttgtcttacaaatttttaatatttagtatttctgaagagccatttgaaaccaatcagtatttgggattgtgtacccaccagaggccaggagtcctctaaaactagttttccctgggtgtttttgtgttacatggagatttaaaggtcacagtccacctggcctttttagcatgttaaaagaaaaaaaaaaggcatcaggagcctgttttcctgcctaagggttttccagttgaggtatctagaaagatctgaggctgagcttcttaaatgtccatctctcccacagctacacaggctattatgtatgctttgggatggttaatttccaactcatagtgattttgacaccttgtgctgcatccagtctcgcctacctatatgctgtcagtgacagtttgctactcagaagagaggactaaaagggatccgtgccctttaaaagaaataaaagaccagcatagaaaatagaggccttggctgtggcagcagagttaggggggagccatgggaaagtaatgatccatggagggtgggaataaaaaggagttgtagtcgggccttgcagatttttgtttatagtagtggttcccaaacattgtccacccagaatttattccttttggcatttgctggaattttatagaccctatttcattttattgcccagtgtgtttcttctttcatgtcccatggggaacgtttctctgcttttgtgtgagtcctagaaggtctccatgcccttctttagcttgcattcttcctctgttcttccattcctaactccacccgaaactgccacattatatttttcttttccagcacattatgtctctctccccctctgaagccttctgttcaaaatagctgcttatctttagaaaataggaaaggaagttttatttaataactaatattaagatatttagataacagttgaaagcaaaattagttacaatctgtacttaatacagtgggtaaaagctccagatggaatgagttgaataattaagcaagaaagagaagaaaataaaataccagcatgaaatagattacttatcagatacttggaggggtaatagctttttaagaattgaaaccatagaacatataatagagaatagcacttataaacttaattatagaaaagcagcaaacaaaatttgtataatccagacaaactaaaataaacaggaaatagattgacaaagatgttttcatcaataagacaaatagaatcttaaagtttatgatccataaaaaccaacacgagagtaatttaaaaatcattaacattctaagagataggtaaaatatatggataacaagatagttcaaacaaggagaaataaaagcagtaaacagatatgtggggaaatgttcaaaatctttagtaaagacatgcaaaatcagcattgtggtaatataatcagatagtaagaaaaatattcacagctcagaagttaccttgaaactagtaaattggtaaaaatatttagaaataaaatccaggggaagcagccaagatggccgaataggaacagctctggtccacagctcccagcgtgagtgatgcagaagacgggtgatttctgcatttccatctgaggtaccgggttcatctcactagggagtgccagacagtgggcgcaggacagtgggtgcagtgcaccgtgctcgagccgaagcagggcgaggcattgcctcactcgggaagcgcaaggggtcagggagttccctttcctagtcaaagaaaggggtgacagacggcacctggaaaatcgggtcactcccaccctaatactgcgcttttccgacgggcttaaaaaacggcgcaccacgagattatatcccgcacctggctcagagggtcctacgcccatagagtctcgctgattgctagcacagcagtctgagatcaaactgcaaggccgcggccaggctgggggaggggcgcccgccattgcccaggcttgcttaggtaaacacagcagcctggaagctcgaactgggtggagcccaccacagctcaaggaggcctgcctgcctgcctctgtaggctccacctctgggggcagggcacagacaaacaaaaagacagcagtaacctctgcagacttaaatgtccctgtctgacagctttgaagagagcagtggttctcccagcatgcagctggagatctgagaaggggcagactgcctcctcaagtgggtccctgacccctgacccccgagcagcctaactgggaggcaccccccagtaggggcagactgacacctcacacggccgggtactcctctgagacaaaacttccagaggaacgatcagacagcagcattcgcggttcacgaaaatctgctgttctacagccaccgctgctggtacccaggcaaacagggtctggagtggacctctagcaaactccaacagacctgcagctgagggtcctgtctgctacaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctccaaaggaacgcagttcctcaccagcaacggaacaaagctggacggagaatgactttgacgagttgagagaagaaggcttcagacgatcaaactactccgagctacaggaggaaattgaaaccaaaggccaagaagttgaaaactttgaaaaaaatttagacgaatgtataactagaataaccaatacagagaagtgcttaaaggagctgatggagctgaaagccaaggctcaagaactacgtgaagaatgcagaagcctcaggagccgatgcgatcaactggaagaaagggtatcagtgatggaagatgaaatgaacgaaatgaagcgagaagggaagtttagagaaaaagaataaaaagaaacgaacaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactccttgagaagagcaactccaagacacataattgtcagattcaccaaagttgaaatgaaggaacaaatgttaagggcagccagagagaaaggtcgggttacccacaaagggaagcccatcagactaacagcggatctctcggcagaaactctacaagccagaagagagtgggggccaatattcaacattcttaaaaaaaagaattttcaacccagaatttcatatccagccaaactaagcttcggaagtgaaggagaaataaaatactttacagacaagcaaatgctgagagattttgtcaccaccaggcctgccctaaaagagctcctgaaggaagcactaaacatggaaaggaacaaccagtaccagtcactgcaaaatcatgccaaattgtaaagaccatcgaggctaggaagaaactgcatcaactaacgagcaaaataaccagctaacatcaaaatgacaggatcaaattcacacataacaatattaactttaaatgtaaatggactaaatgctccaagtaaaagacacagactggcaaattggatagtcaagacccatcagtgtgctgtattcaggaaacccatctcacgtgcagagacacacatagactcaaaataaaaggatggaagaagatctaccaagcaaatggaaaacaaaaaaaggcaggggttgcaatcctagtctctgataaaacagactttaaaccaacaaagatcaaaagagacaaagaaggccattacataatggtaaagggatcaattcaaaaagaagagctaactatcctaaatatatatgcaccaaaaacaggagcacccagtttcataaagcaagtcctcagtgacctacaaagagacttagactcccacacaataataatgggagactttaacaccccactgtcaacattagacagatcagcgagacagaaagttaacaaggatacccaggaattgaactcagctctgcaccaagcagacctaatagacatctacagaactctccaccccaaatcaacagagtatacatctttttcagcactgcacaacacctattccaaaattgaccacatagttggaagtaaagctctcctcagcaaatgtaaaagaacagaaatgataacaaactgtctctcagaccacagtgcaatcaaactagaactcaggattaagaaactcactcaaaactgctcaactacatggaaactgaacaacctgctcctgaatgactactgggtacataacaaaatgaaggcagaaataaagatgttctttgaaaccaacgagaacaaagacacaacataccagaatctctgggacacattcaaagcagtgtgtagagggaaatttatagcactaaatgtccacaagagaaagcaggaaagatccaaaattgacaccctaatatctcaattaaaagaactagaaaagcaagagcaaacacattcaaaagctagcagaaggcaagaaataactaaaatcagagcagaagtgaaggaaatagagacacaaaaaacccttcaaaaaattaatgaatccaggaactggttttttgaaaggatcaacaaaattgatagaccgctagcaagactaataaagaagaaaagagagaagaatcaaatagacgcaataaaaaatgataaaggggatatcaccaccgatcccacagaaatacaaactaccatcagagaatactacaaacacctctacgcaaataaactataaaatctagaagaaatggataaattccttgacacatacaccctcccaagactaaaccaggaagaagttgaatctctgaatagaccaataacaggctctgaaatggtggcaataatcactagcttaccaaccaaaaagagtccaggaccagatggattcacagccgaattctaccagaggtacaaggaggaactggtaccattccttctgaaactattccaatcaatggaaaaagagggaatcctccctaactcattttatgaggccagcatcatcctgataccaaagccaggcagagacacaaccaaaaaagagaattttagaccaatatccttgatgaacattgatgcaaaaatcctcaataaaatactggcaaaccgaatccagcagcacatccaaaagcttatccaccatgatcaagggggcttcatccctgggatgcaaggctggttcaatatacacaaatcaataaatgtaatccagcatataaacagaaccaaagacaaaaaccacatgattatctcaatagatgcagaaaagacctttgacaaaattcaacaacgcttcatgctaaaaactctcaataaattaggtattgatgggacgtatctcaaaataataagagctatctatgacaaacccacagccaatatcatactgaatgggcaaaaactggaagcattccctttgaaaagtggcacaagacagggatgccctctctcaccactcctattcaacatagtgttggaagttctagccagggcaatcaggcaggagaaggaaataaagggtattcaattaggaaaagaggaagtcaaattgtccctgtttgcagatgacatgattgtatatctagaaaaccccatcatctcagcccaaaatctccttaagctgataagcaacttcagcaaagtctcaggatacaaaatcagtgtacaaaaatcacaagcattcttatacaccaataacagacaaacagagagccaaatcatgagtgaactcccattcacaattgcttccaagataataaaatacttaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatgtatagattcaatgccatccccatcaagctaccaatgactttcttcacagaattggaaaaaactactttaaagttcatatggaaccaaaaaagagcccgcatcgcaaagtgaatcctaagccaaaaaaacaaagctggaggcatcacactacctgacttcaaactatactacaaggctacagtaaccaaaacagcatggtactggtaccaaaacagagatatagatcaatggaagagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatgaattaaagacttaaacgttagacctaaaaccatagaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaagtgggcgaaggatatgaacagacacttctcaaaagaagccatttatgcagccaaaagacacatgaaaaaatgctcatcatcactggccatcagagaaatgcaaatcaaaaccacaatgagataccatctcacaccagttagaatggcaatcattaaaaagtcaggaaacaacagatgctggagagggtgtggagaaacaggaaagcttttacactgttggtgggactgtaaactagttcaaccattgtggaagtcagtgtgacacttcctcagggatctagaagtagaaataccattggaccgagccatcccattactgggtatatacccaaaggactataaatcatgctgctatgaagacacatgcacacgtatgtttattgcggcactattcacaatagcaaagacttggaaccaacccaaatggccaacagtgatagactggattaagaaaatgtggcacatgtacaccgtggaatactatgcagccataaaaaaatgatgagttcatgtcctttgtagggacatggatgaaattggaaatcatcattctcagtaaacgatcgcaagaacagaaaaccagacaccgcatatcctcactcataggtgggaattgaacagtgagaacccatggacacaggaaggggaacatcacactctggggactgttgtggggtggggggaggcgggagggatagcattaggagatatacctaatgctaaatgacgagttaatgggtgcagcacaccagcatggcacatgtatacatacgtaactaacctgcacattgtgcacatgtaccctaaagcttaaagtataataataataaaataaaaaaatagaaaataaataaaaagaaataaaatccaattttgacatgttaattaattaatctatttatttattttctgagatggagtctcgctctgtcgcgcaggctggagtgcagtggtgggatctctgttcactgcaagctccgcctcccggttcatgccattctcctgcctcagccttctgagtagctgggactacaggcgcccgccaccacgcccggctaattttttgtatttttagtagatacggggtttcaccatgttggccaggatggtctcgatctcctgacttcgtcatctgcctgcctcagcctcccaaagtgctgagattacagtcgtgagccaccatgcctggctgacaacatgttaatttaatatattaatatagtgctattgacgttattgattgacatattctttttggaaattcatctgttgatatactcagaaattcaacagcccagcactagattctagagaaagtggtgaacgaaataatctacagtatagtgcacgacctgaccagcttcccaagatgtggagatggcaggcatgagcaggcttgagccactgtgcttaaccatcccaaagctgttatgtatgctttgggatggttaattttcaagtcatagtgatttcgacaccttgcacatcccttttgttgctgatatgctggtttgctttcccttttatatgttcttctcattgcgccctgccatcataattacgaagttgatgaggatggctaacgtttgctgagtgcctgctatgtgctgagttctgtgtactgtgaatatatgaattcattcaggtcacacaacagccatatgagctggatacaattatttttctcattttacaggtgaagaagtggggtagaaaaacattaaataacttacccaatgtcctgccagtaagaaataatttagttgggattcaaactcctggaggtctgattccaggctgttgctcttaatgtctatgctctgtattctccccatggtgagacagttacattagtgtaatcgactcatgttatattttcttgttcgctatatctcctagcacattgccttgcatactaagcaatttgtaaatgttaactgaatgcatgagaaaataattactaagaataaaactttgtgcttgtggaggatattctttggagctttatctctaatagttaaaaaatgcagacaaggctgagcgtggtggctcacacctgtaatcccagcactttgcagggctgaagtgggcagatcacttaaggtcaggagttcaagaccagcctggccaacatggtgaaaccctgtttagtacataatttttgtatgtactaaaaatacaaaaattagccaggagtggtggtgggtgcctgtaatctcagctacttgggatgctgaggcaggagaatggcttgaacttgggagatggacattgcggtgagccgagatcacaccactacattccagcctgggtgacagagtgagaccttgtctcaaagaaagaaacaaagaaagaaatgcagacaagctaagcacagtagaggaatggctatataatttaccatctgccaatggaatattatatagctactaaaatcaatcattaaggctctgtagcaatacatggtgcatacctgtatgaaggctgtgtagtaagaaaagaatgcaaatgtaaactgtagtggttaaactgtaatctgaacactcatctaggctttacaaatttgtgggcatagataatgtaatgatcaaatcacattacgctagccaaaagcccttgcttgcttacctgcacccctctgtaccccctgcaagtgtttctgatgatccccaagggctgctccccagcctgctgaattacagggatggaaaggaacctgtggattgtgtccctcagccacctcatttttgcagatggagacactgtagtctacatagtgattttgaagtcttttaagattgttgccgaaggaggcctcaatctcaaggtgtttggtgtttctgcagccaacaaatgttgctgcgtttttcctaagggggacagagccttgaggtttaggaatcattaggagagagcgacaatgacagcatctgtgatgaagaatgtgaagtggaattttatgacatgcctaatatatggagctccttaggttatgcaaggtataaaactagatcaaaatagatagcgcacagcaatggcgaggttgatgataaatgaacaggaagctataaacaaagttgagatgatgaatggcctcatctcatctggtgtgtgtgatagcgcttcgtatctcctgggttataaacagaacatgttattgaagcatttactaatgcccaccagcattaaaaatttgtggtatttttggaattgttgtttgcattgaggttgatcttttctacttgttgaaatctgcatttactttaacattagcttgatatacctggtatttgataggtggcgatggaatgaaaatggtcttattaattttcaaagcaggtaacaaaaagagtaatgtcctatttgcttgaatgaactaaaccaatggttaaaatagtctttaaagtcagtgatgcttgaatggtatctcaccaccatgttggtttgttgatgataatagtcttggtagatcctgtggaggaacttccttgtaatgatgtctgtccacccccaacatttttgtaggtattaattagtatgtttctacatcttctggcatgctttattttccttttttctttttcttctttagagatggggtctcactgtgttgccaaagctggtctcaaactcctggcttcaagtgatcctcccaccttggcctcctacagtgctgggatttcgggcatgagccaccatgcctggcccccagcatgcttttatttgctgtttttaaaaagtcacctctttgtctagagcaagcttgtccaaccccagcccatggggtgcatgtggctcaggatggctttgaatgcggcccaacacaaatttgcaaacttttttaaaacatgagatctttctgtgattttttttaaagctcatcagctatcataagtgttagtgtatttaatgtgtgactcatgacagttcttcttccagtgtagctcagggaagccaaaagattggaaacccctcatctagagtttaaaactaatggttactatgaatattcgtgaagtcttttagttcttgtgatatataaaatagaaaacaccttcattataaaagaatgaaacgataatgtatttttacatctgatgtcaaataaatgcatatattcttaaaaaaaaaaccaaagagatgctcactgatggggagtgttgggtgcatctttaacttttttaaagcattttctctttggaactctgttgtgtcttttgcatgtactatggagaatactagtctcttctctcatatgtaaaagaaaatccctgtaccttcataatgattatatatttagtgagttttaagttaaaacttttagaaatttaattagaatctggctaatgggttatttaaaaatgtaaaataaggtttaaaaacccaaagccaagtgtccagtgcacattgaaagcgtatccaatagaagatcctgtagctatccttgtttttccccggttctgtgtcctgtgattcagatctgcctgggtcctaagttttaatctatcatttatattctttgtgtttaactctgtctacttttacagactgccttatatccttatggaaatgaacaggaatcgggcctgtgtctgtatctgaaacccagcttgtctccctttctccctgcctcttacactccagccacatcagctccctctcagttttggagcctttctaaaacacctcacctcaaggtcttcactcatgttatttgttcttctgtaaacactcttctgccaacttttcatcttgctgtattcttccccctttaggttcagcttaaatctcacttccttggacaggttgttctggatcaccctaactctggttttttgatggagtccgagtcagtataagttaacagacagataatcaagaattgaagataggcagttttagaacacaacaactgtaaatctccacattccatagggacaaaaccagtccacattcttctttcttggtcatgtgtaggactaggccttcctggttcctctgttctagctttagaagaaggtaactgtcttcttggagtccagcctttcttttttccccttggtgatgcataccgaatgaaaaggcaagcatataggtttggttttgtgtagcgtggcatagtttttttttttttttttgacagggtctcactctgtcactgaggctggagtgcggtggtgcaatctcagctcagtgcaacccctgcctcccgcgttcaagtgattctcatgtctcagcctcccaagtagctgggactacaggtacatgccaccatgtctggctaatttttgggatgttttaaagtagagacgggggtatgccttgttgaccaggctggtcttgaactcctggccttaagtgatctgcctgcctgggcctcccaaagtgctgggattacaggtgtgagtcaccgtgcccagcctaagtagcataggttcttaaagtgagcaatggtttgctgtagcatgtaattattatataacatatttgttatcctaaagcagaatggggggagaaataatgtggtaacttaactttctaaaaatattgctacccatcaccaaccagccctgcaagggatatcaacaaaaatgctgaaggcctttaagggaatattattctaatcagagacaagtgggaaagtcaaatcaaaatcatgtgtgtgtctgttctgcaaaaggacagatacgggttttccttcagatggaggtttgttttccctgctctgcctttgccacgataacttgaaatggtctgtctgctggcacagaaagccagggagcgggtggagtggccaggaccctgctgcaggaaggtcaagaacattcttagagtgccttttgggaaccagcagccgaagtatttttatagtcagctaagataacaggaaagaaagaggcagggtctgcctttttatggtataaatttttagaaaattcagtttgcccgcatttatatacaagtcatgaatatttgttcatctaaacaaggttccaattcgtggcacagaatgtgaatattattctgtcagcccaattacttgagtactgcaagttgttttacagaccaaagtgaatggtggaatacaactgaaacgcctgacttatttaaaacctccagcttgttgttcttccagcatggatccttttgctcattttgaccttttacagttgtaccgtgagatactttgagtgaccgtcacaaaattacactttctggagtaacaggctgaaggcctacctcttgttaattgcagtagttcccaggtgactctctgatgcaatatagtgaattatggtgatgaccagcaaagtatcaagctaacaaggttatggaatgtctcagccagcattctgcagttcaccttcctgtaatattttctaaaatatatgccccatggctagccttgtaaccagcgtaccacaagcatctcaagtcaaccttaacaataacgtactcttttcctcttgatgttctgaggttttatagaacttgggaagcacagatgatacatcactagatgatgttttgagagtggcatgaacttttgaaacagaaggaaactattcatagttgaatcctaaagtttgtaggtgtattttcaatttgtttctgtgatgtaactgactattaggtataaaaagactgcctgccacaaagggttcaatacatacttattgagctgagacaaagagctttatattgtcatttagattttagaaatgctagaactggagaatagatattttatttattattcataaagggttataaatactggacttttattggttgaaataagtcaagcagaaaccatttcctttataaccagagagacacagggttgttggagtttagggattattgctgtatccacgtatgctggtatagtccttgaaacaactgtgtggaggttatctcagggggttagaggtagatttaaatgaaactaagttcatgatagagttcaaagtctactgctgatattgggaataccttgtaaaagtcaattggttactgtttctttgtttaaaaaaaggtggtgttggccgggcgcagtggctcacacctgtaatctcagcactttgggaggccgaggtgggcggatgatgaagtcaggagatcgaaaccatcctggctaacacggtgaaaccccatctctactaaaaatacaaaaaattagccaggtgtggtggcaggtgcctgtagtcccagctactcggaaggctgaggcaggagaatggcacgaacccaggaggcggagcttgcagtgagccgagatggcgccactgcactccagcctgggtgacagagtgagaccctgtctcaaaaaaaaaaagaagaaaagatggtgatatatatatatacacacacacacacacacacacacacacacacacacagacatatatatgtatgtatgtgtacacatacacacacattgtattctagtatagattgattatagggagccctcactttgcatcttaaaaatcaatttaaaaatgatgagttctatgaccttaagaaatttttgccaaagcattaaaaatgttttagtgtaggttattaatatatagggaaatgaaaaaaatagtacagctaatatttatttagtacttgataatttaaaatgttagaaacattgagagttaaatgtttcatttctttgagtaaaacttgggaataatttcaacatgtttgcttttcattgtataactgatgatatagagtatttcttttcttttgtgtactgtcgtactcctttttgagtttgtacaaaacgttggaagctgatccaaagttgtgaaatacctgagagttactttaatgttaattcctttgggaatcttcatcctgttcattacagccaccttccaatttcacttccagtgttgtcactttgtatttctttgctatactttcttttttgttggctcatactgtctttcgattatccacttttgtaaaatgtcctgtgatttttatccctctgagatgaggagatggcagaactacctgctttgctgtttgttcctgaactgaataccagatgtgcagggaccaatcaccgacaggctttcagagaagtgacatgattggtcattggtcgtgatacacatctgttattcacatcatgatttgcgaaccaaagagctagcagtgaagtttgtatttgatgcagttactcagttaatataccttggtaagtgaagtctgaaccacgttgtcgggggactggtattatttaacaaaactacggtaacggaaattcatgcgtattggaaccataccaagtgaggagtgcctgtattccagttataaattctttgtagtacatttaaagctgggcctagctccctttgctttacccattacacactgagcctgtccagtgtagccaaactgtggtgcagaaaatcaaatcagagttgaactgagagtttcaaagtcattgattcaaccttggagtcagctttgactttctcttttcttacccaagacctcacagagtagtttgggcactaatgaaggtatttttcagaccccatccagcatggggagttttgacttgatctgcagcctacgccctgaagaaagtttctgggttgtcacctttgtaatttttccaactctctcctccctcctccactttctcccctcttccttggcctgctcttttcctcctgtgtcccatcatcaagttccactgattttccctccagccttacgttactgcatgtttctttcagttcctgttgccatcatcctaattatatgtttttcaacttgaatttcaattgctataatagtttcctcactgactttcccactctactctctctcctttccagctaatcccgcatgccatcactggagtaatcttcctggaacactcttgcagctttacttaatcctctgcttgaagcctccaaaataacttactgataacagaataaaacccaaagcccttatcaagcctgtaataactttctttgtctaacacaagcctccttcttcgaatttatcacctgatctcttcccttccctctagaacctgaggtttcagcaacataggtttactcattatctcccaaatatgcccaccacctctcctttctatgcattgtcttcctaaaatgcactttctgatgttgtctgaatcttgaccagtttcaaaaacttatcctaaatgatctctgctgtgaagtctattttaacttcctagaaatgtcttttctcctctgcagttccaaaggatttatatttcatactttccagttaccgcttatttgctgatctgtgtttttagttatgtgttatttaatttctccatttagcttttaagtcctagatgggcagggactgaatcttctataccatgaggaatggcatttgacagagtgataggtataaatctgtcccttccctcattcagtattttctgtttttttttttttttttagcatttcttctagacattgggctatgtgctagcagtaaaacataacaaggtaacttcctgacctcacagagctctggttgagtgaggcatacagagaagtagtcagtcagttgtaatgccataagatgcatggaatgatggatagtgaatcagatttgtggcagcaagaaggtaagtgtcaagcctagatgaggggcaatgggaatgcttctagaagtgaggttcaggcagagtctgaaagatatgtaggaatcaggtagttgacggaggccagatggaaagaatgttccaggcagaggactcagtgtggataaagctctggaagggtgagagcacactgaggaactgaattaagttccatgtagctgtattgtagagaatgaggtaagattgctaagtgtgatgagattgcagaggatccctgtaatgggcaaaaagttgacatctttggtgaatgttcaggagggaggacttccaggaccagatgtttgagtagataaaatgagggggcagcacccaggtgtttcttaaagatcgcttggtggatggaggtattggagggaagacgatgagttcaattttgaatttgaggtgcctatgaaatatgtatatggtgacacatagttgtagacaatttgaagctcggaagaaagctttgaccagaaaataaaaatttgggtgacatcagtgtatgataggatgaaatcatagagaaagagtgtgtagagtcagtgaagaagacttcaagaccaaaccttaacacacatcagtatataaagaacaagtaaagagagcagagtctgcaaagaatgttaagatggatcaggcaggaggaaggagcaaaataggtgagtgaggtgtcatggaaaccaagggaagactgaaatccatccattgggtttagaaatgtggaaaccattcatgaccctagcaagaatagtttctgtgtagaggaggggcagggaatgggaaaacataaaccggcccaagatagattgtagcgcattgagaagtcaacaaacaattatggtggaaagtttagttatggaggagacgatttaaagagggtagaagctggaaggaaatggagctgaggggcttttattataatattcttcaagctgctggaaatctgtgatgtttaaaggctgataggaagaattcattagtgataaagaggttgaccataagctaaaatagccagagttataactcctcttaaaattctttgcccagtctgtcctgttacctttcagtattctaaataagttaattccaaactaattttggacttcactgagatcttgttacacaagattgcaaattcctataaagtatgattcaaactattctacttatttgttctgggtagcatttagtgtcttaaatagagaaaattttcaacaaatattatttttattactgatttgtttctttattttttgagcaaatatatttaatttttaatttttgtgagtacatagtaggtatatatatttatggggtacaggagatgttttgatacaggcatgcaatgcgtaatcacatcatggagaatgaggtgagcaaatacttatttaatctccattgtatgccagacatttttctaggtgccaaggatgttaaggttaccaggccatacacactaccaggccatacataccccttgttctcgaggagtttatcatctagggagtcagttaatgaaataattatggattgcaaatggtacttaaaatggcatggtggtagacaatcatcttgagtggctactgtatatacacactcttttcctatgaacttttctttccattgttggagggagaataattacaagctattaaagagttaaatgacttaagatggaaagaaaaaggtagtcagtaacggagactacttttggcatagcgagtttactcctctgtttaccatttctaaaggtcatgggactctgatgcctataatgggctgtatgttttgcaggttttgttggttgatcattacttagcctctgagagactaaccaactctccatgttttctcttttcccttttagtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaaggtaagcttttttcattccgcccatttgccagacctctgttaacctgccaaacccacatagaagtcaaggatctgcgggtggccagggctggtattgaaacagaaaggagtacatgatttgtggcctgagaaatggcagtagagacagaatgtgggcccaggtatgtagctgcagtactttctaggccatagagagttagtgtctaggaaataagaaaataaaaaggagcccattcttctctagtgattctttaccaccaagagctaataaatgtgcatggtactgttctgacaaggcctgggaaatagaaagatgagcaagacagtgttctggcccttacagcattaataagctagtggatcgcacagtacctgctggtgaacttcacaattgaagaatgcttggttttagttgtaaacaatcatttaacctcactggacttcaatttgttcgtctgtagaggaaagtaaactaggtcacttggagctcaaaaattctatgacgaattcatccttttaaacctggcatttttataaatgcacacttttaaaaagggaatcatagaagtttactggctctaattctttaaaacctgagtccttgcatcaggagatgagattttgtttgaaagctacggaaagtagcttgttatagatataaaataatgcactttggtattttgtgtgtgtgtatgtcacaagaagcacaaaaataacaggtactgtattatttaagggtaagagaattgtgccttgtaaaactgggttttctcttttaatagaaacatgtaaatcctacaatttttatgacagaaattttatgagaaattcaaaaataatcaaatgcttgatctttctgattaacatttgataaaatttacctgcttagaacaagcagcatgaatttcacagctttatgactttggaaaagaatattttagtctcatgaatgtattactgttaaaagttttaatttctctctataattgcaaattttaaaaacatataaattcaggcttaatttttattttgcctgtgcccttaagaattgtgatggctggctgggcacggtggctcacgcctgtaatcccagcactttgggaggccaaggcaggcggatcacctgaggtcaagagttcaagaccagcctggccaacgtggtgaaaccccgtctctactaaaaatacaaaaattagccaggcatggtggtgggcacctgtaatcccaggtactcgggaggctgaggcaggagaatcgcttgaacctgggatgcagaggttgaggttgcaatgagctgagatcgagccattgcacatcagcctgggtgaccagagcgaaactccatctcaaaaaaaaaaaaaaaaagaattttgatggctatgcagcaaaatgctacacatgcatgcatgtttataaaatttactttcatgttttaaaacttttgatttgcctgttagttattcaggactaacaagttttcctcccaatctgttgtagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacaggtaaacatcatcaccgagcctgctttagcagtgtcttacagatatggtatcattttaacaagaaagccagacttgataaaaatgcttttttaaaaaaaaggctttgacaaactatgacttgtggccatatttttgtaaataaagttttattgccacactcatagccacacttattcatttacatactgtctatgcccattttcatgcgatgactgcagaattaaatagtccagtgagatcatatggtctgtggaacctaaaatatttactgtgtgtctttttacagaaaaagcttgccagtccctgatgtacagaatacatttatttatttatttgtttattgattgattgattgattgattgagttggagtctcactctgttgcccaggctggagtgcagtggcacgatcttggctcactgcaacttccacctcccagcttcaagtgattctcctgccttagcctcctaagtagctgggattataggcacgtgccaccactctcagctaacgtttataattttagtagagatggggtttcaccatgttggccaggttggtctcaaactcctgacctcaagtggtctgcctgcctcgtcctcccacagtgctgggattataggcatgagctaccatgcctggcttccagaaatgtttcaggaagtccatgattacctgtttctattttttcagttaggatgatctgtgtataaaatgtgtcaggcgtgagatatggtacagaatatatattccgcaaagatgcttgtaaatatttttgccttttgcagtagttttgttcatgagttttgaattcattgtgcaataataattcatgtcatctttgacaggaagtaatatttcatgttatcttttattttcttataaaaattcaggccgggtgctgtggctcatgcctataatcctaccactttgggaggccgaggcaggtggattacctgaggtcaggagttcgagaccagcctggccaacatgatgaaaccccgtctctactaaaaatacaaaaaattagcccggcgtggtggcaggcgcctgtaatcccagctacttgggaggctgaggcaggagaaccactggagcctgggagatggaggttgtagtgagtcaagatcataccactgcgctccagcctgggtgacaggagtgagactctgtctcaaaagaaagaaaaaaaaattcataacttgcaaggtgtagtgcatgagttgtttgaagtgtaactttaggcctacatttatatcataaagtgagagaaaggcaaaattttctttaaaactcatcattgaatgtgcatagcgaagacaacctaaaagcgttggttcctccactccattatgtggtaatgatggaggcttcgttctgtggtttccctcctgtcttttggttatgggttaaacccctcatgagaagactagatgagatacatttattattattcctctgcgatgtcttgaatattaaaaatatatcgtgtgtgtgtgtatatgcgcatgaaatacttgggagtaatagaactaattgtcactgctttagaaacctgggaaacacttttaggtagtaagtcaatggtaagattgtcacctttcttctaggagaaggaggggagattgtagacctgaatggaaggcagcatatgggaatggaaagagcatccttgtggagttgtaagaccttgattagagctgtgagcccagcactcggtaggagggaagtggcttccttatctgcaaagtagagataagatgtggggctcatgagactttgttaagattaatcaagataatgtgagccctgctttgcaaatattatagaacgatgcaaatattagcttagagaatatttatcaagatgagtcaaacttaagcagccatctactatgactgtttttatatcatgtgctttcagtaagataggggacagcatcgatcccacaaacacagccctcattggcctgtggacacctgaaatgcgactacaggggacctaacgtggcttttcattccccagttttgcaaatgcttttgggagaaggaacatcagtctaaatttagcttaaaagtaaagacaatgtttatgctaagggtagattttgataaggacagtggggctgaagataaactttatacacttcacagctttgcactgaactagtcttggagagggaggacaaatttcgtgccatttgcattgtttattcattccagcttaggttggtcatggagaaaggaaaaagcagatctttttaaaattgtgtgcccagtacctttctccccgtttccaagttggaacacagatgataaaaagcaagaaaatgaggcataacaaacttgttattcttgtataatattaggtgattgttaacaagaaaagatgaaaagatactattgacttgtaagcctagagtgtacaattgaaatgaattggctaattgatggagttacccaaataattaaaactctggaatacttttgtcttatctgcatacatctctgacttttggtctaaaagatccaaacagtgatctcaattcttaattcattttgcatgtgtactcactcatacacagcttcaaaataagacctgttttttggaaagcattctcagcatatatttattggtcttcctgttcatgaggaatgttgctggatgctaaagactgcccaattaatttgtgcaattagggtgaaccaggcatttaaaaaatacattactggcaaataatcatagtgtgtaggtgtatcctactatcctacaaaggattttgaaaacatttgtgctttcttgctgtggttggtttgcaaacgtagctatagccaggaggtataggtagattttaaatggcagataatccaaaacaaaaacaaaaccctggataaatgctcactgttgctttgctcagtggagccgtcttattaattgcaagtgtcaaacattgagactttcaatgcaatagttaccaataaacatctatgtttatatgttgctatgagaggtcatatacaaaataaatttggcagagatagcccttgtttctgtggcacattctaataattaggtagtaaacttgggattgaacaccaagatgaactgtgatcaacgtatttaaattcaggaaagctttgtagggtagaatttcagaactgtttggagggtggaggaaaatggatgattgatgaggaaaccaagctcacagagcagaaagggagagtaattgaacagaggaaagagaacagtacaagaaatgggcagggaagagttgtcagaagagatcagagaagtgaaatagcttgggattcttggcaggctattgcacaaatattaagcctcttaaatctgaggcatagtgcagtataaatgacttgctggcaaggtcagcgtgtcaggaagcccctttgactaagtgatcaactcagcgtcattaatagtggggcagcctgaccttatgtgcctcctgctgtgagacagtatagagtgcagaattacccatgaagtgttcttgccaaatatatctaacctgaatctaatcaaacccttagacttaaccccaagtttacagggaataccaagggtaaagaaacaagttaaaaacatcacactcagacagaaaaaacaatcagacattgacaacgtagggcattgttgcctggtttcttaaaaaaaaaaaatcagagtataaaagaaagtgagatgatgtttgtagaaagagacacaaaaaataagtgtaatatattcaccttaattaaatcttgattttttaaaaaaaagccagatctaagagatattttgggaatagttggggaaatttgaacatgagctctgtcttagtccattttgtgttgttataacagagtgtcacagactgggtaatctataaagaaaagacatttatttctcactgttttagaggctgtgaagttcaatatcaagatgccagcatgtgaccagggccttcttactaagtcaccccatagcagaaggacaggagaacacaagagagcaagggggagctgaacttgcttttataacaagtccactctggtgataactaacccactcccaagataatgacattaatgcattcatgagggaagaccctcttattaggtcccatactcctaacactgtcgctttcaggggattaagtttctaacacatgaactttgggggacacattcaaaccataggaaatgtcattagatgatattttggaattactagttttcttatgtgtggtaatagtattgggattatgtaggaaaatatccttattcttttttgtttgtttgttttgagatggagtctctcactctgtggcccaagctggagtgcagtggagcagaggtgacactgcaacctctgcctccctggttcaagggattctcctgcctcagcctcccgagtggctggaattacaggtgtgcaccaccacacccagctaatttttgtatttttagtagagacggggtttcaccatgttgcccaggctggtttagaactcctgacctcaggtgatccacccgccttggcctcccaaaatgctgggattacaggcatgagccaccgcacccagcaggaaaatgtccttattcttaatagatgaatgctgaaagttttaggggtgaaattccatgatgttcgtagtttacaggcacactttcttttactgcacctcacttccactctttgtagatagatattgtgtcttttactaattgaatgaaggttctggcagccttgcttataggcaagcaagtttttctgacagcatgctctcactttgtgtctctgtcacatgttggtaatttttgcaatatttcaagaccttttcattgttgtatctgttatggtgatgtgtgataagtgatttttgttactattgtaattgttttggggcatcacaaaccacaaccatataagatggcaaacttaattgatacatgtgtattctctgactgctctaccaactggccattcccccatctctctccctgtcttcaggcatccctattggctgaaacacaacaatattgaaattaggctaattgataataacacaatggcctttaaatgttcaagtggaagaaggagtcacacatctctcactttatttatttttatttatttatttatttttgagacagagttcttgctctgttacccaggctggagtgcagtggcacgatcctggctcactgcaaggtctgcctcccgggttcacgccattctcctgcctcagcctcccaagtaactgagacaacaggcgcccgccaccacgcccgggtaatttttgtatttttattagagatggggtttcaccgtgttagccagggtggtctcgatctcctgacctcgtgatccaccctcctcggcctcccaaagtgctggggttacagacgtgagccaccgagcccggccacatctctcactttaaatcaaaagctaaaaatgattaaccttagtgaggagggcatgttgaaagccaaaataagccaaaagctaggcctttgcatcagttagccaagttgtgaattcgaaggaaaagttcttgaaggaaattaaaagtgctactccagagagtacatgaatgataagaaagtaaaacagctctgttgctaatacggagaatgtttgagagaggtctagaaccagccacaacattctcttcagccagagctcaatccagaacaaggacctaactttcttcaattctctgaaggcttggagaggtcaggaagttgcagaagaaaaatctgaagctagtagtggttggttcatgaggtttaaagaaagaagccatctgcataccataaaagtacaaggagaagcagcaagtactgatgtagaagctgcagcaagttgtccagaagatcactgataaaggtggctacactaagcagccttatacctgaagaagatgccatttaggactttcatagctagagagaaagtcattgcttggcttcagaggacaggctggctctcttgttaagggctaatgcagctggtgacttttagttgcagccagtgctcataggctgttctgaaaattctatggcccttaagaactatgttaaatgtactctgcctgtgctatataaagagaatagcaaagcccggatgacggcacatgtgtttgcagtttggtttaccgaaggttttaagaccactattgagaactgatgctcagaataaaagattcctttcaaaatattactgctcattgacaatgtacctggtcactcaagagctctaatggagatgtacaaaaagatgaatgttgttttcatgcctgcaatcacaacatccattctgtagcccatggatcaaggagtcatttggactttcaagtcttattatttaagaaatacattttttaaggctattactgccatagatcatgattcctctgatggatctgggcaaagtaaataaaaagctttctggaaagagtttgccattctagatgccattagaaacattcatgatacatgggaggaggtcaaaatatcagcattaaagatatttaattaaattagatacttgaaaatgtcaaatcccacccttatggatgactttgaggggtacaaaatttcagtggaggaagtcactacagatatggtggaaatagcaagagaactcgagttagaagtggatcctgaagatatgaccaaactgctgcaatctcatgttcaaacttgaatggatgaggagctgctgcttatgaatgagcaaagaaagtgctttcatgagatgaaatcgactcctggtgtagatgctgtgaacattgtgaaatgacaacaatggatttagaatacgctataaatttaattgataaagcattagcaggacttaagaggactgactcattttgaaagcagttctagcatgggtcaaatgctatcaaacagtatcacttactacagagaaatatttagtaaaaggaagggtcaggtaaagctgcagacttcactgttgtcttattttaagaaattgccacagccaccccaaccctcaggaacccccatcctgattggttgacagtcatcaacatcaaggcaagaccctctaccagcaaaaaggttatgactcacagaaggctccgatgattattagcatttttaaagcaataaagtgttttaaaattaaggtatgtactttaaagcatagcgctactgcaaacttaatagacgacagtatagtgtaaacatgacttttatttgcactgggaaactgacagattcatgtgagtcgctttattgtgataataactttattgcagtggtcaggaactgaacccacaacatatctgagatattgcccgtagtttcagaggtattttacacacaagtagcacgaacttgactcttgagcggttcatatgcaggtgatcattgtattatcctttgaatatctcagtatattggaaaatattttagaaagaagggggaaaatattaaaatttcctagacttataaatagaatagtatattttaaagccgaatttaaaagctttcactgtaatacatttagagactttttagaaacaaacttaaagtttttaactgtttaatgggagtgttgggtgagtgtgaggtgacatgaggccaaggaagagaaattggccttgtgaaatgaccaagggccaatctaagaagtcaagttgaaaaaaaaggagatgactataggggattttgtgaggaatcaagcatcaggattgcgttacaggctgttgtgaagacaaggatgatgaagaaatgaacggttctgaattttcttctaaataaataaatgctaaataaatgctaactaaataaatgctcaccagagttgatttcttgacccttagcagggaggattgtgagaagatgagcaatgacatctttgttacaagcagcctcatccttgattaatattaggaagggtgtactcttaattatcagtcaaggaagtccagggtgttttcgagatggaatgctagagaattaatggagaaaattcagtgatcagtgaatagatttgctgatgatagcttaaattcatgaccacagaggacatttctttggattgcattataatgagaaaagagcgggaataatggagttaaaggtttctgtaatgttttctcaccttgacagagaatgccaacctgtagggaaaaaaacatttctattgttttgtttttgtaaaaagttacgtttagtatttcagagttctaaaaatatgtttaacaatcaaataaatcattggtgtttatgtgaattaggctgtctatataggcagtctctataggcatcactaaatctcctatattcaaagaacagaaattgatctcatagaactatatagggtgacagacaggagtggttttcttgaatataaatcaagtatgaagtagttggccggtcctaattttggcagagttaggtttctgtgctacctggagtaagttgtggtagtctacatatatgtgaaaacatttgcaagagtttgctcactgactgttagaatgacaattccagtggttacaatcaccagccacttcagggtaatctcatttttcacaggcttcaaacccgaacatttctgtggtagttatcatctctgaggagaggccaagtttcagaaaatacccctccaatttatttttgcatcataggaacattgaatatgttcatcttttttacataaaaatcaattgtataagggtgtcctttgtttttaaattggatctctttaacagtgacctaaattcaaagcttgtttggcatctgactttttgattgtttcaaacatgttttattgattgcccagttcctggaaacaaacatgtagtgacctagttatgccagatggtatgaaaaggccttctatgggaagcatttagaatcacagtatagagttcagggtccagcttccatgctgaacctgcccactgcctcgttgcacaagcctgtgctctttgttgaacccaggaacctgcctcgtaatcagacagaagcgttataaggggagacaaaaaattcaagtgcttcaagatttcctgtttcaagatgctgaaagatcagaaaattttacatataaatacctgagttaattaaaaagcaggtattccaggactctggaaaaccctgatttatacagcatatgttttaagtacagcactctaacacagataaagatgatcaaataacacatgaacccacttttatagtttgcaactataaaactcttagaaaatattttaaaaaccataagaaacaaacttttctgcatctattgagataatcaggtggtttttgtctttggttctgtttatatgctggattacatttattgatttgcgtatattgaaccagccttgcatcccagggatgaagcccacttgatcatggtggataagctttttgatgtgctgctggattcggtttgctagtatttttttgaggatttttgcatcaatgttcatcaaggatattggtctaaaattctcttttttggttgtgtctctgcctggctttggtatcaggatgatgctggcctcataaaatgagttagggaggattccctctttttctattgactggaatagtttcagaaggaatggtaccagttcctccttgtacctctggtagaattcggctgtgaatccatctggtcctggactctttttggttggtaagctggtgattattgccaccatttcagatcctgttattggtctattcagagattcaacttcttcctggtttagtcttgggagagtgtatatgtcgaggaatttatccatttcttctagattttctagtgtattagcgtagaggtgtttgtagtattctctgatggtagtttgtatttctgtgggatcggtggtgatatcccctttatcattttttattgcgtctatttgattctcctctcttttcttctttattagtcttgctagcggtctatcaattttgttgatcctttcaaaaaaccagctcctggattcattaattttttgaagggttttttgtgtctctatttctttgagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgcttcgaatgtgtcccagagattctggtatgttgtgtctttgttctcgttggtttcaaagaacatctttatttctgccttcatttcgttatgtacccagtagtcattcaggagcaggttgttcagtttccatgtagttgaacggttttgagtgagtttcttaatcctgagttctagtttgattgcactgtggtctgagagacagtttgttatcatttctgttcttttacatttgccaaggagagctttacttccaagtatgtggtcaattttggactaggtgtggtgtggtgctgaaaaaaatgtatattctgttgatttggggtggagggttctgtagatgtctttgacaaaattcaacaacccttcatgctaaaaactctcaataaattaggtattgatgggatgtatctcaaaataataagagctacctgtgacagacccacagccaatatcatactgaatgggcaaaaactggaagcattccctttgaaaactggcacaagacagggatgccctctctcaccattcctattcaacatagtgttggaagttctggccagggcaattaggcaggagaaggaaataaagggtattcagttaggaaaagaggaagtcaaattgtccctgttggcagatgacatgattgtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttccaagataataaaatacctaggaatccaacttacaaaggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatgtatagattcaatgccatccccatcaagctaccaatgactttcttcacagaattggaaaaaactactcaaaagttcatatggaaccaaaaaagagcccacattgccaagtcaatcctaagccaaaagaacaaagctggaggcatcacgctacctgacttcaaactatactacaaggctacagtaaccaaaacagcgtggtactggtaccaaaacagagatataaatcaatgcaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatctcttctttataccttatacaaaaattaattgaagatggattaaagacttaaacgttagacctaaaaccataaaaaccctagaagaaaacctaggcattaccattcaggacataggcttgggcaaggacttcctgtctaaaacaccaaaagcaatggcaacaaaagccaaaattgacaaatgggatctaattaaactaaagagcttctgcacagcaaaagaagctaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatggagccaaaagacacatgaaaaaatgctcatcatcactggccatcagagaaatacaaatcaaaaccacaatgagataccatctgacaccagttagaatggcaatcattaaaaagtcaggaaacaacaggtgctggagaggatgtggagaattaggtacacttttacactgttggtgggactgtaaactagttcaaccattgtggaagtcagtgtggcaattcctaagggatctagaattagaaataccatttgacccagccatcccattactgagtatatacccaaaggactataaatcatgctgctataaagacacatgcacacgtatgtttattgcggcagtattcacaatagcaaagacttggaaccaacccaaatggccaacaatgatagactggattaagaaaatgtggcacatatacaccatggaatactatgcagccataaaaaatgatgagttcatgtcctttgtagggacagggatgaaattggaaatcatcattctcagtaaactatggcaaggacaaaaaaaccaaacaccgcatattctcactcataggtgggaattgaacagtgagaacacatggacacaggaaggggaacatcacactctggggactgttgtggggtggggggaggcgggagggatagcattaggagatatacctaatgctaaataacgagttaatgggtgcagcacaccagcatggcacatgtatacatatgtaactaacctgcacattgtgcacatgtaacctaaaacttaaagtataatgataataaaaaaaaagaagaagaaaaaaaaagaaacaaacttcaagattaaggtctttatacatattctacagaagaaaataaactttatgtggattaggaagaaaggaaaggactggtagttgatgtggaatcctgaaatcattgtgaaaactcttttttcctttaattattggtcatataaataataagccttagggcaaaattgggttaaagtgacacaagaactgtttgggattctgttagagatgccagaagttgttccagcagttctgtttggacaggaaaaatggaaacagaatggaccattggagaacaagattatctaattgaagataggtctcttttggcagatatgttcagtaacatcctaagctctaaagcttagcactggaacacacacacacacacacacacacacacacacacacacagagcattctaaagggccaaatagatatacttagcttttgtttaaaaaaacttaaaagaataagcttaatggagaaattaacaggaaaatatgagctcattgaagtggaaagtatcctaattgcatggctgaaattacttttttttaaaagagtttcaatacttttgtcacaggactttgaataaagaaaaatatttcttggtttccactggacaaaagccagtaagaagctggggaaatagatgtgatgcctgccaactccacatgggagaaaaagatgggtagatggttgggtcgatgcagatgagatgggcactttggaaatcttttctcagtgatgagaaatggtgttcatttaggggagctgagacattgagttctgctcagaaacctgctcttgaatttccgcagtatctctcctgtcctggcaacgtgaatattactgggatgaagcctaaatctatgattacaaaacaaacaaacctagttttatcctgacagaagtaatgccagaattattgtaacacttttcacactggttattccctaaactgagtccataaactatgtaaatagattagaagtctaaagaaaaaaatggttataaaacatcttacttatgtggaaggggaactgagccaggctgggtcagtagagggcagaggtgaattgtggctctctcttcctccccatcgcctaaggccacatgcccttatggatagggccctcccaggtgatcttggaccagtgcagtggcctgccttcttttggaggagctgctgggcagtgactggggaaggtgaggctgaggctactagacatctgtcttcttgctgagcagagagctcagttggagtgtgtgctgattgcatttattgaagcttggcttccttgaggtggaataagtcattaacaccaggcacttcctatgccatctgggcttttcttcagtgtcccactcaagtactcctttggcataatctaagaaatatttaattgagtgttactgagtctcttgtggctctaaaatggctgctctctgtagccatccgtgccaaaccttacctgcgtcaacagctgaaggtatcactgaaggtgtcctacacatctcactgataggtgctgggacttttaagtgttagctggtcttgttccagcaacctctgccagattgactttcgcgcaggggccctctagcctggagtcaagaaagatcagcagagacaggggtaagatccaaagagggaaaatcaccgcatgtgagagagaacatgtctgcatgtcactgggctcctgccagtggagaggagaactgctcgttttacttggattgagaatgtagggctgggacattaggataatcaaaatatagattcttagaacttcagagaatgggttgtgacccagacgttacccttcctgcggcccagtatctggtctttacccaggtagatgtcttctgggaaccaaagaggctgtcagctttaagggtccacctgcccggacctgtttaagagaagcaagtatgtgtttcttcattggttctccctaagcccctcctctcagattttttttcattttattggcaattaaaatgcctttatcatgacgtggaatatcaaattaccatattttatacctctagggctctataaaataatatacctattaataattagactcctgttcctacataggaataagcattgaaaataataattatggagcagctcagagtggaagcatgttgagctacttctgatattggcaaagtggtaagattttatggtcactgtgtttgaagatgacagttctgagcatgttggaaatagttttaagagacgatggcttgaattgatggttgattttggctctatacattttaagaaatggtttcaggatttatagctggtatttctgggctctgatggtctgatgtggctctgtgctatccctcagaattgagatttgctaaaatgaggaagaatcatctggtttactaaaaaaatcagtcctctgaaatctgccccataaagttgtagtgagagaagcaacattttttgccgtatattgaagaggacagagttctctcctgaaccttctctaagaccatgatagtactgtttttttcctttctcatccttccattttttttccctcttctgtctcctttcttaaataaaataatttatatatagaattgaatgttctatttcaacaaggtcactgtatgagactgtgcatttactctagtgacactgccattgggcaaatagcttggacacgtctgtgaacaagatttgccaccgttgagaatatttaaagtatgtctctagccttgaagaacattctaaaattcaaaatattttgtatatttctaaatattttaaacaaagagagcaatgcctccaagatgatcactttgcagaagactggtttagaatctgcaagctctaacggagttgttaaagaatatggtcttaacattctgtggcttcaagataagcctctttttttttttctttttctttttttaagagatagggtctcactctgttgcccaagctggagtgcagtggcaggatcatagcatgctgcaagctcaaactctcgggctcaagtgatcctcctgcctcagcctcccaagtagctaagagtataggtgtgtgccaccatacctggccatggggcaagcctcttcgtaagacaatgcatttttagaaaactgatagctgatttgaccttcaaaacaatcaggagaaacatgaaaagtagacatttatgtctcccatttatttatgtgaaatttgaggctcagagattgggactagcttgtgttggtatttccaagacaatagctctctttccattttagcaaattcatcatatcttggccctcagtttcttcatttttcaaataattggattggctaaggagactaccaaggtgtctttgagccctccaaacctctatgatgatttctacatctttgctcttttctgcaatcttagacaccactggtgctgacatatgcacaggccatatggacagatcaatgtcaaacagagtgaatgaataacctatacttgtctctcaaatgctactgacttagaagactcgtctttagtatcagtttctctgaaaagctttttagtacttcttcaacccacacttctctctgttccttaaatctttattgcatttagaatctaatcagacaattttaaatttaaatattttaaagttgttgcttttgtgcctcgtttctcttcctcaccagcttgcgctttttataaggccaggatcacttatgaattgatcttagaactaggcacacatgaattgtgggtaaatatattagattagtctaggttgtgcttcagtaacacattagcacaacaaagtttacgttttgtgtgcattagacatgttagaggtgagcagaggactctgctctgcatatttcagggacttgggttgatagtggttccatcatgttactgccatgttatccagaatatatggcttccttaattcctacagcagggaacgagaggttctgcaaaggaccacactcattccctttcccatagccccctgttcagaatgagtcccatggccatacctattagtgctattgatggaattatgcctcccatccccaaattcatatgttgaagccccaaaccccaatgcagctatatttggagacagagcctaaaaggagataactaaggttaagtgagatcataagggcagggccctgatgtgataggaccagtgagcttgacctctctgttgctttccccacacacttgcacaaagaagagtccatgtgagcacacagccagatggcagccacccacaagctaggaggaggggcctcaccaaaaatccaccatgttggtaccataatcttgggtttccagcctccagaactgtgaggaaataaaaaaaaaaatctattgtttaaaccacccagtctacggtattttgttatggcaatctaacacatagttttggagctgggaaatgtggggaaacaagtggctctttggggaacaatggatgtttctgccagaagagtcagggcagtggacaagacagacatggttccctgcacccagggatctaaatgaacctgttagtgttatttgtggctttcagtttttctacatgacttgcaaccaaaccacaggtaattattagttttgagttctgtgtacttggaagagacacagaaaaaactgaaagcttaaccaaatgaggcatgcattacaatttcacatagtgctatgaggcctaaaatgtttttggttcctttgattatctctttatagacatgaagcttaatatagaagatttatctcaatatggttgtagaaataagcattggaggccaggcacagtggctcacccctgtaatcccagcactttgggaggccgaggcgggcggatcacgaggttaggagatcgagaccatcctggccgacacggtgaagccccatctctactaaaaatacaaaaaactagccgggcgtggtggcagcacctgtagtcccagctactcaggaggctgaggcaggagaatggcgtgaacctgggaggcggagcttgcagtgagccgagattgtgccactgcactccagcctgggcgacagagcaagactccatttcaaaaaaaaaaaaaaaagaaaaattggagaagataggcatttatgttcatcattttgggggtgatcaggttgctatggtgatagtaatcatggctatatgcacatctttattccctctctcaacatgagtctttctttttagacacattcctagtaattaaacttaaaataaattcgatctactcaccatctagtactaggatttatcacatgatttgtgttgttttgccccaaggaaaggctaacaggaattatgatgtcagaatataatcatgataatactgtacttaaattttctttttgcaacttaagagcaaaacacacatatcacagcctggaagaagacttgactgttgaaatgttcaaatcattgtagaggtggagaaaataggcagcacagattctatcttttctttagaaaagatgtcaagtagaatcataagtttcatgcttaagagggttttttttcccttcatatgtgactttaaaaaccatttttgccttagtgtaacttttaaaataccgtttcataaactaaagtagttgtctggaattccttgaagcccatggtttggcttcagcaggttttaaacaaatacactgtcagaaatcgatgtggatacatttccagcagttaaatgctctagtcacagtagatactttgtaaaatcaatagcctgaaatatcagaggattatagttgtatcagattccccaaatgcctaacattgttttaattactctaataaaagaaagctgagtggacttaaaaaaaagaaagaaaaaaaccttgcctataaagaatgttctgctcaagccaaagcaaatttttttacaagttctcttagaaaatctggaagtatttatgcattttcctcttcttatgagacaatgcctgttacccagccagttctgcattgtacagtgctctttataacaacgacccttagaacaagttgatcaaatatgttgctctagttgcactagcgataggggttagagatttagaactttttactttttgatgcatagaaataagcatatttaatgatctagtactgggacactaaagagtgttcatgagattttctagtttaatttggagccatagttgattcaggggctagaagaacaccattttgctcagaacattgtcaggagtcacttttccagagtggagatgtgtttatatcatagtgaaaagacagtttaagaggagcaaagaagaggaaagacgaagtttggattgatccaacaacctgttacatgtagtcagtacttttcccataggggacttcattctgattcttatgaaaagaagttcaagatttcaaaaaaaataggattaacattcctcatccagattcatagtattgatggtgtagcttttgtttactagaataccccaaggctttgtgccagaatgttagagtaatgtgcttctgaatgtggatggaggtgaggatggcacctgcatgggtggaataatttatgggacatacctgtacagtgtaggttgatggattataatgtgactttataatggtcacagcccagtacacccaagatctgcatttccatgaccatcttgaatcatttctgagatcttgcctattgataattatatcattcattatagctacccaatataatctagaatcgagccatttaagagctgtaactcttctcaggaaggtagagctgccctttgtgtgtacaggttagcaggaaagggctggcatgacgtagggtgaggaaaaggcagcccattattatggttatccttgattaggttggcctaggtcagggtatgaggataccaccaggcaggctgtggcagcatggaatctaatgtatcaacctggcaggcagggggcacctgaggaacaccgaccttcataggattgccctgccacgtagctccttggctgccctcagccctgccctggagctttcataaaatcatagaacttgggcacttaaatgagtattagcaagtagtctgtccttacaattttatgggttgatgcaactaacatccagagaggtagatcagtttgcagttgagtttgtgtgggaggtggggagtaaaactgaagattttagtgtctagtccagtcttgctactattttttttttttttttttttgagatggagtctcgctctgtctcccaggctggagtgcagtggcgcgatctcggctgactgcaagctccgcctcccaggttcaagcaattctcctgcctcagcctcccaagtagctgggattacaggcgcccgccaccaagcttggctatttttttgtgtgtgtttttagtagagactgggtttcaccatgttggccaggctggtttcgaactcctgacctcaagtgacccgcctgccttggcctcccaaagtgctgggattacaggtgtgagccaccgcacctggccagtctttctactattgcaccctgactcttaggccatttcttctagggatggaggattcacaagaaaccattgctatctaaacctgaaaggacagctatattctctgggacctgacttagttagagagtcgcatgctgtgtggtgttttgtgattgggccatggatccttgaggggaaggagcacagtgagctccattgctgttgcttcatggtcttggttctctggcaccaaaacatagcaccatgacaagtacgatcgtgatgtccccaaagtgaaatcatctgccgcttgaacgtcaatatttacaagttgaattattggaattccatgataccatgttgtgcttcttaagcagagttaaaatgaaatctatacaatgacatgccctccacagcattaattcactgagtatttctttactagccagagcacttttgagaaaacctgaatatttttagcaaggtcttaagaatatctttttcttttatttctatatctaacttacgtgtttattttatacatctcttatctgtaggctgaatctgggatattgtatatcgaataactactagattaattgctcttttgttaaataagcccaggtttttaaaggaggagcctgggggaagagatctaatacaagcccagtggggcttggccatatggctgtctcacatacagtccgtctcacatgtgttgtctcagtccactcaagagctccatgaaaaacggatgtctctagtgccattttatagaagacaaaataggcagagagacgttgagagttttgcctatagtcatggaggtggtaattggtaaagtgaagatgtgaatgtttttctattttcaaaagctgccctcttgccatttacccagttgtgggtcatccttacattgcttttcactgagttcaaggggaatgtggttgtgcagaaaagtctgtttcctgttcataatgtgctaatgctgcaaggcaagtagatatctgggagtttgctttgtgttcagaagtctttttgctgtggctggacagcatttgttgagataagatattattcgtgctgaacttaactcctttctgctgtttgtttgagaaaaagtacagtcaatgggcctccaatcatctaatttcaaatttttgtcctcttgttattcctgattatgtttatctccagtatagtttcttccttttcctccctgtgaatgatatactttgtcctggtaattcttttttacatttcaggggaagtactagatatagaacactttacctttataaaaacattatctctttctccttttcctcctcttcatcctcatcagtctttctgtacttaccattgtttcaaagatgctaattatttaattggaagcaatataaacttttttgctttgagaaaaggaactatgatgcttcttttcccctgtttcctggttgatttttatatccaactgtacatctaatctcaaatttggaaaaccctccatggtttagctccacatcttctctgactctgcacacccactctttgttccttcgtattgacctgccttcccctgtctttaccctcctccgttgccactggcttttctcccagctggtggttggtgttatgcttagctagagctgttccatctctttggaatctctctccccagtagagccattgagtcacttccttgtttcagttcttgcctaaacacagtcctacttactcttgcaagagttacaatgaatcagacttctgttttatttcatgttttccctcagtgcagtctctacaagtattttttgaaacctgtatcactttaacgttttgggttctctcctttggctctaaaagatgttctctactgaaacttaaaatattttatactttattatataatagtccttcatagcataataaaatgagttatatacatgtaatgaagacaattaataagagtatttcagtttatcattttttagtgttttaaatagtaagattaagtagtaggttcctgacatgtggctatctttatggagtggcccttttaatagttaaatatctgaagacttttaataaatgtgtcctgagagtttatcaaatggctagtactttaatgctggttataggttttacccacaccaggcaccagttgaggaggatgattggggcctggagtccagcccatgctctgctcatccaactccatgtcctgatgcaggtcacatcctacagctgcccttttctaatccccacacaggggttgatggagtcccagtatctgggattggacaagcatcatttaatctcacaatcctttggggttgggattactggctcagagaggttggatgatttgctgaacttctcactgctagtaagaagtttctgggatttcaatccaagtctaatgactccagtccagcactcttttcttaccaccactgctggatcctccttccccaggactctgcacagtgcagcaaacactcttggaatgagggtacgttgtaggcactataggtaccagcgattttaatacgtgaaaattaaatcttataaaaccttatgaaaccatattccaccatctatcacaatctcttcaaatcatcattcagcctctgaagcaactccagtggggagtttttaattgacaaaaattgtaatccttggttaccagataagttttgaactatctttcctctcacattgataggcagatgtaaaagtgtctatgatcacagcccaactttgaatatcagggaagtgctacagtattacctcaaaaatgagattaaagtctgaagatatgtgttcccagtcaggccaagatttagatacatacattaccctgcaatctgtaatttttgatgactagcttcaaaattaaaggtttttttcactattgcttataataattttgtgttgtaaatgtagtaacatggatatttgtggaataattgtaatgattcttgaacagccttaccttctgcatcacagtgttcatacagatgtgcacataggaagggttgaaaagttattttcatgcactcagtgttccaggaatcatgaccagtgcactgctgaatcaaggctgggagtagctttgtttgtttttcttccttttgccttatttgtataagtgctgtagttagaggcccaggcagcatgagcaactctagagatgtggaaatgagggaggaggagataagacaaaaggaggtggttaggaggccgtctgcctagacgcagtcctattatagatgtgagagcagcagaaacacttgagttttgctgtggtgtgtagtaacttgtatttcctagatgggataatgtaacctatcagtatgtagtgaccacagaaccttagaccttgcagaaatcgtaaaggtcatctgcttcatatcctgggcatccctgagagatgggtttccatggtcagctcctagtgaagtcagcatcttccactgttaaggagcattaactgttgaaaagatcttctgcttaatgaggttgaatccactctttctatgatttgtagcctttagtcctgccaatacaagttaagcatcccaaatccaacaatctgaaatccaaaatgctccagaatccaaaatgttttgagtaccaacataacactccaaggaaatgctcgttggaacaatttagattttgtacttttggatttgggatgctcaactggtattttcaaatattctaaaatctgaaaataactaacatctaaaatacttctagtcccaagcgttttagatcagagatcctcaacctggaccttcatcgtgcaacaggcttcctcttgctcagggtatctgaacactgccatcatgtctgcacgtagtctcaccgttccgcctttcctcagttgatccttacaggacctggttgccagaactttcatttctctgcttgcactgcttcatctaggtcatgcatgggctgaatcctgggacagctgtgtagggttgtagtgtcccttaatctgcagcccaaggttgtgtgagctttttgaggcactgtagcttgtttgacccaataggatttttgttttggatttgatttagctaaatattgggttgtaaatttagcacatttctccaggattacttattcgtaagacacatcctgaaatgataaggctttccatgttaatgtagtgaataattcacaaaggaggaattccatttgtgtttttaacttgtaaaacatcacctcaatctgtgcgtaaaaatatagttagcgtgagcctatatctgtgtgattacatctcaccagaaagcagaacctaacagtcatagacaaggattttctgaatgctgatctcatcctattccatgtgattctcttcagtgtggccttttggtgtgggagagagaagatctttcctctaccttcttttcctgtaggcatttcctacatccaggtgagaccctatggtgttcagtggtctcttgggtgagagccctgagtatggccacagagatctctcagatggagtttctggctgcacatcgaagcctcttcatagttaaataactgaagggcatatgtagaactttgagtcttgttataactgtgacttcatctcttgtagcttattcttatactgtgcagacccagtttcaagacacacacagtgttgtggtaccacctacactaccatttatttaaacaatttggatggcttatgctgctcttggctgtggacctgcaaaaacaaagccatgggataaagcggcctgaatcatgtaatgaaaaccttgtacctttctggaggccctgttgagaaaaaatgatttatttttgccctaccaaataaaacattctaggaatccaaggtgaaaattggattttaactgctactaacattttaagcatataaaatcagcaagtgttgagtgtttcgcttgattaggagatgaacctaaagagtccagtacaagaatgatctgcatatgatgtgaactggtgtcttacataaattttataaaactggaaataaaccctaagcatgctttggcagccaggttgcaacggtggggacctctgtgtttttacagaatcattttgttcccagtcttaggcctgggtcattgttcgcctttcctcccttcagtccttcatatttcagggttacacgttttgtgattaagctcaaggagtatggaaactacctgattccagccccaaatatgtgcctgtcttctctaaggttcccgtttgttctcacgttggatctgtctctccctcttcttctccccactctgcgtgtacgtgcctgtgcatgtttgtttcgtcatctctgtgactacctacccacctaccactttatcactctttttttggtccagtcttcccccgtgtctgagactgttcatctgtggccctgccgctgttccaacctcggggactttccctcactgcacgtggttaaacactttgctgagagccctgtcttcaaacagacttccccaggtcattgtgttggtatctggcacacaacgtcactcattgtttatccagttgtgttgttttataagagagtttctttatctcaaggaatgcgtgtcacgtgtctgcaggagttactgccccggtttcaagagatgtgatggtcttgggctttactgacttacactagggcttttttcagtgccttccccagaattacgtgttttttcaagttcatctaaaaaaaaaaaaagcaattgttttggtatgcctagttttgcttaactcagaatgtctttaacacctgcttttatattagggaagttcattttgtctcgtagggtcgtttcttatggagtctggtactttcgagagggcaattagactaacctgtttgattgacaggaccgtttacaatctactccactcacacgccttctactccctggggaatccgacaaacatttggggcctcaaatgggacatctggagtagggagcttttatctataataataataataatgataatggtaatgatagctgacacatgtaagtgctcagctataatgttcagcattgcacatgccttttttctttcatgtttcatgaccctaggagaaagatactattatgcactctacgttatgggtaggaaaatgtctaagataatgcgtgtaagaagtcctacagtcagaattcattctcaggcctctctaactcctgagtcacatttttaatcactatcatatactgctgttggagagcacacagcatcctgttgaaatcattaaaaataataaaaccttagaacatcaaagctatgatgtaactaaaacttagctgagccttctgtggtttggtcttgttttacaatttggatatgtagttacttagcgcctcagtcagaatgttgcatgcttggacctggcagaaaagaaacgctgcccctggaggcctgccaggtgactggtgtctactacttgctgtccttctgagggccaccacctgcctggaccttctgtcaccacactctgctcactagcctggggtatggatgctaaacttccattggttttcttttgttttttgttttttttttttgagatagagtctcgctctgtcgccaggctggagtgcagtggtgaatctgggctcactgcaatctctgcctcctgggttcaagcgatccccctgcctcagcctcctgagtagctgggactagaggcacgcaccaccacgctggctaattttttgtattttagtagagacagggtttcaccatgttggccagaatggtctcgatctcctgacctcgtgatctgcctgcctcggcctcccaaagtgctgggattacaggtgtgagccaccatgcctggcccctccattggttttcacatagccattgcttgcctggatggcctacaactagcttgttccttagttccctaggttgtttgttcctttcttcatgcagcgtttcctgagcatttgcaacgtgtactgtgtactggaatataaacataagatacatacgcatttaacaaaaatgcatctcagaggcagtagactgtatagacagtgctgtggggtaaaaaggagggaggaactcattggaattaaggagataggggaggtttcatagtgatggttcttcagagctattaatacatctcatgggttgaataaagtttattctgggaaagaaaaaaggggagggtgttccagccagacatgctccttttggaaggacgtgatttgttcagaaaataaagagccctttggtatgtctgcaggatagaggtggatggggacaagagattgccttaggtgggaataggaaggaccttatagatcattctagagtgtgccattttcagacaatggagagtcagtgaaagtttttaatcggtaatgtgaccagatttgtctttggaaagacaactctggaaactgttgggaggatttttgtagaggctgaggcagagaaaggcagaataaccccttggatgctctgtgtttgcacaggagacaaaaatgtggggtgtgttagcctgcatagcaggggtggagagtcagctggtcctcccctcaggctggcctttggatgggtccacagagcaggatctgttttcttaggcacttcctcaccccattgaggtggtctaacttcaggcccctgcctctcagctttttctcacttcctgtggttgaccaggagtcttacctggtcttaacactggacaaccagtgttgcaccagtagcctctaagtcctactcttctgcctgctcaagctggtctcgcttaaacatgctggcaccttcctagcttggctgacctccctgggtcagaatacttggctgcctggagccttcgtctctgctagagctgatttggcccagccagtaattgtttcttctgtcctgtctgtgcccaggccttggggttataggaagaccagaagcctcctgtaggtgggacctgtgccatcttctcacattttacacacatgccatacccttaagagttatgttccctgatggtccacacaagagatttaaacagacagatacaactaaaatctaaaaagcctatattgatcttacacactatgaggctcttattaagaaaaaaaggcattggaaatttaagttttatgaagtactctgagcagtgacagattttcttagactagaaaaacatcaaggtgctcccatttggaaatgtacttgttcatttttgtgttgtattgatttctgtccaggtattttctttccaagttttatagtttttttcctttctaattgtgtcgataacaagggaactggtttatagcgtggctgtgagggacagcagtgctctggggctgggcatcctgcactcaattaaccttcatatttcacacctaatcattgcagtgtggcaaagcgctccctggcctttcaaagcaagaggactgctgtggaactgtgggtacctcctggggctttaacaaatgccagaaatgccccaagaaaccatgtaagtaatgtttcctcactcctttgcaggttaatgtagcatatctgttttttatgattactcctttaatgatgaggcaatattagactttcaaagaactctcctactgaattctagaatgtagtactatgatgtgcatttccagaaaatttgcaagtctgaaaaagttttcatgtcaattattttgtaataagcacagttattaattatcctctttagttggattacttatggggaaaaaaagtcttaagtggtaatgagttaaaatggactttttgtctcaggggaagagaaaataagatctcttttaaaatggtaaataaatgtttcaaaccctgtaaaaagtacagttgttatttcctaggtttaaattccttaaatgagatttttattaatgtccacaacttatgttgtagtttttgttatattatcggttttcaaatttcattaaaaggaaagctaaaatggagaaataattggttgttgatttgtaaaagagaaatttataatcactaggacacaattctttcccattttttctgacactggttttatgctgtcacagacctcagcaacattaatctatattaacacccccaggctttgatttgcttttattgttcagaacatgttgatttgaataaatcagatttacacctttttaatactctattcctgacaataatttgtacctttagtttttcaatgtagtattaactctggataactgatttctaataaatacttttttttctttttgagacggaatttcactattgtcgcccaggctggagcacagtggggcaacctcggctcactgcagcctccgcctcttgggttcaagtgattctcctgcttcagcctcccgagtagctagggttacagacatctgccaacatgcccagctaatttttgtattttcagtagagatggggtttcaccatgttggccaggctggtctccaactcctaacctcaggtgatctgcctgcctctgcttcccaaagtgctgggattacaggcgtgagccactgcgcctggccataaatagtttttagagacagaggtgactgggtttaagttgagctttctgacccttattcatcatgtttttgccaagagagcaagtgatatttttgtcagtcatctttctttgcctcatataactgaagtttttataatttttttattctttgtactgcaagaaatttctcatttgctttaaatgaataatttttgtttactcctcttatctgttgatttgattgtattctcaaatgccttttaaacctctatattcaatctaggatttgccatctgggcattagtattccatatctctttcttacattatttgttcttctaccagtataacaattcattttaagtaattgtctctcatttggacttctttgtctcacaaacttacagattttctaaatgcctaaagcaagtaattttatttattttgttgatactactcatctctttttagaagactaacttgtggaaatgcccaccgaagttcctcataattaatgaattcttcatttacaaaaataatccatgtaaataaggacattttcagtactgagagaattttccaagcagatgttctaagctgattcgatgatcatttgcaatgcaaatttccaggaagtaggttgagtgtgatggttcatcgtcactggaagatccatttgcttaaaattattttggcaacctgaccaaagggatagctatgatgcatttggtttgatttaaaaattttagtgtttgaagttaggtagccctgagttcgactcccagctctttcatttgctattgagtcttagagctcattaagcaggaatctatacctaaaacgttgaagaggcgttgccatctttttttttttaaacctgcctctttgtttaccatgtctgtctgtctgtaggaatattgaggaggatgatatattttccactgtttggtctaagaattaaggatgagggaagttaggttcatagaactttgttttggtcctaagtctatgttctctaatattaaataccttccccatctgtcttatttttctttttcattttcatttacccccttctttgtgtatcttttgcttagctgcttctcttctcttgtgtccaaaccccaaagtagcagggatgtgatagacattaaaggtaaagagattcctactgtccttttattttttttttaatccctaacttccactcttgaccttttgtcgtttttgtctagaattgcgtcatttttatctaagatgagttcactgatgtctgtggtttgtgagctctgtattttaatcttgataaggacttagttgaatgtgaaagtgcaaagttgctgtcacttttaactaaatgttggtgaaaaaaatccatatgttggctcatttaatgtataaaattgaagagactgccttcacttcaggaagggcaatgtggactatgaatgaagtaaactgttaacatcttgacatttattctgtttgtgtcctcttaagtgactcactcccaagaaacacactcagggtcacattcttcctgtgtcatttaaaaagttttcctttccttggttgggactcctctctaaatcatattcagtttggaaggaagcagactttccttggctttctacgctatggttttgtgttccacacctcttttttttcactcaaactagttcaaactttagttttcaagtggcttttatttaacatttgaagtttttgtttagccacatacagaaagacctttcattgttgatcattttttttgctgtgaatacttaattttaaatctgcaaatgatttcttaaatagtttgtgacccattagaaatgtgcctagcatgaacaagtcacttgtcctttaaaacttttgagaagaaaatgaacataaaatcctaagctgaggaggactgtaagagattgcctggtctggctctctgccttcaagtagatgactgctgaaagttctaaaacaagttcatatccatctcttttgactttgaggaatttgcagccagagatcccacagtctctgcaggatgcctgctctagaggtctatgggacaagacagacctgaggccaaggagctgaatggagggactcccacacgcccatatctcccgtcttttaatttgcctttcccagatgcctcactctgatcttctcttttaggcattcgggggaatctgaagagaggggaaatacagcaaagaaaagaattgaaggagaagagggacaccccagtacatattcaccctgttcctttagtggtgacagataaagagcatatggggaggctgaaataattttattttttaagagaaaatttccctttttattttctactttccccttttactcctctttcaagtcttttttagtggtttaatctttcatcccattttgattatagcttgttttctgttgcacagtagcctcttaatagaagaattccttactgcaggacatagcaatggcatttgacactttgggagtgcttatcacacttaggccctgtggtaggcatttttcatgaattatctctaaattgcagaagaattcttccctgctcagtagatgggaattaccctcattgtatagaatttctgtgtgaaacccaagaggcttgtttcccaaggtcacagctattgataggaagaggatttgaaatccacttctgccacatcccagaactttggctgcatccgctatgccaggtgctctctcaagtctcactctagagtatcagaatctcaggaaatagggttttgttgagaagttggtgattgcaacatttgtattgtttgcatattctgagtgtagcccttttaatttcctgacttcctctcatcacctgcctattcttctctggttcataatggtgagaatcatctcatgactgggatacccgatccagcaattaggatgagtgtataatttattgtctaaagtgggacactttggggagtaaagtactgttaattaactttgctggaataacagacatcacccagaatgttccaggacgtgtagtaaccctacctacaatggataagaaaatccaaaacctaaagcacatcaatggggaggaatagatcctttgtgatggaaatatgtaatcactaattagaagaaaatgtacaacaatcttaggattgtttcagttaacgtaataaagatttactgataatttcttgggactttattgcaaaataagtatcctgaaaaataagcagaatgggaaaaaaattatggagatatacattggtattggtttcttatattaataaatgaataagtaagtttgctgatgccttaaatggcttcagatatcacttacactagtctaagattgtaagaatttaagtatgtaacaaagcatttcttcccttacagcttatcatggatacaaccaaatgatggaatgcctaccgggttataagcgggttaacaacaccttttgccaaggtaagactaactgaattcattgatgtggactcaacagttgttttggctttttagaaacttcagttgtttgccacggcttgctcattcgcccagcctgtcacagtgaaccacctcatgttcactccttttggctaaggaaatgtaaggaaataagtttaaaatatggttattggaattgctttactaccactgaaacttgatgcaagtttttaatctaaaagagtttggatagaatttaaaagagtttggatcacattagagagcacactgtggtttccatgctagtcacctcatatcctttcatgggcgtgtgcacacatgtgcttgcaggcacccacatgtacttagcagttctacttcattgccaatgcatggttgggcaacagaattcccttttctcctctcatcaaaatgttgttggtcatctcaggaactagatatcagagtaaacacattttgcctaggcaataagaaaagctatgtagctaagtgtgaaatgccctgagtacttttgtttggtttatgttgaacagtacagcaaagttgtacaagcagggggaagctaggagattgtctggtacagtgtctactttataaatgagaaaactcaagcccagagaggttaagtgactttcttgtggcagcatagagctgagattataacttgagtttaccaaggcctagtttagtacccatatatgatatcatattttgttttagttactttatgggaagaccaatgcttctaatttccctttacatgtctaggatgaagatgttgttattagtaacttggaaatatgtatacattgaaactgagaaagcagagagcctcccagagtctgatagaaccaaaagccatgttgagaacatggcacatgtcttctgatttgtgttctgaggctctgtatccttcaccaccatatgtatttaggatacagtagattaaggtcatgttacagagtataggttaaccccctattcaaatggctcatgtcaaaggaatatcttgattacctgagaattttctcaagtagattgtctatcaccctattcaaatggctcatgccaaaggaatatcttgattttttatctgagaattttctcaattgtctatagtgcatctgtgtaacttttatgatatgtagagtctttggtaacataaaagaatttatttagaaatgcacatacagtctgtctttgaaagactttgtcttaaaaatattgtaagccctcatgtgtcacagaatgttgagaaaattagaattaaccacttaaggagaggacacccatgacacattttgagaaacatctgctaaacttagtaacatgggaatagtggattaatctacattattttagagtcagaatttaaggtatcattgaattaattagatggatgaatgagtaggttaaattaaataatgaatagattttaagatgcatgttttacaatataaaccaagttattgttttatagatttggataaaagtctatagccttagcacatctgtaggatgcattagtagaaatggaatgaacagggcagtggaagtaacaaccttgtacactgtgcccctcagactgatttggggtttgggtgttcagtgttcattattgtcttttggttaataaagtcaaccaagtttgtgaaggacctagaaacatgagtgtgtttagcacgcagaagtacagactgaagagaaatattatggctgccctataaacacgccttaaaatgtttgtaaacaggccactaaatgattaactgtcctacaaaacaagacatacctaataacaggggacacttcaggaaactcggtgtcgaggggctaaaacttatgtgaaaggctgagacgtaattcctttcttctcatgcacagtctctgtcccaggggactgatggtaatgatagcatcatagaactggaatgtgcctatgggccatctaaccttatatgctgttcaggataaaaatactcttatcatatccctggccaatagttattaagaagctatcagatcacctctgtggacaggaagctcagtacttccaaagacatttcatttcaaggttgttggggaactctattccacagaaaaggctttcttgtagttgttccgttaaactagaggacagaggagggtccttatttatccttcactaatccaatcctgcatagctaattgttagatacattttccagaatgtcagatgctcctaatttctcttaatgtcaaatggataaaatatacatatgttctcttggtatggtgtgtttatttgtttgccattttttaccattcatagatatttgaagacagaaggcttactctctcttagatagttttatggtgttatttcttccttacgtatttagcgtaattcacaggagaagacatttggtcctgaagttttcttttagaaagtgtttcggttatggagcaaattaatagctatactattattcagatttcccattactactttgtgtcagttttaataatctgtattaccttagaaagtgtcattttatccaaaatgtcaaatgtattaatatgaaatgttttcctaatatcctcttttctttttaatttatatagcaacccccatcccttttagttatattgctacctgtgctatatttgtttttcttgaattaggcttgccagtggtttatcaatgttaccaatttttcccccaaagaatcagttatttgttttgttgaaaacatttgtctatttcactaatttctgatctttgttttcttttcctctacctttttgttcaattgctactatttctaatttctttagatgcatacttaggtcattgatgtcagcctttcttctttttctgaaatgtaaataaaaggctgtaaatttctatcagtctagattctgactttaactgtgtcccttaattttgtgtcattttcttatctttaagttcaagttttaaaaaaatttccttttattttttatcagcatataataattgtacatatttatggggtatgtagtgatgttttgatacttaaaatgtatagtgatcagatcaaggtatttagcaaatctatcatcttgaacatttataattggaacattcagtgtatcttccttctacctatttgaaactatataactacaaaacactagaacttattcttcctatttaactgttgtattagtccgttttcacactgctgaaaaagacatacccgagactgggcattttacaaaagaaagagatttaactggacttacagttccacatggctggggaagcctcacaatcatggtggaagccaaggaggatcaagtcacatcttacatggatggcagcaggcaaaagagaacttgtgcaggggaacacctatatttaaaaccatcagatcttgtgaaacttactcactaccacaagaacagcaagggaaagacttgtccccatgattcattacctcctaccaggtccctcccacgacatgtgggaattcaagatgagatttgggtggggatacagccaaatgatatcagctgtcattttgtatcttttaacaaatctatctttaactttacctcccctctacccttcccagcctctagttatcttctgttctactttttacttcagtgagatcaacttttttttgcttccacttatgagtgagagtatgtggtgtttaactttctgttcctggctgatttcacttaacataatgtcctccaactccatccatgttacacaaatgacaggatttcattcatttttatgactgattagtattctgttttgtatatacaccacattttctgtatccattcatgtatttttggacacctaggttgattccatatcttggctattatgactggtgctgcaataataagttcaatttttaaaaattattctgattttgttattgacccatggattatttagaaatatattgcttaatatgcaaatacttgtgaaatttttcttgttctatcagttgttgagagaggtgttaaaattgcctgctacgattatggaatggatttttttctttcacctctggcaaatttcagtctgtgtttttttacctttacaatgggtgtcttatagacaacatgtagttgagtcttgcttcttttctacattctgatatctctgcctcttaataggggtgtttattgcagtataatctaaagtaattgatcctggcataccccaaagttggggcctagcctgagagggtttttggctctgctcaggaaagaattcaaggctgagccagcagtgaaagaaagcaagtttattagagtagcaggtacagcagaatggctgctccataggcagatcagggctatcccagaggtggggtggcccagcatagtagcagcagcgtacagcaacagtagccatccggagcagcagtccctgtaaattgctggctagctatatttaatactcactcttaataatatgctaattaaggggcaggttatttcgaattttctagaaaataagtggggagttcttggaaccacgtaagataacttctgggtcactgtcgtggcatttgtgaactgtcatagtgctggtaggagtgtctttatgctaatgagcagtgagggtgactagaggttgccttcatggccctcagttggttctggccattttttctgctacagcctattttgattagcagggtcatgattagtgctcagaaaataagtcctgctgatctcctacctcataattattgatgtggttagatttaggtctatctaaacatctttgtctgatcaggaatttttttgttcttttctttcccttttcttagaattccattttatctattggctttttaccaatatgtttttgcatcattttaccttttttttttgtcttttttttgagacggagtcttgtttgttgcccagactggagtgcagtggcatgatctcagctcactgcaacctccgcttcctgggttcaggtgattctcctgcttcagcctcctgagtagctgagtagcaccaacacacctgactaatttttgtgtttttagtagagatggggtttcaccatgttggccaggctggtctcgaattcctggcctcaagcaaatcacccgtctccacctccagaagtgctgggatcacaggtgtgagccactgtgcctggcctttttgtattattttaaagggattactctaggaattataatgtatgtagtaactgatagaccgtttgtattataattcctagagcaatcaggaatttgacagtttaagttttcatagcctatttagagttaacatagtacctctaaacagaaaatatagaaatcttgcctccaagtagctcctctttttggcctgaaaatcaatcccctacttatgccccatgccacacccttagtgaaaaccaccatgacagtctcccagacagtagtaggatttcctcttactctgtgttggaattatttattcacattatatgttgttgttcacctctttcttttcctgacaggctgatttctcagacatcaaggacccagtcttactcacttttgtgaacccagaggcccaatttttaaaaaatagatttgatgtggatgaagaaagggttcatttgttattgatgagataagaagctcttttttttttttttttttttttttttgacagagtctcgctctgtcgccaggctggagtgcagtggcataatcttggctcactgcagcctctgcctcccagattcaagcaattctcctgcctcagcctcctgagtagctgggactataggcgcgcaccaccatgcctggctactttttttatattttcagtagagacggggtttcactgtgttggccaggaatgtcttgatctcctgacctcgtgatccgcccgcctcggcctcccaaagtgctgggattacaggcatgagccaccacgcccggccaagaagctcttattatagctttattttatttggtccagtaccaatgacttacaaataaaaccaacatatttgtagtgattcatgataaactatgtttgtaagcccagaagtcataaacttataaagagggaaataaataatgaattaatttgattttaataactaaatttactgtgtgccagatgctttgtttaataagcactttatatcagttatctccattagcctttaagttttctatttaaagtaggcactattataccccattttacaggagaaattgagacctagagaggctaagtcatttgtgcagcatattgctaataagtgctacatgcaggaattaaaccaaggtagaatgaggccagaacttatgctatcaaccgtcttgttctgctttagggaaagggaactaacctttattgatcatttactatgggttagtccatatgctatgtacttggtttaatcttcaaaacaatcctatgagatttgggcattattattctcaattagacattgagacacagagaaagtaaataactttcccagggtcacaaagatagttaataagcccaaccagggttataccctttttttttttttttttttttgagatggagtcttactctgtcgccaggctggagtgcagtggtgcaatctcggctcactgcaatctccgcctcctgggttcaagcgattcccctgcctcggcctcccaagtagctgggactacaagcacacgccaccacacccggctaattttttgtatttttagtagagacagggtttcaccatgtttgccaggatggttttgatctcccaaccttctgattcacccacctcagcctctgaaagtgctgggattacgggtgtgagccactgtacccggccctaaccagggttatactctcataccacctatggccacctttaccaattatatatttgtttatattttgtaaaatatcactaatgcagatactagctaattagaagttatgccatctgttgtgagagctaatagaagtcaaagcaattaatattaattttgttttatttcattaaaaagtgatggttatcagccagatgtaatggctcatgcctgtattcccagcactttgggaggctgaggcagaaggattgcttgaggctaggagtttaaaaccagcctgggcaacaaagcaagaccctgtctctacaaaaaaaataaaataaaaatttgctgggtgtggtggtgcatgcctgtaatcccagctactgagaagctgaggcagaagggttgcttgagtccgggagttcgaggctgcagtgagctatgatcgtgccactgcactgaagcctgggcaacaaagtgagaccctgtctctaaaaagaaagaaggaagggaggaaggaaggagagacggagggagagaaagttgtacaatacatttcttttactggctgattaatgttttgaataatttatattaataaaaataccactttagaagtgatagaagtgcaaatttgcaagtaatcacttgctatctattttgtatgttagaatggagacttattcaagtaattgcatgagtttttttgcattttcctctgtcggtacggctgactgacccttagcaaactttgttcatactgagcatattagatggttctgccttagtcaattcgctgatggtctactggtaacaccaaatcctggcttaggtctctggaggatatttgtaaagcagtgttatactttttggcaatgattctaaagtgaagtaacacacaaaattctatttcatgggtcctcaaggaggcactgctaaattacattacaaaggcatttgactcataatatgatttcattcagtaaatctattgaaattactattgagagaagggcttaatttcactccctttgtgatattgatggtcagtaaaatgaaatcgaacttgctcacattacatatgtacattcagttttcctagaaccttgaagctttttgattttgttttcctaaaggttttcaaaaggagcccatttagcatctaattgcttgtgccttccacattgttcttacagtctaatgtcttctcagtttacaaagcacttttaaaattaaagtggttaataactagaattacattatttccttcaactaagtgaactaatgtcctgaaacaacttttactaatgtgcactcagtaacaaagaaccaactgtatacatgttaatttgaggagctttcaaataattgccctcaaagttgttttttttcctcctctctagtggtgctgcaattatcttttcaaagggatgatttattacatatacacacatggagctccaaaacagccttgctactctcagcattatggaattgttataatttgcttcatttatcataacaaacaatatagttatatgctctgatggatctagagcagcatttgtcatttgattattatgctataaaggtctgatgtagaactagaattaaatgaaataatactaagagctcctacgtccatgctgcttttctttaatactcagtccttccctgagtggaaatactgagtaccctcttttgtccatattttgccataagtgggttcttaaaaagttagatgtaaatctaagtttcaaaaatagaatttggttctgaaagtacttggggaatcagtctgttgagtgattttattaaaagcaagtatctcttttgacataccaaagtcacttaccagtttcagtttacaaggataaaatcaacttagtattatttgctacatttttggcacgtactgtgggcaataccacagtacctcagtacgtgctgaatgtaattaaaagacatctacacttttataattcagtgtatgtatattcgtttttcatagatcatctcgaagactttttaaatgactcagtattccacaaacattaatcgctggggcactcctagctatagactgaaagtatgtgtgatgaatgatgggtaagacattgttcctgcccttagaatttagtgtaatgaaatcactttgaatgagcaggatgcaatgtgctttatttactcttcgaactagctgaattttagctggctccctatgagcccgttaaaggaaataggaaagagctagccacataactttctttcagcatcgttttattatactcgttctgctttaataaaataaatttatgaaaccgatacattgaggcacaagaatactcattaccaaaactttcagcctaggctccttttagataaaaagttcctcggagtgcatctgaaatcacattttgtttggacaaaagaagagataatgtacctgttttcagggggcatatctgttattaaatgagactccacagtcttgatcaatattctgcataaggactttttggctacaaagcgcttgtctggactgtagcttgcatttcagacctcttcttaatgattaccaaaaaaatactgagtgtgaactgcagtactgtgagcaggtaaaggcagattggtctttgaatgctttgagaaccctagataaatgagcactagaaagtgcaggtgagacccccaagaaagcctgcctggctggagaaaagaatgtgtcttgtagcatagtgctggattaaaacagacatgtagaatgaggtgaaatgattgagaatcttaaggcaaagctcttataattaatcgaaccatttgcatgcaattaattatgggctttgtgatacgtgctgggaaaacacttactggatttgttctgcttttaacataatgttaaagaaaaatattgtttataacatttgttaaagaacagtaagacagattttattcaggtaactgttgtaacaggtataagaactactgcagtggagttttggggtaggggagagagattgggctcaactctgaaaataaggaaaagtaaaagtgtatcaccaaggagtgagggtgagagtgtgatatcagtggatgaaaaattactaagaggacacatgaggggtaaggggggattctggctcaaccatcctaggagggtattcttgctgaaggcagatcagggtgaccagacattacctaggggttggtggaagatgaggaacccaatcagatatccagcatgggggattctggctaaactaacttaagaggatattagctaaaactggacaatgcagagacaaatacagaagcatacatgaagtcagagctagttgagaagagggttcagaggagcctgactagagtttgatcaaggagagcatctttgtcgatggaacactgaaaggccattatggcaacctcttggatatttgaaagaaaatggatttgtggcttagaccagagtcattattttacaggtattgtcaaaggtgtacctaatggaaataaagcctttttccctcatatagctaatagttaaatgaatttactgtcatttttctgatggcagtatttcttgtatcctgtgcttgtttcctgcatttgtttcttcttttggggaggatttgccaaataaaatccagaacccagttaaatttgaatttcagataaacaacaaataggtttttaaagtaagtacatctcaaattatttatttgaaattcaaatttgactgctatcttgtatttttatctggttaatctgtattttgaggttatattctttaacagatcctttagtgagggtcactaaagtatatactttatgtgtctgaaaatatctttattttgcactcattttataatgagactactcgtgtgtacaattccaggttgatagttgttttctagtggtgcttgactacattataccaaagtcttctgacttctgtgttttgacacctcttcctttgtagataatgtgtttctctcttttgagataatctcctaattctttatgttctgtagttttatcattatgtgtctatatttagatttatctttattttactcagtgtaatgtcactctgaaaactcatgtctttcctcaaatttgaaaagtgttcacctattatgtcttcaaatatcactttccaccatgcttttctgctgaaactctcattaaacaaaagttggagtgtgtttttcatggctcttaaaaaatcttttgtctttttattctctttttcgctgcattttgaatggttatctcagttccattttccaattttctaatttctgctttactatgcccatctaggctttatctcatttgttacatttttaattttaagactgtttttcatttccaaggtttctaataaattattgttcatagctacctgttcttgttttatattgtttaagtattcatttaactggttaaggtatgctaaaaatccttaaagaatcttggtaagaccatttcgtaaaattattctcatctagagaatatttgtgttcaaatcattggcttcaattagtttcttagcaaacaagcattaaaatttttaattgggttgataagctcactttgaatcagaagtttattttcatcctccccacccttttcctttttctgtctagcaattttatggaaatttccacttggagtttggggccgttggtctagagctagattataatgatagcttctgacccatggagcttttctttttatgatactgtttgcataagaatgtgataattttcctttttctaatattagtaaatttactttttgttcatgattgccttacacaacttttcaatctacttatttatatattttgctaactttttttttatttttattttttatttgtttatgttaacttttgttgaatgactattcagtggagccattgtgttaagtacattggagacaaccttgtgagataagtagtggtttgtgtgtgtctgtgtgtgtatgtgtgtagctccctcttttctagagcttatcactaccctttcaacttcagatcaattttatcttacgaactttcaaataattcagtaagtgttttctttagtgtctggcttctttcactcaacagtatatggccagcacaatttttatttttagaattctgccttataaagtgaaaatatccattgatgtttttatttaaacaccttttcccctcttccatcttgttcttctctgacttctctgcttagaccccattgccccaaagttacagctttgtctctaaagttgccttcagttgcattatcataagtgagttgctatgtttatttctttctagaaggtttttgggaatatataagagagtgatgtgggcataaagatgaaacttagacgagatcgggcacattcagggtggtatggctatagacacgagcattcctatacaccaataatagacagacagagagccaaatcatgagtgaactcccagtcacaattgctacaaagagaataaaatacctaggaatacaacttacaagggatgtgaaggacctcttcaaggagaactacaaaccactgctcaaagaaataagagaggacacaaacaaatggaaaaacattccatgctcctggataggaagcatcaatatcgtgaaaatggccatactgcccaaagtaatttatagattcaatgctatccccgtcaagctaccattgactttcttcacagaattagaaaaactactttaaatttcatatggaaccaaaaaagagcccgtataaccaagacaatcctaaggaaaaagaacaaagctggaggcatcacactacctgacttcaaactgtactacaaggctacagtaactgtatatgcagaaaacagaaactggaccccttcctcacacattatacaaaaattaactcaagatggatgaaagacttaaatgtaagacctaaaaccataaaaaccctagaagaaaacataggcaataccattcaggacataggcatgggcaaagacttcatgactaaaacaccaaaagcaatggcaaaaaaagccaaaattgaccaatgggatctaattaaactaaagagcttctgtacagcaaaagaaactatcatcagtgcaaacaggcaaactacagaatgggagaacatttttgcagtctatccatctgacaaagggctaatatccagaatctacaaagaacttaagcaaatttacatgaaaaaaatcaaacaactccatcaaaaagtaggtgaaggatacgaacagacacttctcaaaagaagacatttatgcagccaacaaacatgaaaaaaagctcatcatcactggtcattagagaaatgcaaatcaaaaccacaatgagataccatctcacgtcagttagaatggcgatcattaaaaagtcaggaaacaacagatgctggtggagaggatatggagaaataggaacgtttttacactgttggtgggagtgtaaattagttcaaccattgtggaagacagtgtggtgattccttaaggatctggatccagaaataccatttgacccagcaatcccattactgggtatatacccaaaggattataaatcattctactataaagacacatgcacacatatgtttattgcagcactgttcacaatagcaaagacttggaaccaacccaaatgcccatcaatgatagactggatgaagaaaatgtggcacatatacaccatggaatactatgcagccataaaaaaggatgagttcatgtcctctgcagggacatggctgaagctggaaaccatcattcttagcaaactaacacagaagcagaaaaccaaacaccacatgttctcactcataagtgggagttgaacagtgagattacatggacacagggaggggaacatcacacactggggcctgttgggaggtggtgggctaggggagggatagcattaggagaaatacctaacgtagatggcgggttgatgggtgcagcaaaccactatggcacttgtatacctatgtaacagacctgcacattctgcacgtgtatccaagaacttaaatataatttttaaaaaagatgaaacttagaatatattgttcttggtatatgttttggaaataatagtagaaaaccaacaggtaagaactaagactgcggtcaaccagacttgataattctgttcttcaaaacacttagaaatgtttaatattccttttgtttagcctgccagaggttaatcataattttctattgtattttcatttaatctcagaaactgtcatgtacttagtttgatgccagatcatgttttacagtggtcaatggctcagtgggaactgatagataatttactgatttgaaggtgttaactgttctggtcatcctcttagaactactgctgcactttctagtttaaatgtgcacagtattttcagtaagaatttaaacagtttttgatctggacctgagcaccctatttcagcatttgcaaatcaaattgggacccattcctgtgcattttagaattatttttctggtgtgtcctcttactatgctgggataggtttcaaaaaggaaatgtctgtttattttattaactcttcctcaggaaagacagtggtgaagtgagtcattagcacattgtatttttcaatagctctttgaccttaatctctgtggctataaaatgaatgggaagatgcctactgtattatgagtgatgaagaaagcccatgatggattcatgttactgtgaatatttcaaggagaagttaatgtaatatctgtagactacagtcatgaatccaagaccaacagagtaagtgtgtgttgctagcagcgtcgtccatgtgtagcacacatgtgtcaagaaataaatacaagctgttctctgggctctgataattcctttatcatgttaccccgaagacagaagaattggaaggaaaggagttgctgccacagtggtttgacttttttcagtgagtccagtgattgaatccatcctatggtggatggtcattttataatcatgggacagttacagggtggtgggtaggcttttaatggcagtggggcctagatagaagcaaatataatcacgaagagactcatacaatagtctttgaagctggccccagagagcagcatttcacaaaaatgtttccacagatgaccagttcagaaggatgttaatagattgtgtgttaaaaagggtcccacagccaaatgtgcagaaaaaccaagttaaacacagaaaaacaagagattttgccaaaggactcttcgggttttaaatatgcttatgtatatagaataggcagtgtttctcaaacatatttggctgcagaacccctcttttagcagaggtctcacaaagtctgtgttttgtgtaaaataccttgggtaaaattgctctagaacattggttttcaaatatttttttcttaatctcctagaataattttgaaaaagttatgtgttcacatatctttaagctgacatctacattttcattaaaaagtcaagtggatacaataggttaatttctggcacatttatattgtatgtgtgcattaaataatttcatcaaaactttggagctgcagaattggttcatgccattgataaacagtctctgccatttaacctaattggtaaagccagatcttcttatgaaagaaatcggactcattactttttctgtgactctatcctggggttgatatatttgtgaattgttcatttattctgtgcctgtgagaattttacctttcaagacagtgttcttagaaaggcctagaaagattctggattgacaagaggtatgccttgacttggtcaagagcaagaaggccctgaggaaaggggaagataggaaaggaagattggcaaatatattcttaggcagatgacttcaaaaagaaacatctgaaggctgaagatctatagattagttcccttaaaagtgtctaagcctgtgtgtaccctatagaatatcttcatgttccttcgtggtatgtctacccagtgcaaagttgttctttggaagtttaagaaatatatatattgtctaagtgatccttattaaataacttaatagtctgtctgggaaaagtatttgtattaagaggtatttttctgctttcaagtggaaggcatactgctaatggaattctgtcatggaatttatatttactagcaaaagctgaacacacacagatgaatctccagaaagcttcatattttcacacagtagaaagatgctcatgtcctgttcttaccttgtcctgactcctgttggacatgcctcatttcctgtataaacttgcgtcactaagaagacagtaaattcttactcactttgttaaacatacatactttcctgtaggagaagagatgcataaaaatatatttatttcccagaagggcacttgtgctgttcgtaatatattatgcaccaaatgtcatactttctttattccctggcattttcagccctggcaactggcagattgttttgaagtcagagaatatttaaactacaagtaaccttggggataatatagttcagcccctctgtgttacaggagaggacactgagatcaagagaaactcagagacttgctctgggtaacataacattttgtcctagttggaccaaaagctagatcttagtggaatattcctcctattattttcccccatcctctccatcctttttagaaatatggccttggacgaaattatctctgtaaaatggaataattattcttgtactgctcaccatccagaattgttgtgaagttccagtgagatacggtgtgctatagaaatgtaaagaatcctgatgaggtagaaggaagatgaaggtcctcacttcatcgtcaccttatcgcatcattcccatgtactgaaatacttaggctgttttatgttgggttgttcatagggagtctcttgttatgcatgtatacctgattactttatattcttctactacctggttaataaaagcccagccctcttatttctgttgtattagtttgaaccataggacattgccaatatttgaccattttagaagaagagcagttttagaagaaaagcagttttgtgttcctgaacttcatctgtgagctgaagtatgtggtaggctatacaggcagagatacctgtaaatgttttaaataagtggaaaagtatgtaaagctccttcatgttagctgtagtagcttcatggattttgcctactccagaggagcacatgggtccgtatgaatttctttcctagtttctgtttctgtaaacttctagactgcctgcctgaacacaaaagctcagatggggatagggaatggtgactggctgtatgtgggtgctgagccccttcagccatttattttggccttcattctttaactcaggaagttgttctgtatgcagtggttataccacttcttcaaaggacagacttccacagttttccagagaaatttgtcatctatagagggagaacaaggaataaattcatgtatttttcaaactaaatattaaaatacttttgatttagttagaatctgttgaggaaggtttgttgacgctttaaaatatgagacttggccggatgcagtggctcacacactttgggaggctgagcactttgggaggccgaggtgggcggatcacttgaggtcaggagttcaagaccagcctggccaacatggtgaaaccctgtctctactaaaaatacaaaaaaaaaaaaaaaattagctgggcatggtggcatgtgcctgtaatcccaactactcaggaggctgaggcaggagaatcgcttgaacctgggaggcgaaggttgcagcgacctgagattgtgccgctgtactccaacctgtgtgacagagtaagactccatcttaaataaataaataaataaataaataaataaataaaaatatgagactcctgaaacactatattgttatttgaatttattccttcacaaataagctatttataaaatgacaaatattgtaatcaggttttatttgattaaagaaagaagatagctttaggcaatgaagtccaaatagaattctggtttaccattcacccgtcacgttccatacagttgttaagtctgaatagaattacggtttaccattcacccatcatgttccatacagttgttaagtctaaatagaattatggtttaccattcacccatcacgttccatacagtttttaagtataaatagaattctgctttaccattcacccatcacattccatacagttgttaagtctaaatagaattctggtttaccattcacctatcacgttccaaacagttgttaaactttggcctgatgatgtcatcacttggaatgttcttctctcatccagatacaatgcgttcagttcaaccaatgctttgttcttaacgtgtttgtgagtctctgacatcctttactttaatttagaaagcttgtgactacctgtctaggaaaaatcacttaggcagttgctcctgtttcttaataattagaaatgtcttattaatttattaatttctgaagtcctatgttaaaattatggggataagttgtttgttggctgggaaggggcacaaagaaccttctcaggtgatggaaacattctttttttttttttttttttttttgagacggagtcttgctctgtcgcccaggctggagtgcagtggcgcgatctcggctcactccaagctccacctctcaggttcacgccattctcctgcctcagcctcctgagtagctgggactgcaggcacctgccaccacgcctggctaactttttgtatttttagtagagacggggtttcactgtgttagccaggatggtctcgatctcctgacttcgtgatctgcccacctcggcctcccaaagtgctgggattacaggcgtgagccaccgcgcccggccagaaacgttcttaatcacaatctgggtggtggttacaccacaagtagatatgcaaaaattcatctagttgtatacttaagattgatatattctagtgtatatacgttaaatataggaaacagaaatctaatctctaatttgtagtagctcaggaaatataaaaaaatagatgaaccaaggcagttgaaggaaacagtttttctggaagctgtgagaatgtgtcacaaaggaaggcccaggcttcctgggttcttcgggccaaaattaggggaagtgttggtgccagtgccggtggcacaagctgattaaaacagtcataacaggaagagtcttacacgattcttcgtctttgtggatgtttctgtttcttcctgtctatacctgataggtttgcttggtcattttgtttgttttcttccgtctgaattcctgtcctccattcccatggcatcagagtcaaggcagtaagcagtgtggagagtcaaagaaggggcattggaagagggtactaggcattggttgtaaatcaggtatttatgagtctggggggaaacctctacattaacctggcagccagccgcaaggctgagatggtgctgttatagaaaccacctagcaagggaaaattctgggtcctcaatcttatcatggaatgtgtagtggtgcagccaatgaacaggaatacaggccattcaggggaagaggaatgctaataatcataccctagtgaggatatgaggggaaatagaagagtggaaattttgtccagccttcttgaccacaactggctggttacccaaacttgaggttttacttgggacatataatagggcttcacttgtaccgtgtaagctccaactggacttggcactcttcctggtccttcatggtggttttcttaaaaagaatgagttacgggggaatattttcagttacatgctgtacataaaagtgcattacagaacaacacacacttcaataaataatgagatggtcaggtgctgtactgtgtgccgtaccaggtgtcatctagctgtagcagtttccagctacgtgcaagttggaacaccatagaatttatacagcaaatatgcattaacttatcatttgaatgtcacggaaggtatcatattttatcactgaaattaacttaaaaattgcatgctctgagtaaaatatgtacgtatagatcacgatgcctacttagaacatgaaatattgatgttcatataatgttaatatttgcttaaatagtgattgagggctgtattttctttttatgtgatgatcctgatagtaatgttttgctaccattgtatccaactttttgattttcaattaattacctttgcaagtgactatataatctttctttgtaaaatcacttcatttatatctctcctctttcaaatcgctttgatttccccctggatctccatatgcagagtatcttaagtgtctatttgtagcagtgatttcctctttcactgtatttctgaatcttctgctgctactgggtatttctacttgggtatcccaatgtgaccttgaactataaaactgaactcctcttcttcctgccttctttcttcctcagaactccttccgcaaaaccagctgtgatttttttttccttttttcttagattaggagcctcccagacatccttgactcctttctcttactttctcatgatgtgtagtccagtcaagcaccatgcattttcagttgttcttaaaaaaaaaaaaaaaaaagatttgtccattctttatcttcctgattgttctcactgtcaccagcctggctgttaccaacctcatacttgcatgaccccttcaagtgatcagacttttaatctcttctcaacaagccatgtgttggccaggtgaattttcctagagtctgtctttgagtctttctttctcctgctcagaaacctttagtatatagctccctgttctcaatgaaactgaatccaaatgcagcctgaattgtaccagctctgtttccaactatttaccttcctgaatcttcttttccagccagtggtttgactcatcatttcctgagcctccatccactggccacactctgtgctcaagctccagggtttcccacacaagtcattccttcccttcctcgcccatccatccagctcctgcccagacatcagcactctaaagccttacctcctcctcagtgccacagtctgccccacctccagcttccttctgtggcttttactgtctgtataggcaatttcataatttaacttctaacagtttatgacagttctttcttgtgatgacttggactgcttttcacttcttaagtttttcaaatattcatatgtatagttagactgtcagtgcttctagagtgagagtctttgccttacctatatgctccataatgcctaacataaactaacactaaagcaaaagctctgtgaaggccagaatttttatcagtttttttcactagtaaatccttagcacctggcatgtagtaggtatgtaataaatatttgctatataaattgtaaatgttcaataaacattaactgatttaagattattcacacctgctacatccttttttcactataactaaaagattactatagtgaaaaaggaagtgaatgcaatgtatagccagaatctgctcaatggggcttgactgctccttctaaagaattgtgttttcctgcagatattaatgaatgtcagctacaaggtgtatgccctaatggtgagtgtttgaataccatgggcagctatcgatgtacctgcaaaataggatttgggccggatcctaccttttcaagttgtgttcgtaagtaataatcactttttattcctgttttggattaattgtctttggggtttttccaaaagaacggaaatactcagtggccaactgaatgcttgtaaatatacaggaaaacctcattaattaaaataacaagcaaggggcctgcctgatgtagtaaaataaattgatatcatggaaccttctctaaaatgcatttttattgtggtgataaaaatataatagctaaaactctgaatagagactaagcacaccgaggaaatatgctttgatgaaaagaaaagagagaattaaaatggacatatcaaacttttttggtacctgagagatgacagtaagtttttccttcataaatacggtattttaagcattctttaggttgaattgaactgtgtcccagcttctgcctttaattattccaaattctgagtcactggactctgatttaatgaggtttcacttctttctcaattgtaagagtctggaaaatagttaccaaggccctgtgttttagattttctaattcagtcctaatttcagatattgtcttgttctttaaacccaccaaaatgaccctaaattatactgttttgccttaaaaatgtttctgagattttcccttgtttctgataagggtaaaaatccttcattaaaccacatgttctaatattggttctgaaagatagtttcaccaaagagatactccctctccgtgtaaattaatccatgtaatcactacagatcatatgccattagagaggaatgcattttaggtgtaaagttctcaaatgcagatttgagatttttaagaatgtcttatttttaaagtaatcatgcccattattataggtaagcactgtaagattttttttaaagagatggggtcttgctatgttgcctaggctggactcaaatgatcactgttcagcctgctgagtagcatgactatagacatgggccttgtagcactgcagatttttaaagattatatacaatttaaatggctgcatggcagaaaactattaggataattttaagaacaactgtgtattagtttctttcctgcaagtttttgtttttatctatctatctatctatctatctatttatttttgagacagagtttcacttttgtcacccaggctggagtgcaatggtgcgatctccactcattgcaacctctgcctcccgggttccaatgattctcctacctcagcctcccaagtagctgggattatgggcatgtgctaccacgcccagctaattttttgtatttttagtagagacagggttttgccatattggtcaggctggtcttgaactcatgacctcaggtgatccacccgcctcagcctcccaaagtgctgggattataggtgtgagccaccatgcccggccacttttatttattttttaatgtggctttggtatataatgagctgcatctttcttgtctagtttgaaatttgccatttggttgacatgttcttcatgagtttactgccattcatttttaacgaagcttatctctcttaactctttgccctaaggtgagatatgtagaggtgataaaataaagacaaatgtagtaaaataaaaatgacagtctcatttattacttttaggtgagtttgttgagtcttttgaaatgttatcactaattactactcttttcctttaaaaactgtcaactgcagattaggaagttttacacgtaagtcctcttttctgtgttcttttacaaacagttctgatcatgaagcagacagacacctaattataaggctttcctaacgggtggtaaaattagaccataaaattacatttgcacacaaattacctttgaaactgatgcaaggatttggaaatttcaggccaaaaatcacattgttgatgacatccagataacttaggggatcatttttggctgatttgaatcacatgaataaatatgttaaatcattttataatttaaatgtaaagattgtagagtttggatatagagtttgttgtgaatgctttttccacccttttataatttgacttgtagtctggttacaattcttatattgaaggttgctgattaggtaaacttgcagaactagtcacaaaacgctctgtgaaactttgaccagatctgatgtctagagttgagggcagacatccaggttttaataagattatagaaatctgccaatgagatttttgaaacacttgcacatttccttagcatttattttccctgtcattgcccaaataattctgaacttattaaacaaccatccattcttatttgaaaaataaataattcaattttatggttcagctacaacagctgaactgataagtattaagagacgtttgttgctagttaagtgttccagttgagagttcgaagtgaaaacctgggctctttaccagtgttgagtgagaagatttatttctctttcctctgaatttaccacatgtaacatcacagagacatgtagagttcctttaggatttgcgatttgaaccagtccagtctgattttcaggtgaattctgtgaagagcttgatgggggaagtctgaagacagaaggaattagggaaaagggtgatacttacagagtaaaggaaataaatgaaaagataatggtatttttggtagtcacagggaaatagcaggaggggactggagatcacacacacgcacacgcacacacacacacacagacacacacacaggcactcaacacagtggttgctaaatgtttgctctggagagagagaaaaccagccagggatgaagcctgcaggcaaatggaggacaaatgacaacatttgctaggacagcatgaatttaggccatatccagagcatacaaggtgtggctgactctctgaactcctgcacatggttatggccaaggaacaacgggaagcactttctcttcttgaatgcactgaactgagatgaaccccccagaattccttgactgcagccaaaggttgcaacaatttcactttctctccttgccgcttgccttggcttagccaagctaaaaggaagaaagcaggcaaatgctggcatttgctgcctctgacctctatgtttgaggcttaggatggtgtaggagcattctccagacatgttgctacctgatttatggggaaaggtggaaattcgaggacttttcagagcaaattcaagaaaagtatcatctttgcaatccaagtaggaagactttctggctttctgaactcctgcaggaacttcagagctccaggatgagtgctgctgagaatgtgtccataggttcagtaaaaaggcccagataaaagaattctgagcctgggcttttgccttttcgtagtattcttcacccatcaacttggagctagttgacagaaatggagggttagagagaagatgtgctcaggaacttctgccgtagtcctggaagtcatgagagaaagggcaaatgccttttaattaagtacatcattcatttgtaatttcctgagcatctttatgagaaacataccatgcttatcttatacattgggaaactaaagctaggaaagtttaagtagcttctcacacagctagtagctgagagttgagatttaaaacaggatttgtgcctccaaatttagggttctagatcaggagttggcaaattatagcccatgggaaaaaatctgtttgtttttgaaaataaagttttattggaacacagccatgtccattcatttacttattgcctaatgctgcttttgtattacaaagacagagttgagaagttacaacagaaatcatatggcacacaaagcctaaaatacttattatctgatgcttgacagaaaaagtttgctgacgctcaagctaattaacactgtccaatagaactatctgagatgatggaaatattctctatctgtgccacctcatacagcagccactagtcatgtatggcctgtgtaactgaggaattgaatttttacttttatttaaattttatccaaggagcaacatgtggctagtgcctaacatattgagtggcgtagttttgtatcctttttggcaagccaaatgggttaattactgctagctttccagcttttccgttaatatgggctttccttccagacttgatattttttgcccatggtaacattttctccagagcaccccggctgggagcctgtgtcatcttggactcttttgtatcttttggtttcaaaggatgacatttagtcttcataatttatcttatgcccgttcttttctttctaccttctctgtggccatctcaggttaggcccctagcctccctcacttggaggtctcatggcaccgtggcccggaggtgagacagatctgtacaagctgcttgctcccagataattacagtaaacaaaaaccatgacaataataatttttattgcaaacttcgtaaatgccaggcactgtgctaagcactttatgtgaattatcccatataatacttacaagatctctattggatttgttctgttatttttcctaatttagaaatgaaggaattaaggcatagaggggttagggatctttccaacagtcatacagtccataaagggtagagcccagatttgaaactggatctgtctcactccacaagctgaacctttaatcaagaaatggaaaagtctgaaatgccaggaggagtaagtcatttatttaaggagaactgacattttaatctcacctgccacactatagaataggtgacgtaactgcaatggccttgaattattgtttcttttattttggttctccacgaattttttttttttttttttgagagggagtcttgatctgctgcccaggctggagtgcagtggtgcaatctcagcttactgcaacttccgcctcctgggttcaagtgattcttctgcctcagcctcctgagtagctgggattacaggcgtgcgccaccacacccggctaatttttgtatttttagtagagatggggtttcaccatgttggccaggctggtctcgaactcctaacctcacgtgatccgcccacctctgcctcccaaagtggtgggattacaggcatgagccaccgcgcccagccatgaaatggtttttaatgacacatttcccagagtgcccagtggttcttactgccctaggtaagctgcctctcagactcctcaaagcagctttacctgcttcctagacctgtatcctaacactcatccccatagatactaagctgtaaagggattaaatgctaatgtggaatttcatccaagaaatgattaaggatattacagatgtgggtgggagtgattgcagactagtaaggttagctagacttttaaacccttgctcttttctgaaatcctccctacttttcaacttcttctaagtaccagattaattaatatctgcttaatatttgtcattcacattttaacccatttatgcctggtgttccattattggaatgctgagcttgtgggagttatttatatcctgctcaaggtcatctcagtaggtctgatttttcacacacacacacacacacacacacacacacacacacacacacatttacaacctccagcataaatgggttaatacattagagtagtatgtctttgaaagtataatgtgagtttattatacaatcctataattaaggccataattaaatataagttgcttaatatatcactgaggaacccgaataatagtatcttagctttttactcttgttttgtaattgaattgccatcaccatgggctgtatggttatgatttggtactatacttgggtacagagctatatgcttgttaccagtttgaaaatttgtcttatgtctgtagccaagagcaaaaaaattactttcctggtggatgtggcattttcagtaggttttatgcttctgaagtgcttttccttttagataaagtatcagaatctttttgccgtaattttagtaacacatcctgcacaaaataggatctgacaaagtactgtttcagtgtacaaacatgtaagagcctacaggcaccctttattatcactcctcagttttattcgattctacagctgcttcccctatcccttagaaatcttttggtatttctagttttctttagtacagcataaaaccttatgactcagtagaatatataatcacatgtaccatattttaaataataaacgtagtacactaatgtgttatcctttacaattaatcttccagtctgaggttaaagatattcagacaataacaacaccaatcacatcattctgggtagcatattgtttctgggtttacgcatcatattgaccggagtgtgaaaatactagagatgtttaataaacagaatgcaagtcatttgaaatgacaaaaagaacaacaggcaatttaggtcgtaaaataggggcagttttaaatggcacaccctgtcaggtatatgtggcataaatgaacagttttggcttcaaatagttgtagattaaagaaaatgtgaatcatgaaagcatcagtaaaatttcggtttgggagaggctttaagatggttgactagaggcatctggtgctcaccccctccacaaagaagaaccaaaatatcaagtagataatcacactttgaacagatcatctaacagagaacactgaggtttaacagagaagtcacaggaaacacctaaggcagggaaggagagggaaccaagggagcctgctcagccaggattagctgggagcctggggaggctccccagtgtgaggaaagggtagatgagagacctccagtgatccacattcccatgtgaattcctgcaatcctagccacaggagagcccttcggccctcacagactctgagacttaacatagggagctgcctagagacctcgtgatggaattgctgccgagagggagctcatgcatgctgggtcccacacacaccttctgagtcttaagcaggtaccaccaccattggcacctgagcactcctctcagaggcctcaggtcaggcccacccaacgtaccactaccatcacagctggcactcacctgtatataccacctgtgggcctggggactggcctgcccagctgctaacaccagcatggactgcgtgagaagcagagggttgtctcaccactgctgctgccatcacctatgctacacccactgcccaggagcctgagaacctgcctggctaactgctatcactgctggcacctaagcaagccacgtagagacccaagaattggcccacttggacccactaacaccaatgccagtgtacgctgccctcgggcccaaagacaaacacatttggcccacctctgctactactggggctgaggactggcccacctggtagcctcatcctcggcaaaattttgcacagaatctactaacaactgcatcctaaggcactgaagaatcagagacaccactgatgctatttacaactgaagaaatcttatggagactacactactgcatgtggccagaatcaaagccaaagtgccccacccaaacagcaccacagataacatcttcaggaagtcctcccctaaaagagatgctagaggaggctgggcgcacggtggctcacgcctgtaatcccagcactttgggaggccgaggcgtgcggatcacaaggtcaggagatcgagaacatcctggctaacacggtgaaaccctgtctctactaaaaattcaaagaacaaaattagccgggtgtggtagtgggtgcctgtagtcccacctactcaggaggctgaggcaggagaatggcgtgaacccgggaggtggagcttgcagtgagctgagatcgcgccactgcactccggcctcggcaacagagtgagactcagtctcaaaaaaaaaaaaaaaaaaaaaaagatgctagaggaattgggtaagggaaaggcaagtcagaaaacctcatttgtatggtgatatgatagagaagagctttggttgggtttggggaatgggcggcggggggacaccaaacttattcagcacctttggcctgacctggacctggttctgtagaatacactccatccatatttgcattagaagatgaacttcttgaaggcagggctgtgttttgctgattttcatatttgccatgtgtgcctagcagagtatttagctgttaggttgatgaactcttatctactaaacgtatagcagaagatgaggattaaagtttaggtattggatggctatagccttgtatacttttgcagtgttttccgaagagctgagcacatcatctcttccttctctggtgtactgtctggctagaacaggggccttgtgtggcactcgaaatcagaaaccactttctgcctcccattcatgttcactggcgtagggtgagacctgatgggccctgcaagctcttacttccctgggatgagaagagcagaggctggcttgcagcatcagccatgttcctcattctccaaagtgcctgattattcactaaatgctgccctagagttatctctactgtggttaaatatagaaaactaggtagtgattttggcagtaggtgactaggtttatttggaaaggtgggtttttgttgaaatgtttctcttcattacgcacacatacctaattgcatgcttgctaaaatggaagaagagaccagagagggacagggacaatcactgtcacgacttttggtgccctgactctaaaactcacatggtaaactgatttttcttcaagaaaggtgatgctctaaatctagacagatttatcctgaagtgtggtttttaattcataccttagggttcattttactatcatttggaaagccaatgtagttttggtttctcatgtaatgtcgggctttatctctctgcttcagctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacaggtaagacatgcccagctgtatgcgcacatagattcccagccacatgagtacacgggacaactttggcaccttgggtcatttgtggtttctgactttaatttttaataatacattgtaaatatttaatcacctttgtagaaactgtacacatacaatgttgaatcagtgggaaaaaattatgtgcaaagagattttcccatttctatgtgatatcagacttccttttgaatattaagaaaagccattatattttatcttcaatttccaggactctgagtctgatatttaagtgtagagagaccagaaggctctgctgggccatgcgctttcctaatgattggctgctcatcaattcacagtaactagactttgtgcaagttgactcatttactcatttattgagtatcgtgcttaatttctttaattggaaatggaggaaattatattcatgattgaatttacgctatgaagattaataacttaaggacagaacttgccaaaactcctgaaaacttctgtgggagttgagtattaagaagtagattattctttatccttcaatttggtacataattgccttatgccctgagaaggcaaatttatctctttaaataccttctaccaatgaaccaccaacttctcaagcaggatcaagtagagttaagtggaagagaaagaaatgtaacctgaaagcgttagacctgatattaacaaggaatggcttcaatgtcacttacttggggtggacattaaatagtctactcaattgcatgtttgataagatgctttctacctaggaaagtgtcttaactctcacagggccatgtagtgtcttaaagctgtaacttacaccatagcagacaagatttaaatataagtatcatgactcacctttgttcatggttagaaccagaaagaactgtgttaaggcaaaggataatacaacattgatggtatgttggtagactagataattttaggcctccaaaagatcctagtaccctcttgtgctcttgctcttgtgccatctgatgcacttttttttttttttttttttttttttgagatggagtctcgctttgttgcccaggctggagtgcagttgtgtgatcttggctcactgcaagctccgcctcccaggttcacaccattctcctgcctcagcctcccaagtagctgggactacaggcacccaccaccacgcctggctaattttctttttgtatttttagtagagacggagtttgactgtgttacttgatctcctgacctcgtggtctgccggcctcagcctcccaaagtgctgggattacagggatggttccactcattattaaaaattaataatcaagtaatctttataatttatagacacgtttctcttgaagttcagtttttaaagctttcagtttgtgaatttattatgcgtattattttgtgtctgtataatgtgtttttaatttttttaaattttttaaatgtttagcttttaagttcaggggtaaaagtggaagctcaattttgatagctttataatccttacatgaagcataaattgagatggtgactggaactcagggatactcctctctagtactatcaataaatttgaaaataatattcaagataaaatttttgcacttaagttttggttatatggtgattttcactaaaaatatttagttcgttaattctttaaacttggtttttttttttttttttttagggagtttgttgttgtttttctggttttgtttttgtttttattatactttaagttttagggtacatgtgcacagcatgcatgttggttacatatgtatacatgtgccatattggtgtgctgcacccattaactcgtcatttaacattaggtatatctcctaatgctatccctcccgcctccccccaccccacaacagtccccagagtgtgatgttccccttcctgtgtccatgtgttctcattgttcaattcccacctatgagtgagaacatgcggtgtttggtttttttttttttttttttttttttttttttgtattttctattacatttattaatatcaaacactgttgtttcctgcatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaatatgtggtgtttggttttttgttcttgcgatagtttactgagaatgatggtttccaatttcatccatgtccctacaaaggacatgaactcatcattttttatggctgcatagtattccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactggatatatacccaaatgactataaatcatgctgctataaagacacatgcacacgtatgtttattgcggcattattcacagtagcaaagacttggaaccaacccaaatgtccaacaatgatagactggattaagaaaatgtaaacttggtttttaaagtcatgttttcttctggaaacatgtttccaagtaaaaattgtttttcctagttaaacataagaatgaggttctaccatttagtgtgtgatccttagaaaaacagtattttagcatactataagcagtatttttagagtttcctttttcttgagaactaattttaggtcccagacattcaatagaagatctcttgttcagtgaaagtgagaaatgacttattttatattcaattttaaaagtagaaataaaaaagttaaccataagctccttggtgtctacatttggtaatttgcctccaacaccaacaccaaagggattaggtggatttttcctctgaaggccacacactgccttacccttcttctcccccttgcctttccccttcactattcatggggattatgccgtggaggttagcaaatcacatgtgctgagtctacttttttttttttttaaagaatacaaaaccactttttttctggcaatggtagtgattgattccagggcacagaatatctccttggcctctgggtagttaaatgagctggtcacggccaggcttttgcccagttgttgttcctttacttgaaaatagctgcatcttgatttggcatttcccttctttcttgatttctacctatcatctccagcatgtctcactctctagactcttcctcactatcccgagattctccccttcagaaacacttccccttttccgtcctccgtaatctacatcctcttaaccagctgatacatggcattttggtggagccctttgtgttcttcaactggaagcaaactgtgaggatttcggcatctcatttccctgaatagtgattttttttaaccttatggctcttcatctaacttagacaaatgtcactgagttcttttttaataactaatgaaattacatcaaagcgggaaaaaaagcctgatttttgctgataagacatatacatgcaacatgagatatataatacatatagtgtcttctatatataaaatatctcctaatatataacctaatatgatatatagtattttctaattggttgctgatatatatgggatggagggctaactatatatatatatatatatatatatatatatatatatatatatatatatatatagttaccctctgtatccatggttatgcatcagtggattcaacccaattggttggttgaatctgtggatgcagaactggatatggagggctgatcatactatgcaattttatgtaagggtcttgagcattgcagattttgatatccacaggggttatcctagaactaatccctcatggatactgaggaatgactatgtaaataatatgatatataaaatatatgctaagtatatgctatatataatatgtatattctgatttgggtaggataaggaattaacagatggaaaaatgtttagtaaaaaaaaagttggatttttttctttaaatatgcaagtttatcagaaattcgagcaatttgcttacattttgcacctgtttttgaagttttaaaatgtaactacattagtgatgatttattaagagctattcatcatgatattttcctctgtataagtttgcactgttagatttttaaaaggaatattttcccatcccaaatctagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaaggtgagagcggtaatggatcatggactctagacatctatctgtgtgtctttgctttgatttccctgtttataaccctctagaacagagtttctcagcctaagcactattggcattttagagtggagaattatttgattgggggctgccctgtgtattgtaaaatgtttagccactgctatagaataatatgtacctagtagataacaatattccatgctaattttagaatgctgtcctgatgtttgggggctgctttatcttggcgtttatatctggagagtaatttagatccttcagggaatagccctaatttcatttcttgtctagaaggccatttaacaactatttatttctgaagtggaatccacagactttcaaaaagttaaagcattaaggtctaatgggcagtcaaggataatggaggatgaaatgaaggaagctaagagattgtcagttgaagagatctggtgatcacctagtgtggttcttccatttaccctctgagaaacctgagacctagagaggggacatgacttgccagatgtcatatagagaacatgtaatgggacctgtgaccacggagcaccttttcccaaggaaatagtttaaggcttatacttgagagggagtctagagacaatggactttgactctctctctggcattcaggctgtggggtcatccctatctcttgatataaacccagcaatatctaatacttcacatatcttgcttacaaagatgttcacctcagaaggaacaaaccttttggatttgtatggaatagacgtattttctctaataaagctcctgttggcttttcacagttgattctgaggtcagaattcagggggccatttttgggtgctgttgaggagatagagtgcccaggctagtgttgtgttgggagtttgccatagccgccttcttggtgaggcaggctttttttctgagctctgaacgtttgtgtgttctggcctatttgattctatgctttcactcactgcatttcttccttggtgaggcagaacaggcaaaacctcagctggaatcaacagtattaatcagtttgcccctggacacttagtatcatgaccagatgtttgcaactgttcattgtttgcacaggcaggaggaaatgggccgtagttccagattttgcctcaagaccttcttcgtggtaggttaggcagaatagaaggttattgactttctccaaccccaagaatattgcagcaatgattttactttgtctggtaccctgattgctttcaggatttaatgctcctgcccaacctgtaaactaatgtttttacaggagacattgattgacttatgagaaaaatcctggtgaatgttgatccagggctttagaactaatatgaaggactgattaatgaaaagcaagtctttaaaaatacaaaggcatcaccaacaccctcacaataacgtttatgattgtgtaatgtataatttgttcagtatattgatgctaatctctaattggctcttcctggcttgtgagattctttttcgtaatttagttagcatatctttttgaaaatattcacggggcttcattaaagattggaatacatcaagaatgcagcacatgctgtcatgtctcttactgaaataagtgacattcttttttaacacttgacaccagaaagcatttcaaacattatataccataaggataaacctttaaccaattaatgaaaatgtttgttttctaacatatggaaagttccacataactgagataaggcataaaatgttgtaccagaaagtattgccttcttcttttaattttaattctgaaagagtttgaaagacttgttcacatcttctccatgtgctccagtagttgaggagtaacagcactgagagttctctgttagtcatgtgtaaaattccctaaaatggcagatgatcctaattctgcatttgctttagtctgattcttaatccttttgcagagataatggacttctattgttttttaagaattgaaatataatagactgaattgtcttaaatggtactaataccctttttcttttctggttttagtggcaactgcaccccctgaaaaggtaatttattcattgcttgcaagtctttttttttcaacgctcaaagtgattttctattagaatatgtatggattttttagacttaaatatagtaacatctctattatgcatcatttggtttgagttaatatagcattcagttattccaaaaaaatttattgagccattgtcatagattgggactcttctcagtgttaggaaaacaatagagaacaaataggacaaaaatctctactttcatgaagcttcaattctcgtgagaagaaaatgggaaactaatgggaatcaagggcataaatagaattcaatgtcacctgatggcctggaccatctgtgaaagaaaggctgtgacatgcttagataatcatgtattcttagagcacatatatagttagtgaagtacttcttagttcaactaaaatttaacatacatgtttgaattgagtttgagtaagaacagaacttacacttaaaagttacaatcaaatactagaatgttgctttttgaaaagtcagtctattggcttttgggcatagatgggggctatgaattgtgagacattttagtaggaaatgtaaacatttactggatctaagtcctatttatgtaatattgttccttctctgaatccggctttctttctttaataaaaacatccattttcattaaatgaatgaactttatgtcagagaactactatgatatattgctagactaaattatcgttgcattttgaaatgggatctcaatgcatgtaacaggctttaattttctttttatctccttctgcataataattacatgaaaattaggtaattattaaatatttatacatttatgtaccattctttaagctgacaagaatgcattattagaatttagatgaggcaatacatacatgagttattttaaatagtattctaaatcttataattatgggatagagtaacatatatgtcataacataagtgctgaaataagaaaaagagacttacaattttggagtgatagcactcgtccagaaagaggttatagtattttgagaccaaaaaatgtataacagatatgcatactttttgtgtacttttgaagctcttagcatctctaaagatcagtcacagcgagtagtttgcaattttgttgattttgaatttagtcctggttgatgtatggaagtaattatttagcttgtaggtgggccagccagcatcctggcagcctcatcacgactcagttcttctgtctttatgattgaatttaataactctcattaaaaatctaaaaaacccccaaaattttcttgtatacttttactgcattttatttggggaggagatagtacgaaaaatgcaatcatagcctttgttgtcttggtacttaaaaaagtctcatgatgttatgtgatggatgaagaaaagaaaggatacccagagatgtgcaaaggtgtggtagaggggacagcaagggtcatgaaagacttggtcagaaaccgaattagggactgctttggaaggcttagagtaccaaactgccattgtaatcagtggggaaataccctgcttctcgactggaccgtatttgttaaatgtagaagtggtgtagattaggaagtctgctgcctcacggtgatgggggaaattctgtaaactgcagtagtggattaacacctgatcctggtctgttccttgttggcattggccatggctgcagggaatggggtgcaattgagactggttgaggtcatctctagtaagtaatagaaagctagttttaagaagacagaggaaatgtgggaaaaactattaagtgctcagtatttgtaggagctgaattttggtaggtctactcaagttaagaagaaagaggaagccagttagattattacaataaactgaaaatgagagtgagtccggcctagggtggtgggatctatggatatgaaaaagggtgaacaactgttaagaaaaaagtgtcaatggacggggcttgcaatgaaaaatgaaagagggaggactaaaaggtgactttaaacctggatgggacagattaatgactgtggcactggtagaaatgaagttggaatgagagcctggatggttttggaagggtaggctggaggtatctgtgggatatctaaatggacttaccctgtaagcatttgtgcttgcaaagttggatttatgatgagatatccaggcagactatcttagaaaaagcagaaaataggtgatacttgaagccaggagaagaggataagaggttaacagaggccagaggagtaagctttctggaagaggacagaaccaagtaactcgatgagtacttgaatgtagtgatatgagctccctggtcacatctggtgtgagtgaagtcacagatccttaactaggctaattgttcagtctgcctgagccctgcacagttgtaaatggaagctgagccacggatgatggactgcttctttgcttgaggtccaggggacaagcgtgggcaccaaaatgtgtgatgaagccccaaatccttctccaagccagcacatttctgttgctctgcctggctaccactgttcagagagctggagttgtaaagttatcagacgtgaggttaaagaaggccatagtaactgactggtttaaaatattttaacttaccatgtgttctttgttatggcacatctgctatatccattatttaatctgcaaactgtggctggtcatcttagtggggcagagccacatgtgaatgaggcaatagtcctcgttgggggttagttttgccctgttgcagaccaaatatggacccctgggccaagacatttacttacaagatcagactttgggcctcagggaaatggctgaagatatgtgcgtggattagcaccactgggaaaaatttagggctttccatagtagcaccacatcaaaggttcttttttttttttttttttttgtaatttcacacaattatacatgtaaggtcctatgatatttctttgcctttctaagaatataattaattacataaaaatagtaatatgtgggaaactaaaaataatttccactttcaattcttttttttttcttattctcttttaaaatacaaccatccaggaaataccttcattggatcaagagaaaaccaaacttgagcctggtcaaccccagctgtctccaggcatttccactattcatctgcatccacagtttccaggtagcctgtgttgatctgtgctgtttgtcagagtattctgaataaaaatgtaagacgggaaatttttgtctttgactttgtgtagtaaattactagacttcataactgaagttcagtgttaagtatagtaatatacttatataatgttagcataattacagcattgtaaggattgtagtgggaaagataggttttttttttttactgttttctgtgatcaggagtagtatacactattcagacattattgaaggttatcatttgatgaacgatcatttttcttggcttccgcatcactctcagatattcttgctaaatgttgaacccagagccttgggacatagaacagttctttatatctgacaaatgctgtgatatattgctagactaaattatgcttgcattttgaaatgggatctcaatgcacataacgggctttaattttctttttatcctctgcttcctcatatagtagtgattgaaaaaacatcacctcctgtgcctgttgaagtagctcctgaagcttctacgtctagtgccagccaagtgattgctcctactcaagtgacaggttggtgcagtatttttacattatatatcacatggaggagacgtggggctgagcttcattttaaatgtagtatccattatataagcttgctcatggcagggttagccatactagcaaatatttggaaatcatctaaatacagttaaaaaggaggagtatgtggaaataaattatagtatatatgaaacagaatatcacatagtattaaaataatgtttgaaaagagtagttaatatcatgaggaaatatggcataatctgttaataaatacagaatacaggctgggtgcggtggctcatgcctataatcccagcactttgggaggccaaggcaggcagatcacaaggtcaagagatcgagaccatcctggccaacatggcgaaaccccgtctctactaaaaatacaaaaaattagccaggtgtggtggtgcgcacctgtagtcccagctacttgggaggctgaggcaggggagtcgcttgaacccaggaggcggagatcgcagtgagccaagatcacgccactgcactccagcctggtgacagagcgagactctgtctaaaaaaagaaaaaaaaaaaaaaggactgggtgcggtggttcatgcctgtaatcccagcacttcaggaggtcgaggtgggcagatcactaggtcaggagattgagaccatcctggctaacacggtgaaaccccatctctactaaaaatacaaaaaaattagctgggcctggtggcaggcatctgtagtcccagctacttagaaggctgaggcaggagaatggcgtgaactcaggaggcagagcttgcagtgagctaagattgtgccactgcactccagcctgggggacagagcgagactctgtctcaaaaaaaaaaaaaaaaaaagaatatgatgtaatgattaccattttacttttaaaatttctacaaacacggaaaaagaaagaaaatgcatcagtgttctgttctcaccagttaatactggatcatggataattatgttctttaatatatttttattttcaaagttctgtataataaacatattattttaatcatgagtgaaatagcataaaatgttttatattctgaaacaaatgcaaaattctaaatgtccatatccttaatgtgtattgagctcttataaatcaataggaaaaatactaacaatagagaaatggaaaaataatataatcagataatttgtaggaaaaaacaataccaagaagcatgtaacagaaaatttcgactttcctggtaatcaaagaaaggcaaactaacctaggataataccttattcctatcaaattagtatgtaaaacccaatcaaatttttttattagggtgagattgagactctctcacattgctaaagggagtatgtgttggggttctccagagagacagaaccaacaggatatatccagatatgtagaaagagctttattgtgagggattggctcacaccattctgaaggctgagaaattccaggccaaggaaggctggtgttatagttctagtgcaaacccaaaggcctgagaagcaggggagttgatagcataagttccagtctgagtctgagtctgaaggcctggataccgggcataccagcgtctgagggcaggagaagatggatgtctcagctgaagtagagcagattgccttcctcagcctttttgttgtgtttgagcccagcacccagcagataggatacccacccacgctgctgagggtgatcttctttacacagtctaacaattcaaaggcctttttcttccagaaacaccctcacagacacacccagaaatatgtgatcagctatctggacatcccttagcccagtccagttgactcatgaaattaaccttcacagagtataaagcacaaattggcaatatgtataaaaaacttcagaactattcagaacttttgacccagtaattctattttaagacatcttgtctaaggaaataatattcccaaaggctgtgggtaggagtttatatgagtggttacctatcacagacaatgtataatacagaataaatagaaataactgtacattcaactacagggaaatagataattatgttacatctatacattggaacattatgttgccaccaaatatagtatttttgaagaatttttattgaaatatagcaggaagtagtcatacaatattgctaaatttaagatgaaggataaaaaactgaatgatatagagtattataccagtttttttaaagacatatatacactgagaaaatgctgggagaaaatacactagatattagcagtggtttttttttagtggcatctgagagatttaagtgttttattttagatttttttattttccatattttctaaactgaacagttatttttagagtcagcaaaaatgtcactaaggggcatcatcatcaactttaactgaatttatgataccactgcaggatgaggttgacaatgtgttataggagctaaatggaagagtttggagcctcctttagaatattccctcctcagaaacatgttatggttcctttctaatagaaatgttctcatatgttaagcttttggccacttagtgagtcagtagaacaggagcctcgcccttcagggtgcagctacagtcacctagccacggctccagatctagacatccctgcactctaaggggctgggaagtccctctttcaccacaggctcagaagtgcctgctgtcactccttggcctctccccgctgccagcgcctgctccagggtggagcaaagttgtggccaagcccaagtgctattgcaacccagccagttgtgcatgtgcttgggtgagtgttgacatgccagtcccctgtcgccttggccccctctggacattgggcaccaatgagcatgggagggaagctgagggtaagctgagggtagctcagtgtgggcttgcaggtgcccctcagcatgaatagcctgggtgtgtggacaacatgttgatggagggaggcagacaggttcctgggtggaaaggggtgagtcctcagtgaaaccccaccttcaagccaggaatggcctgaagcctgggggccaggctgccagttccaggtgtagtccacggtccagagtgaagacttcatcgataacagtttggccaatcagatggtgtttttctaggccctccatgatcacccatggaccaatcagcacacacttcctccattctgagcccataaaaaccctggactcagccaaactcacacagatgtcaggagtaccagctgtgagaaggagctacccacttcgggtctcctcagcttttcaggatgacgtgcccgcagaaaggagctacccactgtgggtatcctgagagctgtcacgtcactcagtgaagctcctctccaccttgctcaccctccagttttctgtatacctcattcttcctggatgtgggacaagaactcagagcccaccaaatggtggtactgaaagagctatgacacaaacggggctgaaacatgacccccccactcaccatgttgagggtgccgagaagggaagaagagctgtggccctttggggagcccaaacctaggggctccccaagccagggctgtaacagcctctttggtgctgtgtggtttctggcatctccgagctttcgggcagcactgtgtccgccatctccagatgctggtgcctgcagcagaagttactggcagtatatctggtccagccacagcctcacatgaagcctgcacctgtgccagcacctggagctgcccagtctgctacagcagctgggatgcctggctgtgtgtagtggctggaccccatgcttgcttgctcacacacccctcactgctccacacctggcttgcccttggcaagtgtgggatctgggctggcagcacaggccaagcacagcctgctgggctgagtgggtagaacaagctcagtgggtgcaagcaaaacttgggcaaagatgccaccagccacagaggttctggctggcaaagtgataccccaaggatcctgtgacaaaatgatggtgattttttttaatggccatggctaaaattgttattctctattctgaggtcatgtatgtatctacccactttattgagcacactgataagagactgctttgtgctgcaaagtatacaagcaaataatacactattttggacagcaaggatcttctaattgtttatagtaatgttaaaaagaaaaaaatgcagtaagacattgtaatttactagttctttcaaaatactgcatttcaattttttcaatgtgaagataaactctagttttgaatgggcatggctgacttaaatggacaaacctctttcaaactagctttgtagaggttaagttcagttaggtaaatgcagtttcaacatttaaatgtagctgtgtgaagggtaacaaattgaagttactcagcttcaactgaactgcagagctggttaaaaaaacaatgcaagtagccttgctataggaagttgttaaaacacaacttgttagaggcttaatttgagtttggcagaaatacagggctgacatctgctgtcacatgtttgaagcatgaatatatccttccaagaaacaagtgatgcagattttcttttcatgcaacagttgtaggtacttccactttctgtagtaaaagaatatttctgaaagaatccatagggggaacagtatagatagtctttgaaatgaagtggtttgcaactttagagctacactatacatagtgatctgcattagcacaagaagactgttttgtatcaaatataatttaactcaaaatgtgtatgttcccatcggtttcatatgggagccaaacacagatttaaggagcaatctcatcagttctctcaggaatattgcataataatgtttttgtctctaaaacacagaggaggtaaatattatttgttactgttagtttctcccatgattgaagacagggatagaacaatacgtaagagtctaaaatgaataccatcagctccacattgtttagtgattatatctttacgatggtgaaattggaagtagccttttcacatttagctaaacacactttgacatgtgataattataaagtgagccacatatctgcaggaaatacgtgtgatgttttccactcttaacagctgacttggtggctcgcaacattattggcataccattttcaagtgaattatatgtttcagcatataaattcttgatttagcatagtgtcttaatagctaaaggataggttgggaaaatcaaacttttatttctctggcagatatttacaaagtggaaacatctgtttcaattgttgtgggacaatctatgctcactgtggggcagttaggaagccagggcatttttgtaaacctttccatgagttaacatttgatgccttcctctggctcttcccaagctttctccatggctcttgcagactggtcagaaattattctttgactgagttaactgccttgtggaaacctctgtaattatcatggcccagacatttaaaaaaactatttgctcatcagatcttttccagaactcagaaatgacccaaaaatgtttgtccctcaagcatattaccagtgtcattactgcctcaataaactgtgtatgcggatagaaaatgaactcttttatttccatgtgaaatcatcatgctttagtatttccagactccattcattcattcattcattcattcattcattcagggaatcacatgatgaagaaaaaagctaaaagtcagtatagtcattttcatattttgctaaaagctttctgtttcatttaattttagaaaatagagtaaaaataccacactgttaaatctaccattggccttgttgctggtataaatagagtatttggttttccatcactggctttctgtcatggccctttttccatattctagatggactccagcaaaagaaatagaataaggtccttgacctggtgaagatgaggttttcagggagcagatatagtagggaagagtagggctgtcctgtgaaccaggtggcattatgaaggacatgtgagagagtccagtggggagcactcacttaatcgtctctctgcaaagccaagaaagccaagcatgctaaaaagacaagacattcccattcaccagcatacatacccctgacacaagaaatgagtgctgtctatgtgaggcttgactctggtgtatcagacagagcccagtttctagagtttatattgacacagtttgctcaaagaatcatattcttctacatgaactgatctactcggtgggaaaaggtttgcatgccgatgtgtgagtgaccacttaggaaaaatataaagcatcttgtctttgccctaaaaaacagaaaatgcagaacacttttcctgttctttaagacaacattctcaggacttgtgtactgtctatgtgctcaggaatgaaaacctattagaaaaggagagaaaacacaggggagatatgagggagacatgttttatatgttttaaagtataagtaccagtaatttatttttttacctgatattcaacttttttttttttttttttgaggcaaagtctcgccctgtcactcagggttcaagcgattctcctgcctcagcctcccgaatagctgggactacaggtgcccaccaccacacctggctaattttttctatttttagtaaggatggggtttcaccatgtcctggctggcctcaaactcctgacctcgcctcaagtgatcctcccttctcggcctcccaaagtgctgggattacagacgtgagccactgcacacagcctctgatgttcaactttttgataagtagtgaatagaaagcagacaggggtgttttgaaggtgtgatggttgttttctgtctgcctacaagagtggaatccttggctcacgcctgtaatcccagcacttggggaggctgatgtgggtggatcgcaaggtcaagagatggagaccatcctggttaacacgatgaaaccccgtctctactaaaaatacaaaaaaattagccgggcgtggtggcgggtgcctgtagtcccagctacttgggaggctgaggcaggagaatggcgtgaacccgggaggcagagcttgcactgagccgagatcgtgccactgcactccagcctgggtgacagagcaagactccgtctcaaaaaaaaaaaaaaaaaaaaaagaatggaatcctgcctggcaaaggatggaagggatctctgaggtcaaactgatgacagttacattaattaatcacttgtgtaaaaatgggaagaagtagaaatcaagtatgtttcagaaagtgtccctctttcctttgctgtatctcttagtaccctctagtggtgtcagcctaacattttcttacatgtaacgtgatcctgacagacatgttcagcgtttgcaagccacgtctctatatacttatgtatgaggtaatcaactaaaaatcaacaaacattttttatcaaattccaacctcctagcttctatctaagatattggattggtgggaaaggccattattactcattttattcctaagactaaagagttatacttcttcactatttctcctacctcagagctgacttttgagaagaaacactttagctatgttggcaatttgtggcataggaatatatcacattttaattaagcatcacatatatttgaagacttgttcacacatataaagaagttccattctaaggctgtccctgccaaatgacaaatacttggtaatcaccaaattggtattgtgggagtgggttagtgactactcatcaagcttttcatgaaaaccccagatttatagcctcttaatttgttctgaacccttgccctgaatatattaattcaccttctaatttttttttttgcaaatatggtcaacatgtctttctgctttatgaaaatgtcagagatgagtataaagataggtcaataaccacccgggaaaaaacccaagaaatctaaacaccagtaacttgcaaaggaagcttctatgtataatatagagtcgtgtgcatctcatgctgtttcactaaaaaattcctataaacagaagagaattcttacctgaaagtccatgagtataacctggtgaagattaccttttaccttcagattttaggtacatacaagttatatttttaaggaagacttttcagattatgaaagtgccaagacatgcttagtgtaaaaattttaaaaagtaccaaaaaaaatgaagaaaatgctaatcctaaaaaccataaaacttggatctacttccctccaaccttcttttctgtgtgtattgtagtataatggagattatattctatattataatttgtgcctgtgtttttttaacaaataagcattttcctatcttgttaatgattatatgctgtgctgtatgtataattcattgttttgtgttattattgccagtcacttaagtttaggcagtcatattaattacccatgtttttagccttttgaattatttttcctataatttgataatattttcactataaacaaatgtatcttcctgaaagtgaattaacataactagactcacaaaaggtataagtaatttgtaaatacatggggtgtgcatacatttctcatacatccaggtgactttgtgtaaaatgctgaagttcatatgcttcctttttcagatgacttgcatgagtagtctcaaagtcacagcacagtgaatactttatgaaaaatgaagcatgtggttttggtttcggagagcaacctcaaccccaatttaggtcatttccatagtgaatctgtgttaaagcactgttttccacatccttttactgcagaatagacagtgtgttattagcgagaatagcccacctgcttttcttctcattcaaaccacagacctctctaacaaagctgtgctcctaggttgtcatgctcagaggcgccaaactatttaccttggagggtcgcttggcctcattcataccagcctctcttttgagccttgtttactatacgatgacagataatagcccaaggtagtattggtataaatgtgttggtttttaaatatattcttaaatgacttcaatatgaacaataatggtaacttttattgagcacatataatatgccaggcattggctacatgcgttatttagagcatctctttcattctcatactttgaagttggaactctgattatttccattttacacatgtagaaaagtgaggcatagaatggtgaggtcacttgccccattctgcagaactgtaaagggcagcagcatttgtgcctgcactgtcttcaagccagtgcttctaaccaccagctgtgccaccttcactaggccattagaccttcttacaaaggacattggaaacagaaaatcttaaaggagtaattaatctcagaaggccccctttgagtccttgggtttttttttgatggactccacctaaccatggactcctaagaccctccctccactgtagtgtatgtctgtgagtagactgaggacttgaacagggctaatctgtacaggatatatagaagaagccagtcttacacagggctcagtaagggagtaagggaggaatttagcagaaaagatttgggaaaagattctactttaccagtagaaataaaatatgttcattttgaaattggcaaataagagtaagatacaccaagaagtttttctttgtttagaagtgggaggtctttggggggattaatgataaattttggaggagattggatgtatttgttgaaactcaaatatggcctgctaaagaatggaaagttacaatgtgtttcttatcaatagataagaaatctcttacctattggtgattcagactctatcatctaagatgaactacaatgaatagaaactcattaataggccattttggaagctgttttattaataattgattttcttacaacttacaacatggcctttttctgagtttcttctcacttcagttcatcttaaaaatggctttactaggaactattgatgtccttggataggactaactaatccattataaagtaatcacatgaatttatacttgatgtcagaggtcacctttgtcttctaaatgtagagctggcaataatttgctagttggtcaggaaactcaaagtaatactttgagagtagcagtgaaatctgttcatttctgtgggttttttcacattattttatttacttttaaagaaatcaatgaatgtactgtgaaccctgatatctgtggagcaggacactgcattaacctaccagtgagatatacctgtatatgctacgagggctacaggttcagtgaacaacagaggaaatgtgtgggtaagagacaatttgattgactaaattattaaatatcaaacatttgaacattaagaacatttttttcttaaaccaacttaaccattttgggaaagtgttactggtttaattttttgaaagtttatcccttagctaagggagctcaaaaaaaggtttgctaaacaactggaattctcttacctctttgttcaacatttgtttacctcgcaaatgtaatatatttacataaaggtgaaataatttccaaaagctttttgggtaaagtaaacaaaatatgaattacagaaacagctacctaaaaacatgtatttagcaaaaacaaattaacattagtgtatactgcagtaaagaattacattcatttatgtacataagacttgatttttttaaagggattttaaaattgaaaatccatatatgctggcctgaaggtgtcagtcaatttagaaatttagggatctcatatatgctccttttggaaaaaaaaaaagtatctcagaaagatatgcagtagagttaaataaatcattttaatgtgactctaaatttaatttctctttttttttttaagaaaaagaaaattcagcactaaattatgaggccaataggaagcaacaaaggaacatatctaattaatacttctttagtatatgtgaattttgctgtttggtgtgtgtgtatgggggagaaaggagacagccacctggtccataatttggctatttccttgtcatttgtatacattatatgtgtcactttcagaacctagaatattaagttagaaaggcaacagagatgacctaatccaactccatccacatgcacggaggaagagtctctttcatggcatttctgactccctactgacagcaaattccattgcttggatgtctctcgttatcaggagaatccttctgtgttgacctgaaatctgcctctttgaaacaccagtgtcatggttttgtagttttagcctttgaagtgatacacagtaggctgcttctctcttccaggaacaatccttcaagtacgcgaggagaaagatcgtgtctccttttgctgttgtcctcagttataaaggttgggtggtacccagggaatagtatgatggtattttacagaacagggaaactaagttcttgctacacagaactaatatttttatatgtatttttgttaacagatattgatgagtgtactcaggtccaacacctctgctcccagggccgctgtgaaaacaccgagggaagtttcttgtgcatttgcccagcaggatttatggccagtgaggagggtactaactgcataggtaatggcagcattcttcctgcttacaaattcttagatctgagtttttagatcccctaagactatcatcagttcagtgcttatccagacaacccagaattttttattaaacaattatcatgacagcagtctgctagatcccaggtgatataaaaatggatttttttcccctaacatttttgaagaaagagtgtcatatatgtgcatagacaagatacattaaatgttacttttggaccaccctgcatgaatcaaaactggatgattttgatgtgtgtcaaacaaatcaaagggaaagtagaaatcagttactggccaggcgccatggcccacacctgtaatcccagcactttgggaggccgagcctggcggatcacctgaggtcgggagtttgagaccagcctgaccaacttggagaaaccctgtctctactaaaaatacagaattagccaggcatggtggtgcatgcctgtaatcccagctacttgggaggctgaggcaggagaattgcttaaacccaggaggtggaggttgcagtgagccgagatcacaccattgcactccagcctgggcaacaagagcgaaactccatctcaaaaaaaaaaagaaatcagttacttcgttattatatttgagctaagctgggagatgggagaggtttgaaacagtatttggaacacaaaactcaacaatgctatctgctcttcgtagatgttgacgaatgcctgaggccggacgtctgtggggaggggcactgtgtcaatactgtgggggccttccggtgtgaatactgtgacagcgggtaccgcatgactcagagaggccgttgtgagggtgagtcagctgagagtgttcagcacacatgacggtgatgtgcagggttggtaggcaccttgcctggttcttgtttccttcccacactcagtgcgtgacaccagtttatccaagctctttctgcttcctagattcacaggctctttgcctcttcctttcactggctcttttgggattattttccatcttcatgctctcattatttttcacctcaatatctgcctctctggtatttggaatgaaatcaccatagaatgattaattgcatcatatttagtagaaacacagacttaattacagagtccggaccattcatctgggaacatgctgcaggtgtaaccagtgttgattttttgtttttgaccttttcacctacttacattcctttgtctccaatgctttcttttacatgtgttctggtactttctcacagactccccaagaagcatggtctgacaaactttggtcagattccaactgtgcttaataaaatttcctcattattgaccacagcaatgagctttctctcattataaaaatgttataaaaagtatttatagcatggtcacaattattatccttttcatatttcttttcacgtttgtgtccaagttgctctggttctttttgaaaccaatgtagtgaggccaggcacggtggctcacgcctgcaatcccagtgctttgggaggttgaagcgggtggatcacttgaggccaggagtttgagaccagcctggccaacatgctgaaactccctctctcctaaaaatacaaaaattagctggatgtggtggcacacgcctgtaatcccagctacctgggaggctgagaaacaagaatcacttgaacctgggaggcagaggttgcagtgagctgagatcatgccactgcattccagcccaggtgacagagaaaaaccttgtctccaaaaaacaaagcaaaacaaaacaaaacactatggcactttttttgcaattattttcatgaagaaatacactgaccttctgctaaaaacctgtcatggaaatatgagggtgaaggaacacgggatctgtgagggcacgggagcatggtgctggttccttggggttccctgcctggctgtcagcagagcctaatagatctgggctctgttaggtggggcaggatggactaggttggcacagccagccctcagctgtcccctggcttctgcctgttggttttcttcactgctctaatgacccaggcctggagggagagctaattagacattttttggcagcctacacttgcccctcctgctggtgtcttgcctctgccccttgggttctaatctagagagaagtgggagtgttttatgttgctggatctctgatcagcatggagttttgtaccctccccgagggccacgaggctacagaacaagcacaggtgtaaagtgtctccacgctgctcttccagggaactctcctctgctgaagagatgcagcgtgggagcagctcaccacgcccacagtaactgcctgacctgtagccactgactttgcccctttgaaacgtagtacatcatctgtaaaataggaaccatgaagttaactttccaggttttcatgaaaataacttcatgttgccataacttgtatgatgcctgtcactttgttagttttcaagaagttatagtttctttaaatctccccccatccctgactccttttgtgtttgtatagatctcaagcacctctgtagttgcggggagtgctttaaaaaaatggggtgtttatttgacaagcatttatgtgcagagcagtatcccccaacccccaacaaagaagtcaaatactgatttttttttccctttctttctttctttctttctttctttctttctttctctctctctttctttttttctttctttctttctttttttttttttttttttaaagacagtcttgctctgtcgcccaggctggagtgcagtggtgcgatctcagctcactgcaagctccgcctcccgggttcacatcattctcctgcctcagcctcctgagtagctgggactacaggtgaccgccaccatgcccggctaatttttttttctatttttagtagagacagggtgtcaccgtgttagccaggatggtctcgatctcctgacctcgtgatctgccagcctcagcctcccaaagtgctgggattacaggtgtgagctactgcacccggcccaaatactgattcttaagttctacacacgggtcaagaatggaaagataagatacttaagtaataggatggaaaggaatagaaaataaattggaaaattatgtacttaaattggaagcttgtaggagaatattcggtgatattcaatatatgaaaattatttgggagaaagatgactagcgttccctcagtaaataatatataattctatccccatgaaaagtcttgaaaagaagaaggagccaagaaacgcggctgttttcaaatttcatcatggactagaaccaaacgtccccgggcttctggcacacagaagattttctcagctgtcactaacgaagttgctttcaaatagcaccagtctccaaggagtctattgtagtttacagacattatctcatgcatccttactttattctgttaaggtattataaggcaggtagttcctaatttatagaagaggggaaaagccgaggtgagagcaggtagaaattcagggacattatcttgtattgctcaacattgcaccctatttattgggctagcctgtctcgatggcattctctgatttagcagttgtagttctatttttttgaaatatcccatccagaggagaatgtaatgctatttggaaaatgaaactggcaagcaccatctttttgtagaacaagaagtcccagaacatctgacctaaaaaaaccactatgtatcattggccattggcaagaatttttactgatagaaaaaaaattacaacactgacctggtgcttattttgttaatatcatctttaactttttcactttaagtatcttttcacatgtctaatggtatgcagtgggagataatttttaagtatttactagaatgtagacatcacatacccatggatatttagtggacccattatatatttctttctttttttgtttctctagtttatgtcctgaaaatccgtttatattttaagtacgattaaaggtcatatatacattgtgtattgggatacttaaacattaaatccactcatataaattcaagatccacctcagaaaaaacacttatttcaaatgcagctagaagccatggtgttaacacttattttaaactgttgaactctctcttatatctttttcctcattttattgtttgacaatttttaaaaatgcctcaagctgtcgtagttatctcctcacagacttaaccatattttaggagatttttttctccccaaattggaaagaatgatgattaatgacttcagttagctatgaatatgaaaagtaaggtgtatttttaccagaaaatattaccatatggtcatatcaccgtgttttctggaaaggcttggaagtatgtgatgagttcactctctcctcatgtttttttttttttccacctccaaggaattcctgtcatatgaaaggttttaaattattccaacctaggatattcttgggcccatgaagccaaagtgagaatttccctagagcatccaatgtttgcagagagaacctctagctgggtggatacatagcttcctcacactcacccccattctttgtatttctttctggaaagctgtgctattacttgaaaggtttcatgtccagaaattggccctagaggagctgccaactcccagagtggagaggccaggtcctgctagttgaagaattggggccaggttcttccttggaatgtatgcaaatattttaatccaggtatgcttgaccatgcattattgccatgtatttaagtatagacccaatgtctcacttacccaattattgtttttcccactgaaatgtagatataacatgctttcccccgctgccttcatcacaaagtaagattttgctttggtattctgataaaatgttcacgacctaggtttttgatttttcagatattgatgaatgtttgaatccaagcacttgtccagatgagcagtgtgtgaattctcctggatcttaccagtgcgttccctgcacagaaggattccgaggctggaatggacagtgccttggtaggtactatagtgtacttatcaaagatttgtttcttctgcatggcccattttctgatagagtggtgtaatgccaatggagccctctttcaaaatgaaaaaatgaaatcttacatcattctaagaaaagttcccagtaacttttaaccattgagaaaataagaaaatgacttagcataaaggatgtaagattctcgatggggaaaataattaggattgaaacaaactgatattcctaatgagataaatatccaaaaccaaataagatagtaaggtctacaggaaggaagagagatggagagcaaaacacttaaaaagagagaagaagcatctaccacagacaagtagaattaggtaacacacacacacaaattttcaacagaagtatcaaaggtagtgctttaggcactgaggaagacagagtaatgtatttgctttgattctaattacccgtgctgtagttagctctgccccttaatggttttcatttgtgtctaccatgtaatctttttccctaaaacttgaactcttttccactccataccaaaactctgaatatgtgagttaaacttttcattcattcattccttctttcctttctccctcaaatgcttaagaacttactataggctatgcatggtggctcatgcctgtaatcccagaactttggaaggccgaggcacgaggatcacttgaggccaggagtttgacaccagcctgggcagcatagcaagacctcatctctacaaaacattaaaaaacttacctgggcttcgtggggtgtgtgcctgtaatctcagctacttgaaggctgaggtgggaggatcgcttgagtccaggagttcaaggtttcagtgagctatgattgtgccactgctctccagcccgagtgacagtgagaccctgtctctaaaatatgaaacaaaaggcaaaacttactgtatatccccagagttgtactaagttctgggatatattgagaggaaaaactgatatgaccccttccttttggtacttactgtctggtgggggagactgacatgcactcaaacatctcacagataaatgcaaactcacagatttgagacaagcactagaaaggagggttctatgatgctgtgagagcatatggtagaacgagctgcccttaggaaaattcttgagttgaggttcaactggtgagggggtgggagggagaacatttcaggcacagtaaacagcatatgcaagaggctcgtggaagaagaagagagcagaaggccagtgtagctgaaggccagagaacacaggaagatttgctgcaagatgagaggacagaccactgaaaaatttaaagccctcttagtcctgttaaaactgacggtcttcattctcatagccctgggaagacatttaggtgttttaatgggggttgcagaagtactctcagttttaaagctttagtctcatcaccaaacagcatcagctcagactctgtagctggtacggagagctccgtgtcctgagcccctaggcccatccccaacccaagagtctctgctgatggagttgtgagatgtagtctttgaagaaaagatttttattcattagttttttatttgataagcaattgtttttgtaactggtgctgaccaaaaagtattaatatatatggtttcagttttcccatttggcataaatttcatacttgcctatcaaggttccatgcgtattctcattttcacatcctgataaataatccaggagcagagccggaactctaccttaaataactacaattcataatagtagtgtaaacgcagccctgattcatgaatttattagtggaatgtgactgatcaaattggcaagtgattgttcttcaatataaataatactaaatgaattcttatacctatatgtgcatatatatatatatatatatatatataaactttagtgatagaagcacagcacctcatttaaaactaattttactttgtcaaccagatgagtagaatcataagcagaaatattagatcactgcatttctcaattcagccaaagtcccacatttagccccttgttttgtttttgcgttgctgaggtcatgtatttcctattgttaaatggaggcagtgtcctttatctttctgctttgggtaaaattttaggctctacataatctacaaatgaagccactcccccaagatttaattgcagttccatccattgttcatattggacttgcagctcttctaaatttctcatgagggcctttgcaggttatactgaaatagattttccatcttaattttttatagtagtagagctttcaaatgtcgagaagttgactgtgacaaaaagcagatattgcagcatgcctttctacttacattgaaccaatgggtgggttggaattttctgctaaactctgaccatgttaatgactgcccagccctagctttgtacttctggtactctaaaatacctttcagaaggtgcagtcttgtcttaagcctagttttgagttgagctcatcactaacataactggatatatattcattcatttaacaaatactgagtgtctaccttgtgccaggtatttttccagaacactggggattgagagtgactaaaataggccaggcacggtggctcacgcctgtaatcccagcactttgggaggccaagacgggtggatcatgaggtcaagagatcgagaccatcctggccaacatggtgaaaccctgtctctactaaaaatacaaaaattagctgggtgtggtggcacgcgcctataatcccagccacccagtaggctgaggcaggagaatcgcttgaacctgggaggcggaggttgcagtgagccgagattgcgccactgcactccagcctggcgacagagcaagactccatctcaaaaaaaaaaaaaaaaaaaaaaagagagagtgaataaaataaagtttttctcccttcattgtagttatactctagtgcttacgtcgtgcttacaaataaacacataagcaagtacaatatataggatgtcagatgtgatgcatgacgtgaagaaaagtaaagtaaaagattcagagtctttagagatcccttggtggtcaggatagtcaaatgctaagttattaacatgctcttcctggctagtcatttgttttgtctctaactgttacctgtgattatatccttttagttctgataatataggatatattgatgaattttttgccccaattgttaatgaaaattctccgtgataacattaaagactttttttttttttttttttttttttttgagacggagtctcgctctttcgcccaggctgaagtggagtggcgccatctcagctcactgcaacctccacctcccggattcacgccattctcctacctcagcctcctgagtaactgggactacaggcgcccgccaccacgcctggctaattttttgtatttttagtagagacggggtttcaccatgttagccaggatggtctggatctcctgacctcgtgatccacccgcctcggcctcccaaagtgctgggattacaggcgtgagccaccgtgcccggtcattaaaaagtttcctgcaatcacaccattttggtgaaaaatcctacatttgtcatttgttagttgccatctgtagagatgataatgtctatctcacagggctgccgtgttccataaatgttagtgtctttttttctaactctcctctcactgagtacatgtttttacattgttataatcaaacatgtacaatgttttatataacatttcttaaatttcacattatgcttatagttttttttctaaactggtctatcttcacgttgatttgactctctttctattgaatgacttcattaagcattgctattcaacccctatattctgcagggattttataccagttacactttctgcttctttcacagactaaatgatgaacttggtgaaaccgttaatggcctctttgtattcatgacatgtaagctggatcttactgattgatgcttctccttgatttataaattagagcagaaattgttttgggcagaaataggcaaaatgttagcaggtgttttctgagggactacattttttccctagtgtttagctcaggtcatacaatccctcatcctcaatagtttattatccacttcaaatatctatcatttcagactgtacctaacacacatcatccctaatgctttttggcaactcttgttggctcttctgttaacgtagcttcttctttcaagtcgtggatttcattcttctctagagagtcacgttcgtcattcggcactgtattccttggacctgacattcagcctggagttgctgcccactcgatccccacctttaatgactatttcatcactctgggttctggccagttccaaatggctatttcaaccaagtcctttcttaagggaagccaccctgtcaggtactcaatttacaggttcttcttggcttgtggagatctggcctgattgaaacccgatgagagccatcccccaaggaaactctctaatatttaattatttaaagatacatttgatattgctaatgtagagatcttagttccctgaatttagacagagtttgggctacatgacctctctgaagcttagttttattatctgtaaaatggggattgaaatacttgctgtttaagctttcttgccagaatgaagtaagcaatatgaagcacctagtaggcatctgacatatggtggaaccccatccatgctacaaccctttttccccaactattaccctcctctatactgctcttgtcctcaaacataagagatgcagtaataactggtacttggtaaagtaagttatgtatcacattctttttttttttttttttttttctgagatggagtctcactcttgtcgcccaggctggagtgcaatggcgtgatctcggctcactgcaacctccgcctccagggttcaagtgattctcctgcgtcagcctcccgagtagctgggattacaggtgcccgccaccacgcttggctaatttttgtatttttagtagagatggggtttcaccatgttggccaggctagcctcgaactcctgacctcaggtgatccacccatctcagtccccgaaagtgctgggattacaggggtaagccaccgtgcccgggtcacattcttctatataactatattctctttggctttttgaagctcatgtcatatagttttttaattcttcttatgtcattggagcattctcttttctttctttctttttctttttttttttttttgagacggagtctccctctgttgcccaggctggagtgcaatggcgcgatctcggctcactgcaacctccacctcccgggttcaagcagttctcctgcctcagtctcctgagttgctgggattacagctgcatgccattatgcccggctaatttttgtatttttagtagaggtggggtttcaccatgttggtcaggctgttctagaactcctgaccttgtgatccaccttcctcagactcccaaagtgctgggattacaggcgtgagccaccgcacctggccttttggagcattcttttatgaatgtaaataattttgtggttcctgttcaatatctcccatccaaatactaactgggcccaccctgcttagcttccaaggtcagactagatcgggcacgttcagggtgatatgtctgttgactccttccaacttcttagtgttcttacttagctggaatatacttcttgggagccatgatacttctctgtagggtcattagtgattcctaacaaatgttcaggcatctataataatgctgctatttccattcctgtactttattgtctctgctcaccttcacaaggcagaatatgccacctattggatatatgcagctagccttttgggggttgtcttgctttgtagttcagtttgtgatagaacttgagacccggtaacacaaaattctgagattttgtcagtgtaatctttcttttttaacccctgattaagttgagaatgactttctgactcccatttaaactctgtgaatgtaggtcttgggtatttgaagaatttagtatcattcagtctacttgacaactgattagctacagtcttaaccaagacctggcacagagaacttgaagaataaacttggacagaaaacatggagaactcattgttctagaagttcttttcacactaggctttattttcagatttgaagattcagtgttaactttcatggcttatatgaatattcatagactaatccaaaattgaagacttggtacagcagatatttgttttatagaagattgcaactgagtacagcatgtacctttttcatattttatgtgcaaacattagctttatccctacattattatatgctaaaggatgcttctaatcaatcactaagctatttattgagctgttgtctgtgtatctatatgccagagaagattggcagttataaaaacacccacccaaatgtccaacaatgatagactggattaagaaaacgtggcacgtatacaccatggaatactatgcagccataaaaaaatgatgagttcatgtcctttgtagggacagggatgaagctggaaaccatcattctcagcaaactatcgcaaggacaaaaaaccaaacaccgcatgttctcactcataggtgggaattgaacaatgagaacacatggacacaggaaggggaacatcacacaccaggacctgttgtggggtgaggggagggggaagagatagcattaggagatatacctaatgttaaatgaagagttaatgggtgcagcacaccaacatggcacatgtatacatatgtaacaaacctgcacgttgtgcacatgtaccctaaaacttaaaagtataataaaaataaaataaaaacaacaacaacaacaacaacaacaacttttgaaagcaggcagcatggtttgtgggaacattaattattataacaaaatccttctcattgtatagtttatgaaggttttgacatgatggcatcatttgatcctcacagtagtcatctctgtagtacaagtgtggaaattgattcccaaacaagtgaatgggctaactaaaggttataggtaataaatgtcagaactaggatgtgacctctgatcttttatctctaaatccagtgttttgttctgtacaatgtctcatgtacccttcgtgtacacgtaagaaaactaaagaacaaaacaatataatgaagacaataaggaaaataaaagagcatagaaaggagaaagccacatgggctggaatcatcccttgcaagcagcagtaacaatggcttgaggattctagagtttgagacagcaagtctgcaccatatgtagtggcagttgagttttgctgaaagataaaatgctcctttggaaaggtgaggtaggaagccaataatttggtgggattagtgattggatttttctgagatcatccttggctctttatgtaggatgtgcatagcattcattggttcttctccagttctgcaaagccgtgatgattctttgaggattatgtaacaaatgtttgtcagcagctctgctgctactaccacatattttaacttcatcagaattgacagagggggtgtgagattctgaggatctactatacctcaaatgcagttgaggtggtttcatcacactggctggaccaacatctgtctctcattttgccatgcttgcttttctgccaaatatgttcttccatcttctttaatataaaagattatgtgtgaagaatagttgaggagtcgctggagtaatgacacatttggggtaggggataatcctgtgttttcatgtagctgtagtgctagaataagatgctttatccctatctcaagtggtactcactcactgaagcctgtattggtgattaaggaacaaattgaatttggatagccttagagaaataattggctatgttgacatactcatctcattgaaagtacaggaagtaatacaggtaaattactgctccgggacaaattctagccaaccccaagcagctgctacatgaaatgtaagtgagcacaggctggggagaacatgactgggtgacatcagccactgaataccctctgtacatggtgggctgtgcccaccagggaggggcttgagacagtctggtatgttcccaggatattaggaagggaaattttaaattttaaaaggttcttcacccagatgaattacaccccaaggcaacgagacaatgagccaggtgggattactggccagctgggagtcatctctgtgaaattgtggagaattgatagttaccagaggatacggagagagtaatgttctcatttccccgcaaaaagaaaagaagttggaggccaggtgcggtggctcacgcctgtaatctcagcactttgggaggccgaggcgggcagatcacaaggtcaggagatcgagaccatcctggctaacacagtgaaaccccgtctctattaaaaatacaaaaaattagccaggtgtgctggcaggcacctgtagtcccagctactcaggaggctgaggcaggagaatcgcttgaacccaggaagcagaagttgcagtgagccgagatcgcaccactgcactccagcctgggtgacagagcgagactctgtctcaaaaaaaaaaaaaaaagaaaaaagaaaagaaggtggagtctgggaattactgaccactgagcttcatgttaatcttgacaaagaactgtagaatgcatgattcaaatgatgagatgaaacattttaaaaaggaagtgatgattataagaaccagtcaggattcgttaaggataaatcatgctagactgtcctgactgcctttcctgatacagtgattagatgagtagaccaggaaattctgtgggcatggcacatctagttttcaacaatgtacttgttagagtctctctgggcactgtagatgagaaggatcaatttggattgggtgataggattgtaagatggatgcatacatctttgaactatctgcctaccaagtctgacctgatacctcggcaagtttcttaccctgggaggtttaattaattcattgagtggcaaatgccaaattgttatgtctcaaaagcccattggtaaattgtttgagatttagaatccatttttcttttctttctttttttattttttaaagtgtcaaggtcttgtccaggctggagtacaacagcatgatcacagctcactgcagtctctaactcctgggctccagtgattctcctgcctcagcctcccaagtagctgggactacaggcacgcaccaccacactcagctaatttaaaaaaaaaatttgtgtgtggagacaggggcttgctgtggtggccagactggtctcaaactcttgtcctcaagcagccctcccacctcagcctcctgagtttctaggattatagacaagagccaccacacctggctagaaccaattttttttatcaacactgttttttattatatttcctaacagataaaacgcaaaggcctgttgaactcattatgtatatgcactggaagaatttgggtaatatgaacattctgtaagaccatatcttagagtaagacaaattttgagctctaccatgaaaaccagaggcataatcatctccctctgcttcagggaaaaggcaaccatggggtggatggtggggtgggtaggcaccacctgcttccttcataacccattttgtgttgctgtaacggaacaccttgagactaggtcatttatgaagaagagaggtttattgatttagctcatggttctggagactggcaaattcaagatcagatggccacttctggtgagagccttgtgctgcgtcttaatatgctggagaagtggcaggtgaagcaagtgcatgcaaagagagcaaaacacagaggcaacctcactttataacaatccactctcttgggaacaatttcattcccacgagaactaacccagtctcgagagaaagacattcatctatcttaatgaactaatcacctcttaaaagcacgacttccctatgctgccaccttgacaaccaagcctcaacatgagttttagcagggacaaaccattttcaaagcatagcacttcttatggcattgatgggagatcttcccaagggttggaagctagaactgtgggggccaagccttctgctatcattaccacccagggccccacaagtttgtgtccttgactaaactgaagaacactgaaagtcatggaaggtttttaaagtagaggagccaacaccatttatcagatttgtattttagaaaaaagtttattctgtctgcaagctggataatggattagagaagccaagtcttagacaaacaaattaaaagactgtggcagtaactcgggtgagaaagaatgaaagtaggtgatttgagagatatttgaagggcagattggtatgcctgggcaataacaatgtgaggaaagagggagagtaaaaataaggactcaggtttctgacttgggcatttgagtagataatggtactagatattggtgtgaaaaataacataaagaaaagacagaggaggggtcagttttggccataaagactcagaggtacctgggggacatcaaggagatgtccagtagacttaccagctggatgcatgcttctacagtttaggagagaaatctgggccaacgatataatgctgaattaattttacaccatttgcatccaccaagtgtttttacgtgtggttcctctctggagaccttccttctttgtagagattctttagtgatattttactgtcttgctattttctcaggagcatagtctcattaaggcaatgtactttcagttcaaactgttctatctacggtgattggcttgacagaattctggttccatgcaattatgtctataataagtaaagaaagaataaacacatcaggctaccctagatatttcaaggcattctgcttcatcattaatcatgagtagcctagaaaaatagaagttttataagtatctcctaaatggtaatctgcagtgtctgttaatttactttacctagagaaagtatggtcttagaaattgattttgctgttatattctacagccttataaatcactttccctggtgcatgaataattaaagagagcaatccatacatttctgagcttgttaacatttttgaaacaaaaccagatactaaacatgacattttcctgttgctgtctggaatttctatgcctggtgtctaggctcattcccattatttactttggctccaatgcttggcttcttctttcaagttgtttgccttcagtgtttacagaagtggattcccacaaccaaggaaagggtggttaatgagtcagtctggaagtgctatttttgttatcgtggactagagtcagctcaccataattagtgatattttgtgaaagcaacgcagagcacctaggcagtgccatttccttggctcttctcagtatgtgcagggaacacacccgtgtgcacactcacagatacgtgtttgccacattttagtacaactccgtttctgcattccactgtaagaaagaatacagtcttaatacagtgcaaatgcatgcaatctagactctgggtttgtattgtcagtgtgcttgtgactgccttaagagggtagaaagctttgctgctttcgtggtgtagtgagcattgaaaagtgaaacagatgctgtcacgtgtcttttcctccttgtttgcctggcttaggcttaagatgctttgattatgttatagacccctataagattaagcctaattgtgttattgtatgtgtagttttagcattttgtgatttaagtttttcctctttaagttcttgcttattgatacctcactagtgtctgtcactgtgacatacggtggacctacccagggccattcaaatggagcacagaacttacatgtttatttatttttgaaaaatagtaatatgtagtagggacttaatattttttaatgaagtagattttagatgattattttcaatataaatgctgtgttagcaaataataaaaacaaacatcaattcatacattctctctttctttaactgtttctatcactagatttaactttgcctgtgacagaaacttacagtcaggttaaaaggataggcttgggttcacatctcagaaccaccattttctatgtggcgttgggctggttattgaacttctctaagcttcagttccttcctccataaaatggttggcccataaggattttgttcggattaaatgagatgatgtatgtaaagcttttaatgcccacatgtagcaagtgcttgataaagattaggtgctattattattatctacctcttcagcgtgtgccctaccttcaaactgcccagtaggcttgtgtttgtcccttagattacttggtttttatcatatggattcactgccattttagagctttttattggactctttttcacctttctgttaaaacttctctgtgatttctctgggtcatgagtcatatcttttgcttttgtgaactctcccatcctattgaattcatcaatttccaaaatagacctcaacccatctttggttctttggaaaatgctttcttgtagagatgttgcactaaatctcccgtctcttccttcctcccccctacaacaagccatctttacttcttgaatttattcacagagcatatttggttccgagttactttcagaaggtaagttaaagtatagaaccgtcatccatttagctcacgacaagctgctttttctcctttgggctaatttgaaagtttatctttaagaatctgcctggtcttctgaaggtctactgtttccatttctaaccaaatttaactttatccatgttttctttttcttctttttttgttctttccattacgcaacattcttcaagatgtggacgagtgcctggaaccaaacgtctgcgcaaatggtgattgttccaaccttgaaggctcctacatgtgttcatgccacaaaggctatacccggactccggaccacaagcactgtagaggtaaatactgtgatcaagtttcccatttttatttaaacttcatttaaatatagattagagcaattagccttagaaaagggaaccctgctacctgtgtttattttgaccgagcgacttagagcacatattggttggcttggctgaaagtggctccttgctgtggttaaatacagagcatatctatttacataaagggaaacgatgtatttttagagagtgtctgtgagccacagatcggttcatctaaatttttttttctcattataaaagcaatacacacagttgcacaactctgtgaatatattaaaaaccattgaattgtacattttaaatggaattgtatagcatgggaattatttctgaataaaattgatatgaaagtaaccaatatacactcattttagaaaatttagcaaatagagaaaaaagaaaagtaacaatcttacataatgtcattaatgaatattcatatttcgtggatattgtatataaagatgttctatgtataattttatatcttgctttttgccatttaatagtatacctaccataagtgttttacattccattcataactttttttcaaacgttatttttagaggctgcacaatattctagtatattcctatatcacagttttcttgctcttctttaggtattgaacaaacaaaaaattttcagcttctcattagtgaacaaaactggtacaggtcttttttttttttttttttttttttttttgagctgaagtctcactgtgttgcccaggctagagtgcagtggcatgatcttggctcattgcaacctccaccctccaagttcaagtgattctcctgcctcagcctcccgagtagctgggattacaggcacacgccaccacgcccgactaatttttgtttgtttgtttgtttctttgttttgggtgtttttttgaggtggagtcttgctctctcccccaggctggagtgctgtggcatgatcttgactcactgcaacccctgcctcctgggttctagcgaatctcctgcctcagcctcctgagtagctgggattacaggtgcctcccaccatgcccagctaatttttatatttttagtagagacagggtttcaccatgttgggtaggctggtcttgaatgcctgacctcgggtgatctgcccacctaggcctcccaaattgctgagattacaggcgtgagccaccacacctggctaggtctcttttaaaaataaacttttgtctgaactttagaattatttccttattcataaaagtggaattattgggtaaaattttttttttttttttttttggagacagagtcttgctctgtcgcccaggctagagtgcagtagtacgatcttggctcactgcaacctccgcctcccaggttcaagcgattctcctgcctcagccgcctgagtagctgggactacaggcacccgccatcatgcccagctaatttttgtatttttagtaaagacgaggtttcaccatattggtcaggctggtctcgaactcctgaccttttgatccacctgcctcagcctcccaaagtgctgggattacaggcatgagccaccacgcctggcaaaaatgttctgaatttttttactatttggttttttttttaattggcatgtaataattgtccatattgtacatatttatggggcacacagtgatgttttgatacatatattgtatcatggtctttttactatttttacaggagaacattctcatttcatatatatatttattttaattctgaaaaggcttaatttttttatatgttcattccctttagcgattctctgaacacttctaatttttaaacatttattttatatacttaacatttatatttgtttttaaaatttccattaatatcatttctcatttatccggctttttatttgtttaatcaatgtatacgaactctttatatatgtaatacatatataaacgtatgtacatgtggccggacacagcactttgggaggcccaaggcagatggatcacctgaagtcaggagttcgagaccagcttggccaacatggtgaaaccctgtctctactaaaaatacaaaaattagccgggcttggtggcatgcgcatgtaatcccagctacttaggaggctgagacacaagaatcacttgaacccgagaagcagaggttgcagtgaactgagatcgtgccactgcacaccagcctgagtgacagagcaagactcaaaatagagtctcaatgatgataataataataataataataaatatgtgtacattacgtatacatttttggtggtacactgttgtaatttctccaaggcttccctaattttcctttttatgattttttaaaaattttttcttatggccaaatctgtggatttttttcttttctgcttacttttacatctaaaagtatgttctagcaaagggtaaaagaggaaataagtaaacattttcttcttaagtgtcttgatgtaagtgaaggatgtagggtgataattaatttctcactatggtaggcaagtagtaaatgaataccctggtatcctgtaagaatcgaggcctcttccactggcagtagggaacatgcaggcatctggatttgatgccttgctccaataatacaacagagcaacagtggatcttggccactcctagtggaacatctaacgtgggcacacctccatttctcctggtcccttctcttttggctcacatccacagtttcctactgattccttaagccaggtatctcctcagaccaaattaaatatgagaagcatctgaaaggtattatttcttcccccatacactggatcaatggtggatgaggatctcaagccttaggagtcatggttaatctttgattgctatatctagtttattttcatatcctgccattttatcttctttcatcctaatctgcctaatttttttcatctgcttgttgataaaaactcttgtaatctgtcctcctctttcatagtccaaacttacttgtcacagttgcattcttcagctagcattctctgacctatccaaatcaatgtcacaactgccctgtgaagattcttcacagggcagtacttggacccaagtacttgttcaagattatcctgcctttcatattcatcttcttcctcactgcttacctgatgtggctcttccagtggttcatggtatgaccttgggtgaataatctcaggtttccagacattgtgtcatccctaaaattaggggatcagactctctaatgggatgctcaaagtagcacatgttgaatgaatggctcattaccactgtcttgctcttggctgttgccatcccagctgagcctgggaaagattggttggggagacaagacaactaacagcaatctaatatccaagattataatatatatataatgtctaaagtctagtatttagttttgtttttttaaaaaaaggcagcatatcggatgctagtcctgatgcgtagaagctgtgtgagcttggataagttacggtatcttacttcactaagccttacttttctcatctgcaaataaaagggagcaataatggtacctgctagagttgatatgaggattgcaggaaataatacagggacagagatcatgtagagagaatgagttaaagcaggggcagagcatgacatggtggtggtggtgtttgctaaattagaggcataaacaaagtttcgttaaagccaagaagtgtgtggctaactctgcttgtgtgcgtctgggaaagcttcacaaaggtattgctatttgaacttagtcttgaagtactgaatacaaaggggagtaaaacttggcaggcagaggaaacagcatatgccaaagcttagaggtgagaaagggctattacttccacttggcatttaaccttgacctctactccgattctaatggcgtcttcccattacagcctgggatgcattacctcattcttcccacatgatctctgtccctgtattatttcatgcaatcctcatatcagctctagtaggaagcattattgttcccttttttttgcagatgagaaagctcacacagcttctacacgtcagagctaggatctaatatactgctttatttatttatttatttatttatttatttatttatttatttatttattgagatggagtctcgctttgtcgcccaggctggagtgcagtggtgcgatctcggcgcactgcaacctctgcctcccaggttcaagtgattcttctgcctcagcctcctgggcagctgggactacaggcacgtgccatcacacctggctaatttttgtatttttagtagagatggggtttcaccatgttagccagaatggtctcctgaccttgtgatccgcccacctcggcctcccaaagtgctggtattacaagcatcagccattacacccggccctgccttttcaaaacaaaacaaaacaaaacaaaaacaaaaaactaaacactagactttatttggatttcacaagtttttccagtcacgtcctctttctgttccaggatccaatccaggatactacactgcatttagttgtctagtctccccaatgaatctttccctagttttcatgatcttatctatcttaaagagtataggccagaatcctgtagcttttccccactctggatccatctgatgtttttctcatgattaaactggggtcatgggtttttgggaagaagaacacagaggtgaaaggctctggtcctcacataatgtcaggtgtacattcacatgtcgggggtgtgtgatattcttggcacaaaagaaagaagacatttgtccagcattcctattttattagaaagctttcttttggctcagaaatgctatccctcattagaaaagaaaaatatttttatccctagaattaatctatctttgttcccttggtcattttaaagacccaaagatcaccttgtgcaagataactgtgttgcctcaagttattccaagtgtatgtgtcattacttgtcatgaattactcctgacattcttagcaacataaatgagtcagttacgtaagatgtctggcatagcctgatagtccttggaatggagggtctatctctgttgcagacatcttcacatgggaatgcttaatttgttgtcttctatgagaaagtcaaaaagattccaaagcactaaaaatgttgtcagatgttatgtgagatccagccagctacaagaactattgttggtcttcagttcgtgaactgacatctcaagtattttatagaatgtgctaaaagaaaatagtgacgtaggctgatctttgctggcaaccattcctaaagctaagagacttacagtgtttgaaaggtataaaataatctttaaaatgaaagttaccttgtttattttctctatggacagacaatattggcagccaggaattatttataaatcaaagagaccaagaacacaattggtaaaacaaaagtttttaatcaactaaagtaattgctatgaaatattaaataaaataagaaacaaatttttgaactccaattacattaatactttgagctatttcaggaaactatgtcagtatttcagtagcaatttcaactatttcagggagggataacctgatactttgcttatatctggatacattttaaaagttaatgccccattagaggttaagaaatgaaactttgcggctaggtgtggtggctaacgcctgtaatcctagcactttgggagaacgaggcaggcggatcatgaggtcaagagatcaagaccatcctggccaacatggtgaaactccctctctactaaaaatacaaaaatgagctgggcgggaggctgaggcaggagaatcgcttgaacccgggagacggaggttgcagtgagccgagatagcgccactgcactccagcttggcgacagagcgagactctgtctcaaaaaaaaaaaaaaaagaagtttggctcaggagaaacaggtaattgtcaataatacttgagtgaaaggcctatacagttaattgagttttcctggcagacacttttagatgcattttaaataagaaaatttgaagaaaaccacagtcatacattgatctataggacatggtttttaaaaaacaaatccctctattttatttattactccctttagattagggctcctttctcctcctgtgagtatagggctaaagtgttttatatctattcccttcggtaatcttcacaacaaacctgtcatgtaggtgatgaagatcagttgtacctaccatgttttaataatcataaactcttataagttggctagccattcagcagaacattctgaggctgtatttgcactgacaaggcaagacagaattatctgcttaggtcggaccaatataatggccaaacaaaaacatctggaagactctactcttaccagacgtgttcaagttattgatgaagccagtcctttgcttcagttgtataacttcgtatacatgacattttctaggacacttattaagaattatcttctttctcagttagtgattttatcttgtcaaagcatgtttaaaaatcctcacttatcactttctcctttggtattcagcagtcatcataatactaccatttctcttggctttccttgttactttgaaaatgagccagagttctttatacaactgtttggccttatagttcaacttctagacaaagtagaattatctgtttccttccataactgcctatgtttttggttttgtttttcaaattcctagtcgagttttccttctgacttctttcatgcaactaaacaggtctgcaaactatctgagcgacattatattgcatcaggttctgccttctgtttgcagctctaaaatatttcatgttgtattccaagacactgatggtgaggagtatgattattataaatagcttattgatttattgtctatttttagttatttctattctatagatcagtatactgaggttgatacaacagcatgggtggagtgataaatactaaagtgtgtagtgccagacataagaagtactattatttttgttacactaatcccagaatgcattgcagggagcactgcattctcctgggtagtctctttttcagaaaaattgccgttgttgtgtttgcagatattgatgaatgtcagcaagggaatctatgtgtaaacgggcagtgcaaaaataccgagggctccttcaggtgcacctgtggacaggggtaccagctgtcggcagctaaagaccagtgtgaaggtaagagggtagtaacatgaactactgaaacttcagcttaaagcacctggtctgaaaaaggtacgctcaatcaagtgagtttaccttttaaaaattacccagataattgcattatagtgccagaaagccaggacttaaacataagttaggaaagtcaataaaacaagattgaagacagttaaatttgaaaacctatggcattagctatcaatggctaggcattagtattaagaagaaaaattattgctttctgtgtaattctttactacagaaggtaatttccatttaaacatgtaaattaatttaaagtttttatatacttggatttcagcaattagaaagtcattatatcgggctgctttatgctgtggaatgttaataaccttaatttttgtatttaacgttgaaaaattttgtcttttaaaaaaatcgctaaagaagatttctcaataaaactgtaataatgtcccccttagagagaaagtttgcaaaatatgttctgttcctacagctgatagtgaggattctggatttgctagggttgaccttagactttttaaagaaacatttcattgaattgcacacagaaatacttcacttcccaataagtatgtgcttcctgaacttgaagatattatgatctcacctgtgtcaaccacaagtgtccagagttcttgagaggaaacgccatttcttatttaagaacagaatccacactgtataaggccattgtttcataaataaacaatatccacgtcttcatgtatactctgaatatttgagaagcaaaaaagtctcctgagatagtattacaaaagcgacaatacatgatggtcattacttgtatcaacattgtctttctagaatttacactgatccaattgagactgattgaaaatgtttttgaagcaccacttccacagtttctttgtattctcttgctcatagacattgatgaatgccagcaccgtcatctctgtgctcatgggcagtgcaggaacactgagggctcttttcaatgtgtgtgtgaccagggttacagagcatctgggcttggagaccactgtgaaggtaagaattgctcctgatttcagaatcataaaatgcccagatcggagggaaatctgggcatcatctcagccttgatctttgaacctcatctcttgatttcatagtgaagacattaggtccctgcaaagtgtcttccccggggtcacacaaataattcaaagaagggagtagagtccagattatctttgcactgcttggagctgtcttttagacttgtgccagccaaaggcataaaagaatcagtttaactttaccagctatagatggtttatcctgggtacatagttctgaactgtaacaccttatttatgcagaaccaacttctaaatgttccaaataagtaaatacaacttaattttccaggcaattagaaggtttttcagagccaaacatcaattcagtttttggctttttgcataaaatatttctgaaagatatcccacatgtccagtatcgtgcagtcatcaaccactttcactacttgtttggctaagaagctctctgcagtggttgggtgactgaaccaggcctgcttatggagcggggaatatcttctcccagtgggcttctttttcacttttaccaccggtctgtcacttgtgacctttctctgcattcattgtccacctaagtaacaagctttttcccagcccacctgaggtttcactgcatttagagcctgtcagttgtgaaaccagaaatatgcatgttggcagggttgtgtctcccatgcagggtccaagtttttgaaggagggtctgaaccccacctttgagagaagtggatgagccttttggtgaatggtttcatgacacacacatttcagcagccccagatcctttttcactaccagtccagtggattgggaaagatctattgtcatttacagcatctacatttctgaccagagaacttggcagaagcagtcacaagtggctgagccccatatcctcctgctgctgggagtgtaaatgacccaaccctcgggaaggcaattttggcagcgttttaaaggccttaaagtgtatactgttaatgaatcagtaaatcaacttctaagattttatcctaaggtgatcatgttcctcaaagagttaataacaccagtgaaaagttgtaatcaatatacctattgaggccagatgtggtggctcatgcctgtaattccagcactttgggaggccgaggcaggtggatcacctgaggtcaggaggtcaagaccagcctggccaacatgctgaaaccccgtctctactaaaaaaatacaaatattagctgggcgtggtggcgcccagctaatatttttacacacacacacacacacacacacacacacacacaaacacacacaaacacacgcacacacacccctattgagaaataggtcagataagtgataatataagataggactatgtatgaaaaagttgtgttttaggaactctctaatatatgggtaaatgataatgattctagatagtgacatcccaaggtgggagggttggtggtgttggagggagacatttatggaagaatctattctagaactaagtaactggtaaggtatattctagggcagtggtccccaacttttttggcacacagggaccagtttcgtggaagccagtttttccctggatggggttgaggggatggtttcaggatgaaactgtcccacctcagatcatcaggcattagttagattttcttttttttttttttttgagacggaatctcgctctgtcacccaggctgagggcagtggcacgatctcagctcactgcaagcttcgcctcccaggttcacaccattctcctgcctcagcctcccgagtagctgggactacaagcacctgccaccatgcccggctaatttttttgtatttttaatagagacgggttttcaccgtgttaacctggatggtcttgatctcctgacctcgtgatccgcccatctcggcctcccaaagtgctgggattacaggcgtgagccaccgcacctggcctgcattggttagattctcataaggagcgtgcaacctagatccctcacatgcgctgttcacaagagggttcgccctcctatgagaatcgaatccagctgctgatctgtcaggagatggagctcaggcggtaatgctcgctccctgctgctcacctcctgcagtgccgcccggttcctaacaggccacggacccgtaccggtccatggcccagggattgaggacccctgtgctagggcactaaaaatgtaaactgaccatcagcatctcctctgtcctgattcctggccaagccaagaaggaactgcaccattgattaagtcttgggtaactgatgttcattggagggcatgttcctcgctttgtctcttttaatgtgtaagcattttaacagaagtctaaggtttttattccaaaaacatccattgcatgaaaagtcaaacaaaagcttttagcaaactcgttcttcattattaatgtatataagatatgactatgttccgtaagaaagcttcttttggaatatataatcaggcccttttaaagtcaggactagtttctctagtgtactgggttataaataggactggagtccatccaactaatttagagctccctttgaaactatgttagcacctcagcctgctaattcccaactagcaatgtttccgaccctccccagtgatatttagccataattaactaaaccgtgactgttcacacgcctctgacagctgtgcaaggaagagccatctttcttgttggcttttatgtttacacgtgtaattttcccctaatggttctggcaaagaccttgttttcttattgtcctgtcatcctgctggcctcctcgtagagtcagactcccaagtgttgtgcctgcttctgtgcgctactgactccagcatgcttggtagctagtcattctgtgataatgaacgtgcctcaattgtcctcattcttaggagtctggagcatctcagctttcaaaggctctgcctgtgacttgttccctccaagcacagtctttaatctcgtgtctaccttaacctttccccaatccctcactaaggttgctccctgcagtcctttacaaagctgagaagatgactcattacttacaatgtctttccctttccctctgtgccctttgctcttggtcatttatttgtggacaaaattttaaaaaggtggaaaggtgggatagtatttctttccaaatcagagtcattcatacattcacttatgtatttgttcaaatatttatttagtgtggagcttgtgccagacactgttctaggcatagggcaataaaccaaacagaaatttcttcccttttgtagcttacattgtagtgtgggagataacgaaaaaatacaataaatggctgggtgcagtggctcacgcctataatcccagcactttgggagttccgaggcaggtggatcacgaggtcaggagatcgagaccatcttagccaacatggtgaaacctcatctctactaaaaatacaaaaaaaaaagaaaaattatctgggtgtggcggcgtgtgcctgtagtcccaactactcaggaggctgaggcagaaaaatcactcgaacccaggaggcagaggttgcaacgagccaagatcacgccattgcactccagcctgggcaacagagcaagactatgtctcaaaatatatatatatgataaataagtaaaatatatagttcgttaaatggcaataaattttacagagaaaatagagcggggtatatggggagtgttgaggaagggtggtgattttaaataaagaggcaagtagaggcctcgctgggatgataacacttaatcatttatgggtagagcattcagttcaagggaatagcagatgcggatgcccgaggaaccagctatgtggagacctgaggggcaccacgtcagcactttccacttttgatgcccaagatgaatatttgaaggaagatatctgaaaggcaattgtatctatgcatttggaatttaggggtgagttctaggccatgaaattaattgggaatgagtgtagctagaagagagataaatcccgggccctccaacatttagaagtgaggaaatgggtaagaaccagcaaaggagattgaggaaaaagtggcaagtgaagaaggagaaaacccagaatccaagagaagaaagtgtttcaaggaggagggagtgatggattgtgtcaaatgttattgctaggtaacagaagaaccaaaagttaaccatgggatttttagcaagctggaagtagttggtgacctcaacaagctcagtcttggtagaaagatgacagtgattcactgttcctgcccttaaaaccttttactctacttctaggaaaaatatatattttcgcactaccccaggtggtggtacgaaatagtaccatgttgtgctctcgtaatgttcaaccttcttattgctttgaagacagataaaggccttgcaaaaaaaaatttaaactaaacctaaccctaacatatgctcagctttctaatgtatataattatttataaacactttaaataatgctcttttccctcacattcattatttgtcttagattttggaaaataaatgagaatcaaattgctttaaagtagcatgaacagagccgggcatggtggctcacgcctgtaatcccagcactttgggaggccgaggcgggtgaatcacttgaggtcaggagttcgagaccagcctggccaacatggtaaaaccccatctctactaaaaatacaaaaattagccggccgtggtggcaggcgcctgtaatcccagctactggggaggctgaggcaggagaatcgcttgaacctgggtggcaatagttgcagtgagtcaagatcacgccactgtactccggcctgggtgatagagcaaaactcagtctcaaaaaaaaaaaccaaaaaccagcatgaacagagcaacatgcttccattatgctgaggcaaacatctaggttatgaagtgttttttcttgtagaaattcatattcccaggattctcttatgatcttttttgaattgagttttttatttaatgtcactgatcaaatatgcttctcctcgcttcattatctccatttcctacaaagcaaagaaagaaaggttaatggaaaaactgattgtcagtcgggtgcagtggctcacacctgtaatcccagcactttgggaggccgaggcgggtggatcacaaggtcaagggatcgagaccgtcttggccaacatggtgaaaccccgtctctactaaaaatacaaaaatcagttgggcgtggtggtgggcgcctgtagtcccagctacttgggaggctgaggcaggagaattgcttgaacccgggaggcggaggttgcagtgagccgagatacaccgctgcactccagcctggcaacagagcgagactccatctcaaaaacaaaacaaaacataactgattgtctactttacacccattaaaatagttgtagagctgtcagagtaaatgtggaacaatcggagttctcatatgtttcctgtgggaatgtaattgctacagccacttcagataacagtttttcaaaacttaaatataacctaattccatgacccatgcatcgttttcctgggtatttactcaaaaaaggtaaaatcatatgttcacacaaagacttatgattttagaaatatttatagaaaccttattcacaatggcccagatggaaacaacccaaaatgcttatcaaaaggtgaatgagtaaacaaattatggtgcattcatccaatggaattctacccagcaataaagcacagagaactactgatacacacagcaacttgggtgaatctcaaaactattatgccgagaggaagaagccccaaagcacaaaaggagtgagagggaatgtattggggatggaaatgcctgttccttgactgggatggtggtcacaaggatgtgtatacatttgtcaaaactcattgagctgactcttaagtagatcaatttattttatgtacattatacttcagtaaagctagaaaaacacattaaagaaaaagttgagaacctgccttagttgagacaaattcacatcacctgtgttttatgttttagggtcagtacccggaagcattttaattctgggtgaacagtcattataataacgtggttttatttgatagaaagaagtgataaggcactctcttatttctcttttgtttgccctgtgaatagtacagaagcctgttaattggttgattggattctaggagaaaaatgaaattcggtatcaccgtacttgaaccagacagccgggcgtattagacagatggcaacagtctccatattcacttcttcctggaatctctcatattttggcagcaattacaattatttgcaagaaatgccataaaatgccaagttctgagaaaacaaagaaggttttgtttcttagctttcttcgttgctaataacttaaatcctcacattcacaacagaagagggctcatggagtacattaggaataatgtgctttgactaggggtaaacatggtaatcagcagcccttgagaaagatctgctcgcattcatgcggtgaaggggagccattaattgtctttcattctcacagtcaaaactcgttattggttatgtataccacttttagttgcgcatttgctatgaatttttttaaacatttttaaacattttttaaaatccaggctacctcaaacctgtttgttacagctgctgaataagtgacttaaactaggtttttgatcttgctgttctccttctgttcaaaagtccctcttcttccgactcccccatattctaccctactgtgaaatttactataagtaaatttacagatatgcttctgttacacaaaagttttattttaaactttatgatattctttgtctaaatgcatatgacccctaaagttgatgctactactttgtcagataattatattttgtgacaattcttatgttacattggtttggacttataaaacaatgtaatattttatgtttaataatacaatatcatttgtttattttattgttaataatacaatatagtttgtttctttgaacaaacatttctcttggggacaaagaccatgctgaaaacttttaaatttttttctataatgcataatacagaagcttgtataaatagatcaagtgttgctcaagatacacttaataagtatttttgaaatattttaagtctttatcatcaccaacaatataatcaagtaaattattatttgctacagaattttgacttttcctcttccatttaatttcatttgatgtttaaaagttccatttcttggccaggtgtggtggctcatgtctgtaatctcaacactttgggaggctgaggtgggcggatcacttgaggtccggagttgaagaccagactggccaacatggtgaaaccccatctctactaaaaatacaaaaattagttgggcgtggtggtgggcgcctataatcccaactactcgggaggctgaggcatgagaatcacttgaacctgggaggcagaggttgcagtgagccaagatagcgccactgcactccagcatgggtgatggcaagactccgtctcaaaaaaaaaaaaaaaaagttaaaaagttgtcatgtatttaaaattatgtattataaatgatgtaaaatagtgtacctttacatgtaagagaaatgtctaattttccgatatgtgatttatttagtctttaaaaatttttaaattggtttttagatatcaatgaatgcttggaggacaagagtgtttgccagagaggagactgcattaatactgcagggtcctatgattgtacttgtccggatggatttcagctagatgacaataaaacatgtcaaggtatttcttgctcttttttccccagtcattatttacgtaattcttcaattctgccatgttgccagatgatagtctgtggttttgccatgtgatttatatgtaaataatttatgtcaatttttgatattaaaatagctgtcttgggtccacatcaagtgcaggaaggtgttgctttgtccagcatagtgtcaactgaaactcacacgagtaagagctgtgtcctcactgcgtgcttccgtcacctgtactttactgtttattccatgctgtaaccttggtactgggttctaaattatctttatagcatcttttatgggcatattttattttgtctcataggtggtatttatctgtccttttctgactctatttttatccagtgcccgccattgctttttttttttttttgagacagagtctcgctcttgtcacccaggttggagtgcagtggtatgatctcggctcactgcaacctccacctcccaggttcaagcgattctcctgcctcagcttcctgagtagctgggattacaggcgcctgccaccacacccggcaaatttttgtatttttactggagacgggggtttcaccaccttggccaggctggtgttgaacacctgacctcgtgatccacccgctttggcctccaaaatgctgggattacaggcatgagccactgcacctggctcaccattgctttttctcttcctaaaaagcctcactaataatttggtcaaaatcatgaagaagaggatcttatattttttcaatgtgctgtcatgtttaatcttccaaactgtacagtgcatgaagggtactaatgaaaacacagcaacacaacacaggtactaataataacaatcacagcagctgtaactgagcttcttcagtgtgctgagtactgtaggtatcttggtatctcttcgaattcttacagcaacttcagaggtagcttttcttgtattcattttgtgcatgagtaactgaggctccgagaagttagggagtatgctgctctctaatgagtggtaaagttgagatttgaacccagggtcttttcccactactcttccctacattgccataccaattattgttacatttatagccaaaagaaagaagaaagtgaaattaagtgatttctctcacaaggtagcccattgagtcatttcaacaccatagctaaaaaaattaaattctctaggttctgtatcccaacatttttagctatacctgacttgccccacaagctttcctctatttactagtgttagtaaacccatgtttatattttccatggaaaattcacacttattttacctttatatctgtttatttttgatacccaataaatgttatttttttcttattgtttatctaccattatggaactgtgtagtgtatcccaaagcataaataaataaaaaaaattgttggagttactttttacccactattactgaatatgtatgatttttttaaaattctggattgccataagttatatctcatctcacatgtcccaaataacagtcttcttgtaggagaagatggtatctactctctaagatagtggcactggaattatatatctatattaccggtcacacccagccatgtgtcagagatatgaaaaacacggacctttgccacaaggtttttaaaaattaattcctttactgatccaaagatttaaatatacaccttcctgcacttgatgtgtacccaagacagatattttaaaaatcccaagatttaaatataccatgtacctcatttgagatcatgtatttatttgccatcctcatgcaataaggtgaaattcaattttttccaatgcagaaattaaatgtgcttggacttaatgcaaaagagaaggaatatttgaattataaatatatgtgagaatatttccactttgggactattaccttttaacaaaatgaatcttgatttatataaaaataccaagagatggaaaaaaaaaaaaaaaggaaaccaaaccctgactcttgtttttattataggctttttggcttaaaagtatattttcttttctaattcttctcgtcacaatttgttttggccaaatacaggcaaaaccaaatcttaataaaaatggaccaagatttcatattgcataaatttaacttctagagttcagtcacacggaactaatttagttatctgattcattaattgcactacttcattctctcaatatattaaatttgtgtctgtggtttgatatcacctctcaaatatgtgactactccaaacatagagagttttattgactatcaatcattattaaattgacttcgttctctgtcacatatattcctattttccagaataagttaatatgtctgaaaaatgtaaatccaaataaatgagaagcatttctgaagtaggtcttagtactgtttaaagaatagtgtctgtgaatctgttttatcacccaccacctcctgttagaagctgtatatgatggcatgtatatactcacctcgttttgaattatcccttttcgctctttcactagaggcagttttgtgatctttcactctgcctgaagttagtagcctacttttctctaatcccttgatcatgtcagcattctgtggagaggtgtagatttcagagtttgtttaaattctgaaaatgtaattgatggcaatgctaataaccatggacatgtttgaataacagtgtgtgataggcataaactttaaaccttacctaatgttctgaaaatacttctatattcagtaaggcattttcagttggaagcgtgtttaagattttctttcccatacaaaactaatgatgatatacagacagtatggaaattccatgttaatagtctctttagaaatgtggcaggatacatttgagattcagaatgcagttcagtttcatgttttgatttacgcatgccaaattatgaatttctgtggaatcgcggacccatgaaagaaacccaacttaaatatagtctggctttcagcttgaagttactagcagcatagtttagaaatgcctcaataagtacaatccaaattgaatgcatatgtttccctagttccaaatattcatgttgttctttcttagcagtttcctggaaaaaaaaaaagtctaggaattcatcttcagttcccgtcatcaaactttttagacaattatttgtgttaatcagtgacttttttgatgaaaaaactttgtgcacattattccctatgcaaagttgcaaagcaggtagtttttaaagggccacactgaggcataggataaaataagaagaggggtctcaggtagctattagggcttaataagatggatataggtcctgagcttgatccccaagccagtggaacttcatgccaccttcttcctcagatagaggtaattcttgggcagcaggttggaaataaagagtggatctgaggaccaaaaggaggtcaaacttcaaaaaggatggccaatctaagatattaccaataggtagagaacaaacatagacaatgtcagagattttatcaaagaagtaaagaatttcacagagtaaaatcatattgagaaatacataagtagaaaatgattcattgaccttccttgaaatatctaaaaactagtgacagtaacaagaataggagaattgttaagaaagtatgagtaattcctgttgggtttcttatttttattcagcgatggacaggccaaataatctgaattatgttgcagatggaaggctaaagagttcaagattaataaaggaagacgtttaaaccaataattgccagaatttctgttgcacgggaagatcaacaagtcaaaaagaagagcttcaggagattctggctgtagggaaagggatgactttattgaggaccactgggtcagtggctaagcgtgttgtagcagccaataggaagaacatacattctgtaccttttccctgtccttattaagctttgcagtattcatgtgggttcctgtactgaagacctcttttgtaagagataaagggagggcctacgagacttggggaagataggaaaacgaccttagtggaggtatgcctcctgaatgctgctgctaaggacatgggatcatttttatgacccccaattaactaaaagaaccttcaccagtcaccattcagttagcggagaaggaaaataactgagaaattttgtggtggacaaacattcataagaccctgcaatgtacccaataggagtcaggaactcagagcttttcagctgagatcgtttatcaaggagccatcagtgtaatgagggacacagatgagtaaaccaacaattaggcagttgcatgtatcagaaccattgtgaacaggtgaaactttctctaggcgctttatgttgtcatcttgggcactgttagccaatataattagaactggtttgaaagagccttttacttatagtaaacagtccatgtgttatcagtgtttggaagtagcccttgaccctggccacggggagcacaattacactgaggacaagctgagcataaagtcgacaacacaagtgtatggcatgatctgttcatgagtcttcttaatagtagttattgctttttgacgcttcattgtgtggtaggcactgccctgagccctcattcgctgatttcatcatcggaaaccatgcaaatacgaattttcatggtctaaaagtccttctcagccaagcatggtggctcacctctgtaattgcggcactttggaaggcggagacaggaggatcacttgaggccaggagttccagaccagcctgggcatcatagtgagaccccatctctgccaaaaatttaaaaaatttgccaggcatggggccagtaccttagtgccagccactcgagaggctgaggagagaggattacctgtgccctggagtttgagactgcagtgagccatgatcatgcactgcactgcagcctgggcaaaagagtgagaccctgtctctaaaataactaaacaggccttcttttacttgtattttatttctattacccatttccaatgagttatagattggagtctatttcatttatatattcagcagacatttgtgaagtgccatttatgagccaaatactataaataagacatgtctagccttgcccttaagaagcccacatcctagggatggataggcaggaatgtaacaaggtactacagactataacagctgtgtgcatggcaatgggagagggcaaagaaggacagcattctcaccaatgaagagcatctctcagagttgtggagtattcctcaagccccatatgtctaaaataagggtagctttgggttgaacctatgaaattgctttttttgcaggtcaaaaatgattgtacattggctatttcctaactcaacctaaatagtttctctctcataactcagcttgtcctgtggttgatttatggacaaatggtatagttgttccactaaataaatgtccagccatgtcataatagatttatttgccatctgtttgatagtatatgggaatgaaaccgatttttttcaagtttttaagactctattttaaattacagatattaatgaatgtgaacatccagggctctgtggtccgcaaggggagtgcctaaacacagagggttctttccattgtgtctgccagcagggtttctcaatctctgcagatggccgtacgtgtgaaggtaagataaaccatacgaaatcatattgttgtgtgataaaagagagaggagattgctttcacttatacaaagacttgaagacactaagaggtactgcataattcagagcctcaaagcatgtatgcatcaaagtaaaccatatctgaaagcatagctcaggggttgctgggatttacgaagaggataacctaaggttatgatgataaaaacactcacagatggctccacgactggtactgaattaatgagtggaaatgtgcaaggactgataggagacatgtaggagacctaaaggaaaactgtggcaacttccctttcccctgggactctgcttcttttgattgtgcttcatgtagatcgtcttgatcattctgtgtgtaaaaaatgtcttgcggctgggtgcggtggctcacaccagcacttttggaggcccaggcaggtggatcacttgagatcaggagttgaagaccaagcctggccaacatggtgaaacctcatctctactgaatatacaaaaattagccaggtgtggtggtgggtgtctgtgatcccagctacttgggaggctgaggcaggagaaccactgtaacccaggaggcagaggctgccgtgagccgagatggcaccattgcactccagcctgggcgacaagagtaagactccgtctaaaaaagaaaaaaagaatgtcttgcttgatttttctgtatcactgtgaacagatcttctagaattcttcccctaatatccttatttccaaggcagtatatttacttacctaccagtatttattatctcctaaaagctaattaagttgtaagatgttaagataatgctcttggcttcctacttacaacctctgtatgtttgcaagaatacagcactggttattttcataagatttgtgttcttgatgataatttacctgaaccattttaaaagtaaactgaaaagattcccataatcataatttcagttgatctcttttgagaatctagattattgaaactcagctatattttaaagaagtaaattgcaaaagttttgttctgggtctaacatagtgcccagattctttgctctaaaaaatagtgcaacaggaagtatctgctctccttgctagtaccagaatggaaccaagccgtgtgccagcaaccaggttcatctgaaactaattattatattgggaggaataaactgatcttgtaaagagcagaagattgttgaaattactctcctgctgagcagacaaaacatggatgccagatttgactagaactgggagagagagagttcagggtggattgagcaaacagattgaggggtttggaagggataggaagttgggaaatggaagaaagcatcataataatgtgggtgatgagagatttagaagaaatccctgcttcagtggttcaagttttatgtaaattttatatttggggctttgagaccagagcttttagcaaagacactccatgaatgcatacattcttctgcagagattacagtattcctcagcttgagggatagggtgcaagcccatccgagtcactgaggaaacagatttgcagaattcctaagctctagaaggatgcaggtttgcttctttgcttagctctaaatcatggatggtaaaggcttgcttcctaagaaatggtctgtggtataactactgatggttgtgccatgcaaaattatattcagaaaaaaaaataagtgacctcaagtgctccctagtcaaagctgttgttccaaaagaatatactaaacataaatatattcacaattattttgtcttttgcacttactaatgatttaattctgtacttttttaacacagatttctgcaacttgagagttgcataatcactgtaatttagttgcagctctaattttgttggtcatttacttggcaaagacttgaatttaaaaatgtggttttaggaaacttgtaatgctttataaattactgtactcattgagtatactctttgtgacacctggtctgtactgccttgactccagaacctggacaattttataagtaatgaaatacaagttagaatattatgttggtattatacatggtagtataactagaactctccgtaattattatgcatgttattctctttctggagtaagttctgcatgaattttattttttatgggcttaatccaatattctaaattggtccaaatttccctttgttagactcagtctgacacttatggcagtagtgctatgtcctgatttctacctctggctgtgctgcaggacaaagccagctcatgtgatcagtattcagcagtgaggctgatgtgtgattgaaatttagcaatggagcagttgtacatagtacttgaattaacactgagaagtggctggcattcttatctcatgtccatttactgattttcttctgagcttctgtttgaggagctgaagcctcgttgacaccagggctgacctgcccggctctaagcagggctaaataactcccacatagctgaaggaaggagggcccttccctgatttcccgtgacttggagaagtgtcagcatctggtcgtagttaatgaaccacaatgaagaggcaaactctgtcaacatgaattgtctttaagtgtagcatggcagcttctatagcaataaaaatggcaccactggctccttcctttctcttacatgtatagattgagtattcctcatctgtaaatccaaaatctaaagcactccacattctaaaactttatgagtgcagatgtgatgctcaaaggaaatgctcattgagcattgcagattttagatttttggattagggatgctcaacaggtaagaataatgtacacattccaaaattaccaccaccccccaaaaaaaatcccaaatctgaaatacttctagccctaagcattttgggtaagggatactcaacctgtatatggtactctgggatagatagctgggagaggaaggagaaacaccgtggttctcccatgtaaggtaaagaatggtgtaattcacagttcaagtgaagtgggaagtaggtggtgggtgggcagctatttgtcatttattcactcacgtaaccggtatttactgagttcctatctggttccaggccttgttccaagggtaaaacatacaattcttgcctccatgaagccgacattccactaggggaattggggataaagaagccaatggtatgtgtaggatacattaagtgtttataacacagcatagttaccctttctggatataaataagtgcagagtgtaacgtgtcatatataatataatacacaggatatttttttcaaatcccagacttagatgtcaggaaattgcaggggaacaggactcttctgattgacttctgctacacttccctttcctctctcagttatagttcatctcctcctgccaccttcctttcacgctatagccagagcttttatcttgtgtattaaaacaaaggaaactttttctttcactcaactcgttgttttatggtccatttgatcatatccatttgtttagcaaaaaatcataattcttttgcctttttatttctgcccttttttattgtggaattttaattcacatgaaaaatactcatcatcaagcctgggcaacatagcaagactctgtctctacaaagaaaaattttttttaattagctggacatggtagctcatgtctatagtcccagctactcaggggactgagacggaaggatcgcttgagcccaggagttcaaggctgcagtgagctatggttgcaccactgtactccagcctgcgtgacagaaccagaccctgtctcttaaaacaaaaaatctgaccaggcacagtggttcacgcctgtaatcccagcactttgggaggccaaggcaggtggatcacctgaggtcaggagttcgagaccagcctggccaacatggtggaaccccgtctctactaaaaatacaaaaattagctgggtgtggtggcaggcacctgtcatcccagctactcatgaggctgtggcaggagaatcacttgtacccaggaggcagaggttgtagtgagccgagattgcgccattgcactccagcctgggcaacaagagtgaaactacatctcaaaagaaaaaaaaaaatccttatcattgcattcataagctgatttgagattcggtctcttcatcatcagtagaatgtgtgtgggagaaaattagggaaacttaatggtaatcagattcctaggggtcaccacgtctgtccccatggcccatggggaaaaacctcctgatctctgactttgtgtcacctcttttccatgcctccttccttgctgcacttggccaggaacaactgcgctctcccagtcgtgtgcccaggctgagcaagggcttgtgtgactgccgtggagtccggcacaccccccatctctaggctccctgtgcactctatcctgttcacatgatacagcggccatgttcatctagcagggaccccaaggagcccagccacacagagggagcaccagcagcttataggacctggcacttttccctctggtgttggccaggcttggttagtcatggctaattaggcctccaaaccatggccaaaatcactccctgaagtattgtcttttagaaagcatcctcattcattccttcgtttgacagatatttattaagtgtctacctgtgtgccatccactgttctaggtactggggccttgtcagtgaagaacagcaaaagatccccacttacttagaggcaataactaatagataactaagatgttagaaagtgtgataaaggctgggcatggtagctcacacctgtgatcccaagcactttgggaggctgaggcgggtggatcacttgaggtcaggagttcgaggccagcttggccaacatggtgaaaccctgtctctactaaaaatacaaaaattagctggttgtggccgtgcacacctgtaattccagctactcaggaagctgatgcacgtgaattgcttgaacatgggaactggaagttgcagtgagccaaggtcacaccactgcactccaccctggtgacagagcaagactgcctcaaaaagaaaaaaaagcgtgataaactctgtgaaaaaaaaaaaaaaagaaaaggtagagcacaatatgggggacctgaagggtagagaaagaagtggaaagctgctttgatgctaactggggtggtcagaatcggcttttctgcttctgtaagtgaaagaaatactgaaattttctgagtgaagaaatgaagccatatgaagtgcctgtcatgttcaaactggtcttctactggcgaagtgataaaagcccatcaataaataggtaagggagcatgagatggcagccgaggactttcttgcagctgtcaacatgaattctattgtccagacaagaatagaaaatcagataaagtacaacgccaagagttgtaaacacttgatgtaaactatggactttggatgataatgatgtaagagttcatcagtcataacaactgtatgtaccagtctggtgcaggagactggcagtggtagatgctgggggctggtgtgaggaagacaggatataaatgaaaactctctgtgtaatcttattgggaacctaaaactgctcttaaagtctttttgaaaactcagacatatttttggcattaccttttttttattggaaaggaaaaatgaaaacctttcattttattaataattctatattccactcctgtattttcttctcttggatgatgatggtgatattatttctcacttttcaaaataataccctggactgagtatgggatcagcagcttctcctcctagttttcaaaaatgattctactatttgattgaaaaattgagcactgcaagactggaagagggcttcttgtcacatctagcctgaactctgactcccacagtatacccaaagtattcaggaatcaagtcctattgctaaacatctatagagactctaaccccataaccttcttaggtatttactataaatcactccttgcttacacattcatctgaaatggaaaccggtaaaaattgccaatgcgttgacgtgtactgaaagtagtgatatcacaaccgagagaaggtggattcaaactctcaggctaattttgtattcattgggaaccagaaaacacaagaaagacaacattgccaaatcaaaaaagtaacaaattgggagcagacgtggggtttgttttcacacttctaggtacattttctatgaacgggggagaatgaaagcataaagccgtggacagtgccccaaggcagttggtggttttgtggcatggatatagaactttatatctgtcaccaaatagaaaatgcttttgaaaatgactcagccaagtgggatgctgaagaactctgatgcagtaatgtgttacatgtggtgtgcttagcccaagattttcaggtttttaagagttttcgggtctgaaactgaaaactgtactaagagatgatgattttagtatttcttagtagagagaattttaacaacagaatccactctcttccatgtgtaaaaagaaaaaggatcatacaacattctaggtaaagaaagaaagtggcttccagctataaaagctactgttcacactcactcttcctgtgaatgtacttctgcagaagtgagtgaaaatgaatgtttaaatcattagggagaaagctgaggaaatttttctggaatgagttgcttttggacttgaaatgcagattttccatgcattgcttgattgtcttccatatatcaacatttgtataaagaaattcataatagtagcaaaaaatttgagatctcttcctaagcctttttttttttttatcactgctgaccttttcaaaccccagagctatggaaatcatctgttcatagaaggagaagtaaacacttgccttgcagccaaaaaataggcagaagactgccagaaagtgaagtctgtgactaggctagctgaccttgcataccgtatgctgacatccactcatgctctggtgctgggcgtcctacatctgactcctttgatgtcaacaacccgagtcctttttagatcatggaaggttattgtaagcagtgtttttgtacttgagacctaaactgtaatgcttcatacacatattccagaaacagttactttttagacatgtgatagaatattaagcaactatcttggtctcccactatgagtggactggagatacattatatatctgattgcatgattttattaaaacagtagcaagaataatgtataatagcattcactgagttcttattacaagccaggcactatgctaagtgcattgcacctgtcttctcatttaatcttcacaataaatctgtaagtaggttaagtattaattggtttaattttggctgcaacaaacagcttagaatgagggcatttattatacgaatgagaagtatagtacaagattgttacctcttgcctcctgtaggtccgtatttaaatgctgtttccttagtgaaccggtttctgaccgttctttctcagattcactcaccgtgtaatgaatgaattaattcacttcctgttcttttttccttttgctttttttatttctttaccaccttattctacttctttaccttgtttattgttctttgtcacactccattgctagactttaaggccagtgagatcgggattgttttctgtattttttacagctctgtatgccattgggaatacagatgctactcaatttatgatagggttatgtcctcataaatggaaagtcaaaaatgcatcaaatacacctaacctaccgaacattatagcttagcctagcctgcttctagcacattctaaacgtgctcagaacacttacactagcctatagttaggcaaaaccatctagtacaaaaaaaacccgattttataataaagtgttgaatatctcatgtaatttattgtactgaaagtgaacagaatggttatatgggaactcgaagtacagtttctactgaatgcatattgctcctgtaccttcataaagtaaaaaaatcgactaggcgcggtagctcacacctgtaatcccagcactttgggaggccgaaacaggcagatcacctgaagtcaggagttcgagaccagcatggccaacatgatgaaaccccatctctactaaaaatgcaaaaaattacccagatgtggtggcacacacctatagtccagctacttgcgaggctgaggaaggagaatcgcatgagcctgggaggcgagtgagctgagatcacaccattgcatttcagcctgggtgacagagcaagactccgtctcaaaacaaacaaacaaacaaaaaatcataagtggaactatcctaatttggagaccatctgtaattagttggggcacaatacgcatttggcaaatgaatcaagggaggaagggacagtctgtagctcatcctggagtactaggaaacattcttaataagattactccaaactgaatgtgatgtacacttctgtgaagccttccctattttttgaagacttaattctctaatgcacaccctgcataactactgggtgtagtagtggctaagaagttatgctggtgagtttggctacatgggcttgaactcttgttccagcacttctaagctgtgtgaacttggtgagtgcttcagttccctctctgtatagtaagaataataatagcacctacatggagttgatgtgtgttggcaagtatccgccgagaatggagtagcccatagaacatactcaatgaatgtgagctattgttactattttagcatttcttatactggtaccttagttacagcagtccttccttatctgcagttttacttcatgtggttttagttaccatggtcaaccacagcctacaaatattatagtattttgagagagactacaatcacataacttttgttacagtatattgttataattgttataacaattgttataattgttataattttaattataatataatcacagtatattattactattaattcttactgtgcctaatttataaattaaactttatcataggtatgtatgtatgtatgtatgtatgtatatatatggaaaaaaacacagtatatatatatggttcagtactatttgtggttccaggcacccacgggggattttggaacacatcctccaccaatgaaaaggaatgattgcattgtcattggtttccttattatgtgagcatctaaaaggagggaaacatttaacaactattttatttttatattgtcaatgcttacaacatatataacatgcagattaaatacatacttgtgaatgaaattgtatggtatttccaagttcatgtcctgatattgatgaattactgtattctatcttttttttttttttttttttgagacggagtctccttctgtcacccaggctggagtgcagtagcgtgatctcggctcactgcaacctccgcttcctgggttcaagtgattctcctgcctcaccctcctgagtagctgggactacaggcatgtgccaccacacccgactaattttgtttgtttgtttttagtagagacagggtttcactctgttagccgggatggtctctatcttctgaccttgtaatccacccacctcggcctcccaaagtgctgagattacaggcgtgagccaccgcacctggcctctatttttaaaccccatatttattttaaatcatatagaatatagtgtagtaattcatttatatataatttgctttaattcttcaccctttgttttccctgagagtttcatatgactcttttccattcacccacaaagtagttccagctttaagtcattccctgtatcaagggctagtaagctgacagccagcactgatgcttgtttgcatttgagcattggagctcttatttctagaggtacactgtctattttctgtggttttataactgatctttcttggcctcctatttgaatatagaaagagaaaaattagaaaatatagaaaaaagtgagaattttttggctgattttatgttgcctctgaggcctaagtgtcaaaaagatgaatctggggtttgatatgtttggcctgtctgtagggctttctcccagtcctcactggcagcaccttttagtgtaagaaaagctgtatgaaaagagaaagcgtacagcatggatctaaatttagaagacatttatttttcttaatcccagatataaatacgtaaaactattacattaattccgagactatccagtggttatatataattatgtaaagacaaagtaatagagccttttaaaaacttagaacagtgtaaaacaaaatgtatatttcacatttatcttttgtgagtaattggaagaaatttacaaatgaagttaagattttcccttaatacctaaagaactgtttctgaacatcgtggaatttatttataatggagctaaaacactccacttttttgacattgttccttatttcatagtaaactgtaattctttacctacaggtgtagaaaggtggattttgggggctttcttctttttttcctttaaaaattttagaagtatttcttttctataacaaattcaaaccttcctcatacactttttctgttttataacactgtcagcccatggtagaaagaaataggaagaaaatgtctttaaatttagaaatatactttggttctctttttctgtaaagaatcacagatgacttatagtgtttatagtttttgcttttgttaaaaaaaaaaacagtgttttgtgtttcattaaatatatactacttttcagtctaattcagaatattgctttaaaatgtcccagatactcagttttgaattttcatgtataatatcaaggttttattataattgaacaaacatctggcacacacaatggctttctcacgcagcacctctcaactccaccccgtttctccattcatggagtggggaagatacatgcccagcacaaactgcgtgtttgcaaagctgttaatgacataaatgtcctttccagatacaaaacctgagctttgtgagctccctcaatgaggaaaactgtttgaaacaaaccactttccccattttcctggtcattcactgaatgagcttgttgatacagttcgaaatgtaaatgctggcatacttttattggattaaaaaaaaaacaatctaaactgacttcagtcatgaggatattcattcttgaccttatttgggatgataaagagagaatcttctatacatttaccctgcttttttgtcttcaaagcctactgaaaatgagaatgagggatataatttatttatttatttatttatttatttattttttggaggccgaatctcgctctgttactcaggctggagtgcagtggtgcaatctcaggtcattgccgcctccgcctcctgggttcaagcgattctcctgcctcagcctccccagtagctgggattacaggcacgtgccaccacacctggctaacttttgtattttcttagtagggaagggtttctttcaccatgttggccaggctggtctcaaactcctaaccacgtcagtctcccaaagtgctaggattacagacatgagccattgcacctggctgatataatttaaatactttaataattcttaggactcttggctgttcaaaaaaatcaagatgtttaaaaatgcattttagattttactcctctgtaaaaaaccatttgctgtttatttttaaacgtttgaaaggacatgtggagtggggaaaggaaccaggccttggagcccactctcagtggttcagatagactctgggaagggggtgagtccagtgaggaccctggagacctggactgatccagacccagtgtctccttatgaatgctttacagtaaactatgacctatcttttgaacatgaaataggtcttacttccgtcttctatcattttttaaaacattcataattccaaagcctgatgtcttagaattattactaggattgcattctcttctgaatatataacaatgctgttatacttctaagaaaacgattttttttaatgacataataattctccatcaccttctacaagactaaagaacaatagaatactgaagacagaggattcaaataactcccatgacatagagtgggtcatgtacaaatggagttgagtttttaaggaaagatatagtaaattacatatgtttcttatttttgcttatattcctattttaaaaaaagtagcttgacttcattttgcagttggagaaaaataagttatagggtattagaatgtcttccaataagcagataggaagtggtggtcaagatgactactcagagtgccttaatatttcagtctaatatatatgccacaatacctgtaacccatgggaaatagaaaagcaaagttagcttttgaaatggtaagagagtctctaaccaggaaatgcagcagtgtggattatctctttttttttcagtaaacattcaagttggtgtttaaaatgcatgtagagggccgggtgcagtgactcacgcctgtaatcccagcactttgggaggctgaggtgggtggatccgaggtcagcagttcgagaccaccctgaccaacatggtaaaacccatctctactaaaaatacaaaaattagccaggcatgatggcacacgcctgtaatctcagctacttgggaggctgaggcaggagaattgcttgaaaccggaaggtgaaggttgcagtgagccgagatcacgccactgcactctagcttggacaacaagagtgagactctgtctcaataaataaataaataaataaataaataaataaaataaaaataaaatgcatgtagaaaagtgcctaaatcataaggccaccacttgacaagcatttatagtgagcatacctggtaaccagccccctgaacctccctcaaacttcctcgtgattattccccaccctcatatccaatactcatacatagcacttaccactatcctgacttcattattgtagattcgttctgcctggtgtattagtctgttctctgctagaacactgctaggaagaaatacccaagactgagtaatttataaaggaaagaggtttaattaattcacagttcattgctggggaggcctcaggaaacttacagtcatggtggaaggcaaaggaagagcaggtaccttcttcacagggcggcaggatggagtgagcgcaagcagggaaaatgccagacacttaaaaaatcatcaggtctcatgagacttactcactatcatgagaacagcattggagaaaccgctcccatgatccacttgcctccacctagttctgcccttgacacatggggattatggggattacaattcaaggtaagattttgggtggggacacagccaaaccatatcacctgcttttgaacattagctacatgtaatcataatatgtactcctttgtgtctggcttcttttattcaacattgcatttgtaagcttcgtctgtcttgtcatgtgtagtagtccatttattttcattgctatatagtatttcattgtatactacattatgtatccattctactgttgatggtcatttggcatgcttcctatgtgaggctgttgtgaataaacttcctgtgaatattcttgaacatgacttttcatgggcataatcactaatttctgttggatatcactaagaagtataatttctgggtcataaaatgtatgtatgtttcactcacatatatatagccagtttttcagagtaccagtttacactgctaccagcaaagggttaagagtctcagatccacattatcatcaataattggtattgtcattcctcttaaggtttagccatactgagtaaaggtatctcattatggtctcaatttgtgtttcccttgtgaagatatatctttaacaacttatcatacctttattggccctttggatattgtttctgttatctaattctgcataagaaacttcttccaaatgaagtgctcaaaacaactattttaatggcaacttcaggtgaactcaagttgttaattttaatgaagtccagtgttttaattgttttatttcagatcagtattttttatgtccagaatctttgcaaaccctaaagtcattaaggtactgttatgttgtcttctgatagctttattgtttcacattttaaatttggatttgtaaggcccctgaagtttttttgcatatggtgagaaataggggtcaagatttcttcatttcctaaatggacatcaaattaggtcatcactgtttattgaaaagagtgcctttttcccactaatatgaattttttttattaaccatagagtcagatatatatgaatatatttctgcattattcatattatttaataggtttatctgtctttgtaccatttgtacattgtcctagttacagtagctttataataaattttaatgttttctgctgtcagttctaacttcttcaattctgttcttgagattgtcacagctattcttggccctttgcatttctatataaattttataatcaggtgatcaatttttacaaaactctgctgggattttgattggaattgagttgaatcaatagatcaatttggggaggtttggcattttacagtatttagtcatctaatctgtgaatacaacacacccctttattagggtttccttcatttgtcttagtgttttgttggagatttttgtataaagtctttcacagcttatttaagacttattcctaggtcttcaagatttgcatgtggttgtgaatggtattaaaatttttttacccttataattgtttgttaccagtatatagagctaaatttgatttttgtacattgaacttgtatccatgaccttgctaaatctgcttgttaattctagcagtttatatgcagatttctttgcatctcccacatatacaattatgttgtataagtaatgctagttttattccttctcttctggtaagcatacttttatttccttttcatgtcttactgtactgtctaggacctctactgcaatgttgactagaagtggtgacagcttgcttgtctctttcctgatatcagcagcaaagacatttaatatgatgcttgccataggttttttttttcttaatagatattctttatcagataaagaagttcccttatatatctagtttgctaatgttctttatcatgcttggttttgaattttaacagatggtttttctgcatctgttgaaataattacattattttcttctttattctgttaatgtggtgaattacattgactggattttaaaacaagataaaaatttgttttccttatagcagtctaagcttcagtaatctagggctgataatacaggtctataatacagggacccagacaatatctttttttttttgctttgttcttccggactcaggttttctctatcatggtctcaaaaaaaaaaaaaaaaatccttgaagaattcaccggtaaagtcatttgtgcctggaatgtttgtttttgtttccttttgtttttgtgcctatgcattataaacatttttaaattgcagttaagatttcattaatagataaaataatattcaggcttttgacttttcatgtcagtttcagtaagttttgttttccaaggaatttatccatttgggtaaaatttcgtttttatttgcacaaaattatttataatatcctcttctctgtatatatgtagtgatcttttttaaaatttcagtaatttgtgcttatgtttcgctcttgatcagttttcctagggttattagtcatttcaaagaaacaacttatgtggatttgtttcctttgttttctattttattaatttttgcttttatatttattattttttctatattttttatatttacactttggggtttaaattgtctttatttctaactacttgaagtagatctttaaatcattagattatcaatcttctaatatttgtatttataggtatatatttctttctaagaatggctttatctgctatccataagttttgatatgttgtattttgttatttacataaaatatttctaaagttcattgtcatttttttcctttgaccaatgaattatttagaagtatttcacttaatatccagatgtttgggtattttctggttaactttttgttactggtttctaccttaaaaccactatggccagagaatatactctaaatgacttcaatccttgaaatttgttatggcacagaatattatcaattttagtaaatagtccttgtctgcttgaaaacaatttatattatgcggctggacctatatgtcaattagggccagtttgtaagttgtgttgttaaaatcatctatatccctaccgattttttgtctgcttactatataaatgactgaggagtatgtaagaaaactacatgtatgtaagaaaactcggctagattaaaaagcattttaaagggttttatgtgtatttttttgttttgagagttttgggttttatttgcttgtttgtaattgcaattgttgagaattgcagtgacctcctaacttaaatatgtgtatactattaattaataattatcagtagcattttatcttacataatataatttcaagcaaaacacttcatcttaaaacaagattttattttcattcagaaaaaataaaacgttgcaagttttcaatattttaaaaatatttatgaataggtattttatttttgtttgtacagttgtatttcactcaaatgtttattcctgttagggtggaatatatatttatacacaagcaaaataattaaaatacttatttaagtatcctcaaatagtagattgcaagtatgtgatttttctgattttaagagtaacataagccaggtgtggtggtgggtacctgtagttacagctacttgggaggctgaggtgggaggatcatttgagcttaggagtttgaggccaggccagcctggttgatgtagtgagacaccatctccaaaaaaaaaaaaaaaaaaaaaaaaaagagagagagagacagagacactctcattatagaaaatttagaaaattctgagaaatataaagaaaaaaatcatttatcaaccagtgttaattaatgttaatatttgacatatttcttaatagtttttagcatttaaaaatgaaattatatactttatttatttaattttttttttttatatggagtcttgctctgtcgcccaggctggagtgcagtggtgctatctgggctcactgcaagctccacctcccgggttcacgccattctcctgcctcagcctcccaagtagctgggactacaggcgcccaccaccatgcccagctaacgttttttgtataggattaatgagagggaggaggagggaagactgttttgactgaaggatctctctaaagaaacagcatttgagctgagctcagggcaaagcctctgagacagagaacttggtgcactcaagggagtggaaaaggccatgcctggttctgagagaggaggtgtagtctacagcaatcccaccgtaaatacacctctcatctgatcttgaaagctgagcagggtcgggcctcattagtacttggatgggagagagaggctcagcaagggtagagctagggaggcaggtacagaatttgcaacttcccacaggaaatgtaaagagtttgggtgttattctaagtgtaactgaaatagactgatagattcggagcaggacaatgatatactatatttcatctttctaaaaagatgcacattttttcacctttaatactggggcacttcctacagttgaagtgatttttaaaaagcagtgcaaaataggttaatttgtagagtttttttttttctttcttagtggttcagaaaataattttgttctttttaatgagtggagtcttctatttgatttaattcagtaatttatattttttaagtacagtgtttctgttttccaggttgctttttggcaatggggttagaggagcaggagaaaactcaggatatcttctaggatattgttataatagctcaggccacacatattggtagctcaggctagagcagtggcaacatgatggagagaaatgaatgactccaaaaatgctctggagatagagcctagtgctagattagaacatagagttgaacccgatgtaggacatggaggagaactgttgaagaggggtcataggtcctggctttagcaagttggtatttggtgacactatttgctgacatggtaaaaaaacgaagcaatttttttgtaaagatcaagagtgtgagttggttatattaaattagagttgcctgtgaaatatccatgtgggtgtgtcccatagggaattggatcaagttaattctaatgttcagaagagaagtctagtctggagataaaaactggaagtcatcagatctagaccgcatgtgaagccatcagaatggatgagaccaccaagagagatcatagaatgagaaaaaaagaaggtctaggactaagctctgagaaatgccaacatataggggtcaagtaaaagagaccctgtaggaggagtccagggagtaagaggaaacagaggatatggtactgtagaatccaagggaaaagagttcttcaaggagagagtggtcaaccgcattgaatacaactgagagctctactaagaggacaagaagaatcctttgggttttacaaaatggtgaccttatcaggtgctgtttcagtggaatcttgaattcaggagccactcaagaatgaatgagaactgatggagtaaacacagcatgcgtagataagtcaagaaccttggctgttaaaaaggagtaagaaatatggaatgatccaatagagagggaaagaaggtgatgcaggggcagaggccacatggacaagcgcagacagcacgtggcaaaggcctctatgccattacccatggaagaaaactgaagaggtttaagcagagaactatttgattggactgtttcattaggtaaattattctgtcattgtgggagatgaatttggggtctttaatgagtgtctgaaagcacaaaactcagtttggaagccattgcaggaattcgagtgaaagataatgtgtccttgaataaggctggagaggaaaggagagactggagatacaaccaaaagataaaatcagaagaatgtggtgactggatgtggagcagtaatcaaggatgactcccacatttttgggtaactaggatgatatatgtgatttttaggatggtttccaacaggatatctttaactgtagatggtgaatacctgttgtctacatagtggttgacaaaaatggagcagtgttgttttagtttctctggaatataggattgaggcttgtctgggtaatttttacagaataatttaagtaggctgggcatggtggctcatatctgtaatcccagcactggttggccgaggtgggaggatcacttgagccgaggagtttgagatcagcctgggcaacataatgagacctcatctctactaaaaattaaaaaaaaaaaaaaaaaatgccaggcatggcagcatacacctgtggtcccagctatttgagaggctgaggtaggaggattgcttgagcctaggaagttgaggctgcagtgagctgtggctcactgtgagagccatggcactctctctcacagtgagagcatggcactgctctctagtgtgggcaacagagtgagaccctgtctctaaaataaataagtaagtaagtaaattttttgaaagtagtacatctccatgctggggaaaaaaaaaaaaaaaagatgtctcattggccagccttcttttctagaaggtaattatgggaaagttgaatttcaaataatttgttacctatgtcatttcttattgcttatcttaggctgctagctttcaaaacagacttgtgaccatcaaggtccccgtgtttttttcctgcccttctctgtcaagggatagcatggtagtcagactcggcccagggatgtcgtctgctgtttctggcctattcccatctcctagaacaaagttattttccataacacatatgggctatattccccagccttgtcgatgttgccagacctcagtggaccttttttaaaaggatctttccatatcctattgtattgcctggaccatctcccaatccagtttttaatttcctattggctaaattttattttctttctttaggccttgtgctcatcttccgcttaatgctggcttccctcctgtgctgtgagagagaccttaatcgcttgtgggccagcagccatgccattttaaaattcttttgggcagctattcagctggtttaacatctttcactcccacttgttggctgagatttactctctcctagccggcttccattcctttcagaaaggagtgtgagggctgcatttccattgtaagccccttttctttggatctgttttcctaagattctggcaccaaatacttaaccaatctcagttggttaagaagttctgagctaaaatagtgggccattttcttcttatgaagagttccaggagcaccgatgctagacatggtcctgtctaagtcctgggacctcctgagacttgcaaccatgggtgcctgatgtgctttcttccaagggtctcctacaaaaatatcctcttcatggcccacagtagctctagtgtctagatttcaagtatgatgatatttcttgtattaaaggacagagatgcctaagtcttatttaaggacaagaagacttgataaaactggaagccagtaggtgatgagtcaaagagtaacagatggtgtgttctgacctccatcttcatagtgggcaaactccagtgtgctttttgggctcacagtttggttagttctcttcatcatctaggactaaccttttttaactatcatcatggtgacaggtaagagaatgtgatggctagaaccacagacagattcagaggattcttctgtgaccaggccctgttcctctgccagctctcccgctaactgactatgtaaccttgaggcaagtcacttcccctttctagccctcagttttccggttattaaaatgaagagattgaactggataatcttcaggtttccgttaagtcaaaatggaccatatgattcatctaaaaatgttctaagacaggaagcccgtttcttcacaactctcagtagctttggagattttcctatgaattatccattaccaaaaaatgacacccccattcccactatccacttctctggagcgtcctggcagcagacggaaagctcattagtgagctgcttcccctaatagatgagtacgttttgctcagaataaggaagaaggaagtcaacaaaataagagaaggagatgttaagaaactaagaagaagcactttcctaaaaatgtaaaaccaaaaactgaagaatatatctgaaaaaagagcaccaaatcattttactaatgaaatagacacaaatacccctttctttccaatatacatcattttcagaatatgtacagatacacatagacttttctgcatgtaatacaagacacctaatggaaccattgagatttgttgtgaatttttgtgttgagttcttaaaattaaaacgattttaattttttggttcttaaacaagatttacatgaccccaacctcttttagaaaaccctgccttctttccatacttgttatttatttcatagttcactttacataaatgagaaggtgacacaggtgtctggccttacacctttatttgagaattcgggagtgcatgggttcgagttctactctagtatgtagactccctgaatgcagtcagtaggtttttaaaaacttttggttcattgagaaaatgtcttaagtaaaaagcatctgggcaaggaaaatggatctgccaagtagatcaataaagaccctcaaaagcgtggatctattagtcattgacaacattgctactttttaaatgagccactggtagttcccgtcacccagaactatgttctatttttctttctgacatttatgtaattttttattgggaaattcacatcagggatcgattctccttggtttgcataattctttcttgactttatttccattgaaatatcaatatttatatctgccttcttcagtaaagtgtaaatagcaacacttgcgtgatgaatcagcaacttttataataccacacctgatttttctggattgacaattgacagttgatcactagacaaatcacgcctgtaatcactaacccattggatagtattaccaatgatatcatgcatggcccttacagatcactaagcaaaattgcttggtagttttaacagaatcacccttcattaagtgaaaacatatgatatttggatgattcaaaatatagtttcatcttccaaattcaactttagcaaaaaaggatgactttcacttgttcgtttagtcttgctgggacttctactctaatgtaataaattttcttaacatttagctttatttctctagaattactcgtatttgtagcagttcttttcattgtatgtatatacgggactaacaatggaaaaatatctcagagagctcacatcatcaaagaaaattctaatgaaataatgttttttcttgtagaggtcattaaagtgaaacaaatgtcctcttattaagctattacctcacctcattgttgaaaacatgaaactgctgagaattacattatatcatttttataaaatattagttgctgaagagctagtttccagcaggcattccacgttattttttcctattcattcaaatccaaaatattgctcatctaaactttctcggttaatcactgttacagtaagtctgagactgcaagacgcccagtaattcataaccagcttggggcttgttcaccttcaggtcaattatttggttcctgtgcacagtaacgagaaatcatcatctgctataattgcatagaattaataaaaaggaaagcaaggatgttccttcaggaatctggactgaaaagccaccaggtttctagtacataccttctctttctcctccttagctgtccttccactcattttagtagggaaataagttgctgatgaggttaagttaaaggttcctcaccctgagaaggagccctcgataagcacagcagtggcacaaaatgctctgggactggagaggagaggccctgagatctgcttgtggagtagttaaaggaggtgctgcagaggaggtgtctcttgggctgactcctgaagggccaagaggcatttctaagtaagtccaggggaaaggggtggcatggagattccagagacggaaggagtggcatggagattccagagacggaaggagtatgcaccaagtccatgaaaaattaaagaccgtaggttttcaaagacctctagtatgctaattgagccagagtgcaaattgggaaggaggttgtctggaaactgtggccagacatataggcaggaggcagatgaggaagggtgctccatgccctactaaggagtgtggttaccctttagccaagaggagattctgaacactctgagcaagggaatggtactggtgagtttgcattttgcagagagcacattggcagttttaggtggagaatggatagagggagggaggcaagactggagatgggaagatgacccaccaagagtatgagtatcaggaaagatagtaaagacggcatgacagggaaggacagagaataggagaaagtgaagggtgatattaagatttctggcttgggtgacagattggatttgctgatgaaggaaataggagaaatggagttgagatgaggaggggagtgataataaattcgtttattatgaatatatccaataggtattagataagtggttctaaaggacagaggtaaatttttgagagagactgggaaatcatcagtatgtaaatggtaattgaagtatttccgagtttctttccagcccttaaatcctgtggttcaatgaataacataaataatctctttgatgtacgcccatctcagaaagcctacctttagcagtggcctgtgttaagtgatttggtgacgcgatgcagttcctcctcaagttgtgatcagtaaatagtgatctcagcctcatgctgacattgaaaatcaatcagaacagatttattgagtgtcttttttgtgtttactgttgtaagggagattcattttttagactggaaataatttcattgatttgtcctttttttttttgagacggagtttcgctcttgttgcccagtctggagtgcaatggtgtgatctcggcccactgcaacctctgtctcccaggttcaagcaattctcctgcctcagcctcccaagtaactgggattacagtcatgcaccaccacacccggctaattttgtatttttagtagagacggggtttctccaagttggtcaggctggtcttgaactcccgacctcaggtgatctgcctgtctcggcctcccaaagtgctgggattacaggcatgagccaccgcgccgggcttcattgattttttaattcaagtcaccaaggtcaggaaatggagtttagtaggaagacagtgaatacagttttaggcttgataagtttaagttcatggcagaagatccaatggaaatgattaagaaatgtgcttgcaccccatctctactaaaaatacaaaaaaattagccaggcgtggtggcgagcgcctgtagtcccagctactcaggagactgaggcaggagaatgacgtgaacccaataggtggagtttgcagtgagcagagatcgcgcccctgcactccagcctgggcgacagagcgagactctgtctcaaaaaaaaaaaaaaaaaaaaaaagtgctccgtagaagaatcttggctggagaggaggatgggggatttatcccaaggagcatggtcactgaaactgggagagtgtgggaagggtggaggagaggagtgctgagcacacagcagatttcaggcagggcgggagccttggcagacacccactttcaggctgccaaagggcaaggacaagctcaaggcagaacaagaagaatattccgtcactgaacgtgggaagagagtgttcaaggagtgggcattcagccagactcggaggtcaggggtgactgaccggaagatgatcatgagatttagtgatgagctggtcactggtgctttttctcataggagtctcagtggcataaagagttaggaagtaagattctaggtcattgaggaggaggaggaggaggaagaggaatagtagtaataataataaagttgacatgtactatattggatgtctccctacgatacatgccaggcagtcttcaaagcactttgtacgtgttattttgtttaatgctcacagtaattgtaggaacttaccaatgttattaatattattcatattgatactattatttccatttacagatagactgtaataggaaataaagacaatgagtatagacaatcctttgtgacattttgcagtgatacaaaaagtttaattccccccaaactaaattctgtcaagtgaaattgaacttgtcattttctttagcatttgttgtctgatttcattatttgaacataaaagtacaatcttcacatatatttggatgctgttacattttcttaattgtttctccaaatcttacattttggcgtgactgttaagtccagggcagagagagcagagtaccaggcgtggctggtgtgagatgtggcagtgcccaaggagaagaaaagcacaatgggcgatgatatgatcaggtgaaaactattttcaagcaattttaacatttttgaaggcagtgagggtaggatccaggggaggaataactgaagatgttggagaaggatgagcaggtgggaccttgaggcagagactggtcagggcgggagaaggagccccacccagaaaggagaagggatgtaggttttttgtttgtttgttttgagttgagaaaataagtttaaaagagaaaatgcggccaggtgcggtggctcaagcctgtaatcccagcactttggaaggccgaggcgggcagatcacgaggtcaggagattgagaccatcctggctaacatggtgaaacaccgtctctactaaaaatacaaaaaattagccaggcgtggtggcgagtgcctgtagtcccagctactcaggaggctgaggcaggagaatggcttgaacctgggaggtggagcttgcagtgagccgagattgcgccactgcactccagcctgggcgacagagtgagactccgtctcactcaaaaaaaaaaaaaaaatatatatatatatatgtatatttatatataaaaataataaaagagaaaatgctcaattttattaatagtaactctccccaaactaaactctgtcaagtgaacttgaacttgtcattttctttaacagttgttacctgatttcattatttgaacataaaagtgcaatcttcttcacatatatttggatgctgtcattaacattttcttaattgtttctccaaaaacttgcatgtggcatgactgttaaatccaggggcagagagagcagagtaccaggtgatgggtggtatagatgtggcagtgcccaaggagaacgggaaggaaagaacggagaaggaaattagtaaccgtaagaataaagaagaattctatctaaaagtctgttgtaactttgcaattgaggcatcacttttataagaacatttttattaatgagaaaaaaaggcagaagatcactctcatcacgtttatggagaacaaaatgaattggcaagtcagccaatcagctggagcagcctggacggttaggaccttgaatggctgtaaattggtggcatcaaatcttttcttttggcactgggactgactggctaccctgctgacttcatcagactctctcttgacttcctgaggatgttgtgtagtctggatcaaggttatccacaaggttaagtaaactattgctcatttccacctgtaactatcagatgcaaatactattagcatttactgcaactaaaacaagtgacaatattttcacatgttttctctgtaggaatataaggtcccttggaaataaagagtcgagaacgtttaggtaatactgggcgtggcacttgcagccatcatttcagtctaaaaacatttcctaaggaaaagtactaaatgtttttttcatagaacccaacattttggctgttaaaccattttcatcaaaacattttatttatatgtaaaatattttaaaagctgttttctgtgtaaacatgttcatctcatcatcacacactaatcaggatgtgttgagtgcctctgtttatccattaatatctggtgtttgtcagcctgtgtttgttttgtgtctgatgttccatgtcttttttgcagatattgatgaatgtgtaaacaacactgtttgtgacagtcacgggttttgtgacaatacagctggctccttccgctgcctctgttatcagggctttcaagccccacaggatgggcaagggtgtgtgggtgagtttttagattttttcccaacgtgtttcacatgtccctagggaaaagaaatcacagtgaacaacaggagcttttaagcaggtaatttgggtagagctttatcgtaatttgattttgtcatacaatttgaggatgtgcaaaaatatcctatgttggctgggtgcatggctcacggttgtaaccccagcactttgggaggccaaggttggagaattgcttgagaccaggagtttgagaccagcctgggtagcatggtgagatcttttctctatgaataaaaattttaaaaaaaaaattagccaggcttgatggtggatgcctgtagtcccaactacttgggaggccgaggtgggaggatctcatgtgcccaggagtttgaggctgcaataagccgtgatcatgccactgcacggcagcttgggcaacagagaaagaccctgtctcaaaaaaaaaaaaaaaaaatcctatggcttctgaaattgttagggacattaagaaatataaaagtatgactttacatttaaatgaattttaacaagaacatctgtttaaactctaactgagtatgcagaactctagactcccttcagcacaggaaatagagtctggtgtgtggtatagattgtctgtctttgaaatgcatccccttagacagtgcgtttaaggcaaagtattgccaggagcttcagtgtccaggaatgatacctgtaaaaggatgctttgaattgtgcaactgtatttcctcagtctgttccgggattgacagggctggaaggaatcttgaatatcatcatatgtcctggaatatggtccaacaaatgctcacacagaaaataatttgtatttcattgtctgaccaagatgtgatttcttcacgtcaaactcattatgaaacatatttgcaattagagcaattaaatgggaaagagaagaaaggttatcaaattcaagactttatagatagcaagacttttctttttctttattcttagagaaaaatagccatgttcactacatggcaggtggaacttgaggagtctattgcctatttggtttgaaaatttgcaattaagacattagttcatttgccatccatattaaacttggaaaacaagatttttaaggtttaatgataatgtcacttaataactgcttttgtggaattatgaaattcagttaattctcaaccaaaaattatttacaaagcaatggtgtggtttcatgcataagcagtagctagtcaaaaacatagataattattcaagaattattcacaacaagacatagttatttaataatatagctaagactatcctaatcttagttcaaactcctgctttggccacctttccaccaaaatacagttgtttgacgtttggataatattttcaccagttgggtcttgtgatgtggcccctacttttcatcttaactttaccacttccttcttcacctgttgtttccagcaacgtcagactggttgtggttgcccatgtcactgtgcaattatttgactgttgttcactccttctgctgggaatatcctcctgacctctccttccctgagccctggatttttctcactcgttcttgaagactgaggttcagtgtcatcttccagacaccatccctgctccattcctcactctcaagctgagctgtgacctctgcttccagagcaccttcagcaaattctattatagcacttacaacctttgggggaataatttaataatgggtataccacctgcagaccgcttctgcaaggctatgacctctatatgattgaaaactttctcacttctccctgggcagggcacgatgcttggcttattataggtgctcagtaaattttgtttaactaccaactgtttaaatatcagatgttgaaccatacctggaaaccatgtcagctatctggagtccacatagctccagagcccctgcttaatgttcatttctaaccagccagatgagcacaccaaacccatgctgacatttcagcttggcacacaaaacaccacccttagagaaggaatatttgttatcattttggtgaactcaacaaatgccattttatttgtgtttgtatttattatttcaaaaatatttactaagcacctatgatacgcacttcacactgggtgttctgtagagctacagggatgagtgagcacctgccccattatcacctactcatccttcagctatttgctccagtatcatttctctaacccacccccacatttaaggtctgctgttccatgctttcactgagctctgaacttttcactcctcacactcactgaagcatgtacaattattttgttcatttccctaactcgtctgtaagctccatgaaggcaggagttgggactgctggctcatcattgttaccccacatataggccgtacaggcctgccccacagaagtaagctaggaaatatttcttgattgaattattgcagtctgatgggatagagtttattagccatgtcaataatacatgttggaaagtacaaagttccactggacatttacctaaaattgatcaatgtgaactggcaatttcttaagtttttctggtctcaatatgactgtcggttgattaaatatttcaactctgctttatgttatggtatttttcacaagtgaaaccagttcattggatttatatctctttatatataaatgaaatggaaaactgaggtaattatccaaataagtcaagatgtataagctttttgtccaattaactgggtataccaggtgaaaggacgatttttttttttctggaatgatttagataattgctcaaatttttaactttgattaagccatctcaaagtatgctcatgaaagctgatgtttatacacgtttaatgcataagacatgtgagcatttcagactttaagtcaggtgctttactgaattggatacccatgaataaaatattgcaggaggaaagagggtaaaaagcactatgggacaacatcaaacataaaattagcctttctttagggctgtgtacttgcaaaatgttgaataaagtgtacttgtcactgagattccttcactgtattttaattatgtatatttaagtacagaagaaaaacatttagcaaaatagaaattacacagtggaacatcaacagaatttgaaaaggtgtcatgagatcagtgattagttattggaccaatttgtttcacatgaatgattaatgtagcctgatgagtatctataggagtctttccttcatttctcaaaggaatatgtaatctgaattctattgataattatggatgctttggctaccagagaactgtattttcagatatttaagtatattttaaaagtttttaagtgaacttaattctgtggttactgaagtgtcagtgattctaactttgcttgaattaagaactgagagtaggccaggcgtggtggctcacgtctgtaatcccagcactttgggaggccgaggcaggcggatcacttgaggtcaggagttcatgaccatcctggccaacatggtgaaatcctgtctctactaaaaatacaaaaattagccatgcatggtggtacgtgcctataatcccagctactcaggaggctgagtcaggagaatcacttgaacccgggagacagaggttgcgagtgagctgagatcacggcactgcactccagcctgggtgacagaatgagacgccgtctcaaaaaaaaaaaagaactgagagtagagtgttgcgtcatttaagacttcattatgttgaaaagtcaggaatgataaaactagatggtcagtgggcacatactagttttgcagtacaattccagagtatcttttaaaactagattgggaattggctgggcgcagtggctcgcgcctgtaatcccagcacttttggaggccgaggtgggcggatcacgaggtcaggagatcgagaccatcctgcctaacacggtggaaccccgttgctacttaaaatacaaaacaaattagcggggcgtggtggcaggcacctgtggtcccagctattcaggaggctgaggcaggagaatggcgtgaacccgggaggcagagcttgcagtgagccgagatcgcgcctctgcactccagcctgggcgacagagcgagactccgtctcaaaaaaaaaaaaaaaaaaaaaaaacctaaattcggaattgtcttgaattttcatagtcctttcgtacagaccaaatctgacagctctaccttaaagagccccttccctaaaagagcagaaggggtttgactgctctctggggatcgccttcttttcagcaagacactattagccctggcacagctggtaaaatagagagctgtcgtgaatgaggcacacatctcacttggtctgtgctcccttttccagatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacaggtaagtcccagtgacactgtgcaagggaatgacaggctcctctcaaagacctgcacccacacagctttgggataaacgctgggagtgagataagaagcagccagatgtcctgacacagtgctgtctctggaagcttccatgatcttctgtgcctgccttgtcagtggaattaagatgtgggtgatgactctttgggctagatggcctctaatgttctatccaaaccagagatgcctccagtaaggtaaaggatccaaaatgatgaggacatttgctggggattgcttaaaacttagagagctatcagctcaggatttaatatggcaccatctcattaagttgcataatcctccatacgttcttggcccttagagaaatgtgtcttgacacttctctaaattaaaagcaacatataggcctcttaggatctacaaagacttccacttggaattcttaaggtgtttttccagaatttggcctagagagtagctatgtttgcattcgcttaaaatttgatttaggctgtgtcgtcactgtgcaaactgaaatagagagttggactgttttccagataaattaatcaacttcccaatcacccttttaagtttgtgccatgtagctatagcttggttgtattttagggaaagcaaaggcccaaatggtcctttgagagccaagtaaaatgaaacatagaccatttttttttctttctcagtcagttttatccatgcttccataatagctttcactactcctctggaggatacacttgttctgtgtaaaatagctatctttgcaagtaataggaaatgaaatatgaaaatattttcacccacacatatttcctcagttattaaatatagaaaggtgaagggtatagaattaaatgaacaggctataattcaaaaaccttgtgaaagagaagagacaggttattactggtgggaggatttctcttcattcaagtgaccaccacaacaatacatattccataaagaagagacttttcattttaattggatctacaatagcaaaaaacaaaccaaaaaacaaaaaaatctggttggccactaacagaattggttaactaagtgtctttttcttatttttgtttggttccatagggtagcacctcacctatagtgttattttgaatgaattaattcatatatcataatatatagccattaaatggtctgggtgatgcttagatagtcatgataaagataaatgtatgtgatacaatgttaagtgaaaaaatacaggatattccaatgatcacactctgtagaggaagggagagtgagaatacataaaaaggtaattgttggaccgaaccaataactaattgagcttattcatttgtatagctcctggcagcttttccttttatcatgcctcaatttgtatagttgatggtgaactttgattatatggagtcttaagactgtcttatgacagtcttcatttttaaaaaattttctagcagtatcctgagagactgagtttagccataaacttcagcagaagccttctgtctgatttcatcagagtcaataattgatcagttatttgaaaaaggtgattaaaaactagaaatcataaaaaggtaacatcttctaaatttaatttttaactcaaaggatataagtacatttggccaggtgcagtggctcacgcctgtaatcccaacactttgggaggccgaggcaggcagatcactgaggccaggagttctagaccagcctggccaacaaggtgaaaccctgtctctactaaaaatagaaaaattagccgggagtggaggcatatgcttgtaatcagtaaggcagaggcatgggaatcgcttgaacacatgaggcaaggttgcagtgagctaagatcacaccactgcactccagcctgagcaacagagccagattctgtctcaaaagaaaaaaaaaaaaagtacattcatacaccaatctttgaagagaaaggctgtggtctttttttgtgtagaggttcatttgtggagtttgtgtggctatcctgcataaaccccatctgttatgtattacttacactttctttgtagaagggagtgagaatctaaagcctttttcaaaacaaatgaatgtaaaatccctctaaatttttacagtttttctcaattttttacacttgtccacacctaatttgacagcatttcttttactgaatcaactttatctaatctttctaaagctttaacttgccctagaaacagctcttctggttacattcatattgtactggttgatgtaatatttaattaaattatgtaagtacagtaatcaatacactgacacagaatgtttgagtgtatacctaggtgagtcttggtttgtgtactgcacagcctgtaggagcagaagtgtgtggacctctgcaagaatagccgtctggctctgagcattctcccttccatgagcatcagcagtgatattttacagagggcaagaaaacatcagttaacacaagttggttaaatgtaggccagttaagagagtttgtaccctgtccagtaaaagaatctgctattccacagaccaaaacattttaaaccaaatttaaataaaagtttttagactaggattcaaattaatttcattatatgcataatatactgaagctgagagctcatccgtcctgaaaagtacttaggaagggaaagataaatttccagtataggctatcacatttttattcagctataaaactcccccaggacaatctatattccaacaatgagcagtagcatgataatctgatgtggtatcatactgaaggcagaactagggttatggggtaggatattaggaaggcaggtttcaggtcagtatccagaagagctttccagtaactaacaagagctagtcagcaaaaagctgccccagaaaatactggagtgcttcccgcggaggcatccaagaacaggtgggatacccactggcagaagagcacccacttccagcagggtattgccccagatgaacctttaaggtactttggaactctaatgtcctagggtttttatttctaaactttcttgcttcccacatatatattttttaggtctgccttaatgttttttactgcctgggcctttggccactaatttacattgctgtgcattgcctaaaagcatctgaaaaagaagtaactaaaaaatgtccataccaggccactcatcacatttaagaaggtatggatatgaaatatagtctgatgctattatttccttagtgcctgtgataattgctcaataaaaactttatgtctttgggcactctaagggaagcagtaaatatttaatcttggcaactgcagccttcagaccttacccacaaaatgctgttcttttccttgattggtgtacagaggaaattctgtggtaggaactgcatcttattcttaaaacagaaggtataatgaaaagaatacaatgaaaaatatatatatattataatccatacaggtattctccactttaagacaagcaaacaaaatcaggaagtataaagcatataggttggggtggttagttatattataaagtaattcttcactttactcaataatttatcataggatttctttaaatatcagttttcgctaatacagttcgctaatacatcttattcccacatcatgagctatatcctagacttctgcatttagaaaccaccttagtgattttccagctcaacttttttatttataggtaaagacactgaggcccagagaaacatctgaaatgtcattcttaaggttatatagctaatgaatggcagaattggtccaggaacccaactcaggatcttctcacttcaccatttctaattttagggctgaggacaacaagacatcaaattcttctcaaaattggcttttctcattttgtttttcattattaagataatacacattaatcatagaaaattggcaaatacaaaggtaaatttttaaaaagtctcctgcagtatcaccatccaatatctgtcaccatgttgacctctggactctgaaaggacatccatattcccctgtctcaacagaaccgttttccatttgaccttcagtgcactgaaatcaggccctctgacttttcatctaagtgagccgtcagtgagcttctatatggtaaactccttagtctcatcccagagtcgtcttctgaaacatttgacagtggtttttcatcttttcccccgtctttgccctgtgattgatttcatgacattactgttccctgcatcctcctgcatcttggactagtcttttcctgtctcattctcaggttcttcttctcctgtccattccttaaataataacatcccaggcagttacatgcttagctgtcaaattatttatgttattcccctgggatatttcatctgctttggagtcaaccattacttatatgacattgcctgctaagtaaatatcttctgcccccacctctgttgtgagtgtcatgctcctatttccagctgcctattggactttttcttccagggtgtcttgtaagcctctctggctgacagttattcaaacctaaattaatcaccatttcctctccttgtgtctatttatttatttatttatttttatttttgagatggagtcttgctctgtcacccaggctggagtgcagtggcgtgatcttggctcactgcaacctctacctcccgagttcaagtgattctcctgcctcagcctcctgggtagctgggattataggagcataccaccacgcccggctaatttttgtatttttagtagagacgggatttcaccatgttggtcaggctgatctcgaactcctgaccttgtgatccacctgcctcggccttccaaagtgctgcaattacaggcatgagccactgcacccaactctgtctatttattaattgctagacatcgatactagaaattctgaagtcatacttttttttgtctccccattcgtcatccaagcagtccatcataatatcctgccagttctacctccagggtgtccttcaaatctctccctgttgcggatgctacttccctgggtcagtctttcagcatcacttacctggatcattgcagtagcctcctaccttctctcctcgcctctctcatcaattcctgctccacactgctgccagagttaatgttttcaaaacatagatatcggtttaaatcgttcagtctttcaactgcttaccactgctttatagcatgaagtccaaatgcattagcagggcagcaataccctttatcttctgtaatgtaaatggattgtttagctttccgtcctacactcctcatacctacatccaagcccatgccctgctcatggttaccccaaacaattacgctttcccaagatgatgactttgccactactaactcttctgcctactgtgccctcccccttgtaagcctttcttttttttttttttttttttttttttgagacagagtcttgctccattgcgcaggctggagtgcagtggtgtgatcttggctcatcacaacctccaccttctgagttcaagtgattcttgtgcctctgcctccctagtagctaggattacaggcctgtgccaccatgcccacctaatttttgtatttttagtagagacagggttttgccatgttgaccagcctggtcttgaactactgacctcaagtgatctgcctgccttgtccttccaaagttctgggattacaggcgtgagccactgtgcccgtcttcttgttggcctttcctgaaatatctctcaagcctttttaaaagtctgcttgactgtcaccgagttgtcacacattccccaaatccccaagatggaattacaggattctgcctctctgctctcaacacgccttgcttttgtggctaacagtctctgcgtcttattctctctgcatccactgcaaaacagctcactgctgagcacggcgcctgatggatggtagacactcggtaactgttgaataaattgcctctccacattagaagcacatgtccctttcataacccatccctcccattcctagctacttctacagaataaaaataatttttcatttttttaaagatttaataggggcacacttaagtggggaaatgtctattcacacttccgtgtaggaagtgctgcttcagattgcttgagttaaattagaagaggttaaattaaaagaaaaaaagaacatctccccactgtcaaggaacacagaatacaactcatcttggtagttctgacaattgaactcaaatagcatccctgttcccttcctagagaggtacactacaggttttgtgcatgtacgcctttttttttttttttttgagactgagtctctctctgtcacccaggctggagtgcagtggcaccatcttgactcactgcaagctctgcctcccaggttcacaccattctcctgcctcagcctcccgagtagctgggactacaggctcccgccaccatgccctgctaattttgtttttgtatttttagtagagacggggtttcaccatgttagccaggatggtctcgatctcctgacctcgtgatcctcccacctcagcctcccaaagtgctgggattacaggagtgagccaccgcgctcggccgtgcatgtacacattttttaaaggcaggaagccacatgtgacaatcagtcaactgttatatttggcagagtctgttttttaaaatgtgtttagttaacctgttaaataaatttaacattgaaagacttataaaaattatttctgattggaaaaacaagacttttggtaggaaaaaaatattaaagaaagtaagaccacagtatttataatgcaaatattgtaaaaggccataaacctcctgaggtcgtattgtgtttttgtaatgaatctataccatatatgtaggtaaggctgaggaaaatacgttcatttgtttaaaaaaaaaatatctagtcaagtttcttcccacatccagcgatgacaatgagaaggtatcatctttttggtataaaagccaaactgcttttttaagattttctgcttgctatagatagtacctaaagtcatatctgagtttctgaaaagagatatcagtgttttaatgaactgacatatcaatcaaagtgacaaactaaaactatacacacacacacacacacacacacacacacacacacacacacacaccattgtatcttcatttatttttatttttttgagacaggatctcgctctgttgcccaggctggagtgtagtgtacgatcatggttcactgcagccttgacctgctgggcttaagtgatcctcccacctcagcctcctgagtagctaggattacaggcccacgccaccatgcacagctcgtttttaaaatttttttgtaggacgaggtctcactatgttgccgaggctggtctcgttttatcttcttaatactacaagatatactcacactgttgcattagaaatgcattttggatcctagaacttgctataaactaaacctgacgaggaatggtttgtacatttccttttaaacgtttccatacactttgtgtgtcactttggatgtgctttactcatgcatttatcctcgcaggccctcatgacgcccgagtgtcaggaatgttatgggtttgtgttgtgtgtcatctgcttgttcccccatctccatatgtgcttcctattctgactcatctcagtgtactattctctcgtttttctttctctgcagtacagctatcccttggtatttaagggggcttagttccagggcccccactgataccaaaatccacagatgctcaagtccctgatacaacacggcgtagtatttacatataacgtatgcacatcctcctgtatacattgaatcatctctagatgactcataatacataatactatataaatgacatgtaaattgttacactatactgttgttttatttgtattatttgtttttgtatgttttttattttttcaaatatttttgatctgcaattgattgaattcacagatgtgaatcccatggatacagagggctgggcccactgtactttatttggcttccaggagccccttcattcatccatttctgctcatttttcttccccctgcttttccactctagagtaatatccccgactttttcttctcctcaccctctcactgtcccaggctcattttctccaatctcttgtaatgccttcactagatgtcagctccaccaggcagccttccctgatagccttgtctacccatccctctgcagtgaggcctaggtgtgcgtgtgtgtcctgggagtgaagcctccagttcactccttaagacctctttaagagcaagaactatgtggagagatcctcttttaaagtgtttttatttttgtgcttttttttttctaaacttcactttgactgctttggcatgttttaccatctgaagttatccactttctgttaccgaacaccaggggtttggtctaggttctgcagctcactgcacagaaaaccaatcaccgagaccacaagtatttccaaggaagaaggctttaattgggtgctacagccaaggagatggtagctcagtctcagatccatctccctgatggactaaaactaggggtttatgtaacagggaagaaatgtaacaatgtgtaagaaaacaggagcaagggagggacagggaagcaatcgtgatgaatcaggggtcagcatctggttgtcaggatgtggtgatctggtgagtttcagttctttgatactttctttgagaggcctgaaagtcatttcctgagaaaggaactcagataaaacagatgttaagtttcaagctttaagatcagaaatgtctgccgggcgaggtgactcacgcctgtaatcccagcactttgggaggccgaggtgggtggatcacgaggtcaggagatcaagaccatcctggctaacatggtgaaaccctgtctctactaaaaatacaaaaaattcgccgggcatggtggcaggcgcctgtagtcccagctattcaggaggctgaggcaggagaatggtgtgaacccggatccactgcactccagcctgggcaacagagtgagtctgtctcaaaaaacaaaaaacaaaaaaccacatttctcattttccgagttcttgtgtgagaaaactcgaaacaaggcatatgaatttctaagttttccttgacatctccttgaaatattacagaattctttctcattaaaacattaatgcctgtagcatttttaaaataaaaaaggaaataaagtgtcctgggtaattctgctgaaagtaatttactgaacatcatcacacacacagagttttatccattgatctcttttcaggactataggcagcgtttctttgggggtaactatttactcatgtgtattagcagtgttactcttgggtcattgtaataattctgactgttaggaaaaggtacagagaagattagctcataaaaaccttcagaacacattgtaaatggaaagggagagcccatttaaaaagctcatgtccactttgaccaactacatgttgtagattttctcaccccaacagtaattcctaagattagacatgtatggggaaacactaaagatggaaacggccctacaagcaaatggcccacaccctctttaggctgatgaaccaagagagaaggagctcccagacagggcttggtataggtggtgccttcagctcaaacctactccttcctattcagagccaggggacatgattgcactatttgtggccttgttgctgaacccccagcagcagagattatctgcggccctcttcccatttatctcaaagatgaaaaaacacagagaataaagggcaaagcagaacaaacccatgctatgtgagataagaacctgagctccaaagaagggttttggggaaagtagtagacataggccacttggaaccgacattagttttctcttccgggaagtgaggatgctgtatttaccagcaccttctatctcatatagttaccctctggatcacatgaaaaggcctctgtaaaagttcctacagaaaaaaacatagaaaatgtccaaaaccgaactttcttgttgttaccggccacacctctagaataaaatatgaaaaacttgatctttttatgcaaatgtgaagccagcctcttcatgcaaattgaaaacttaatctgaaaatactgaaggaggagtaatatattttttagaagtctgtggcatgagatatgtagtacagctaatcttactcaaaatatctttaagaaaaagagtattcattttttagtgcttgccactttctatagctattgatttgaccttttaaaattagtttccaatatagaaaccctccacccctggcagcaatgaactaaactcatgtaggagtttctttaagaaattacattatcacatatttactgaccagagttttatcccaatagaaaaatgctctaggaagttaattacttaaagactaggaagatagggaaattgtagcttttcccagaatgacctttgtggactagtttttagaaaataatttgcatttctttccaaacagggtaagtcaagatgagggcttgactaaccctcagtttcagctgtataaacattgaactttcaaatgtcttagaaaataagaccaaaacttataacaaccagtgtaaaaaataattatagttacattattgattatttcccttatgggaaataatctctttctccaaaaaggcaaagattgttttatttcttagtttgtatgatgtgagtgtaacaaacattttagtaaacaaaacaatgtttaccatatatgtatttgtctatatatatgtgtgtgtgtttaaaatgcataaaattatatttaaatatatttcaaattttaaatttatatatatttataattttgacatgctttggactcgagaagcctatagtttctaattacctgtgagtataatcttcattgaggccttattacaaagtattccgttttgtaataaacaccatgacatacttacaactttgtacatgagggaaaaaaatctgaggcttcttttagcacaaaccatagaataaacccgattaccaaaaccctgttgcttttttgatttgtatttctcactattatttattaatagctagctacatttttggaccagctgaataaaataattgagcggaactggtagtagtaacaggctgacaatttattcaccatgttgagggagagattctaaaattttctatagggctcataattgatttaataacaatttaaaatacgtactcttagttttcctaagtaattccatgtctaagagcttggaggcccttctaacgaagatccgttccgttaagagtacgcaaagtgaatttcagtcctctgcacacttgaagcaagctagaccagatgagggaagtggcaggttttacccaatttcacacacaaggaaatgatttaaaaccacttcgtaaactgctgcatagaaatcagcatttgagtttttcctggacgcttgttctaggtttgcatttgtcatcagctattaatgctgacttacagtccaagctgaaatctgtcaaagacaaaataatcagagaattggccagaatcaactggatgagggatctttatattctcactgatgctctgtgttctgagaggagtatatatttcagaggtttgtttgctgctttgcttgcttttaatgccagaagaggaaagagaaagggcagtagcttttcggatagaattttatgagtttatattttagaaacacgtttactatttaatatattaataaaatttccattgtcaactaggccctgcaaaaataaacatataggaagctattgtaaaaataatttatttaatttccttgctaatataattatctactaacttcaaaacaaaggtaagtgtaagtatgtgtggacattaaactcttatcctcatcagtaaatgtcttccttttgaccttagagtttgagtcccaagaatctggaaatagtagagttctagtggcaatatttcattagaattaatctaagtaattattatgacagtagtcagcttcttatttgatgtggcattaaataaaaacagttaatacattcaaactggatcataggcagtaatttgaactccatagtatacaggagagaagggatgtgactactttccaagtctagtcacaaaatagtgatcattttttaaaagcacagacttgttcaaagatttcgtatctgattgaattcaatcaatttcattattatctgaaagtgggtggattttgttcttattgtttgtattctttcatatcgccttgttcgtgttttatcacacagagggttaagctgaatctgttagaatatgttttcctctaggacacagttgagctgggactagaacccagatttgaaattctaccctgaggcttagctggcactcattatgtcattcagtcatatatttgcaacaatttaagtagttagatttttcagtgatgaaaggttatttaataggctgcaggttacgacagtattttcctagttatcttctgtgcagtcttcagaaaagattgggagcatggttgattccaataactacctaagggttaaatattatgtgtgggctcagacccgtggtcaagtatttgggaaaatttttattgatttaagtaggtgttatagctcagtaacaaatggccctatgtttggcaagaaaaggagatatggaaactctactcacagccaaatctgcaagaataaaataattggttcacgtaaaaggaaatggttttgacagatttacactcttggggtatgttagaattccaccaaaactaaggattcaagtgcatttttatctcaaagtggaagaatctgacactgaaagtggaaagcattttctataaagcaaatgctattgacacggtcactctttcccccattgcattctctacttgttgtcttaggtagttctgatgtgtcctattgtcactctactttctctactccatttagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactggtaagaatccgcttagtggtagagtcacacttgtgtttggtcacatggtgtccctgggccttgaaatgataacactcattcccacagccaactcaaggcgacttaccttatagtgagtttcattcagggctagagccagcacctgcatcccatcttaatatgaatccttgaacttctcttcatcatcgtgtactttgacagtcaggttctttgtgatattttggcagaaagttaattcagttttattccactttaaaattaaaatcagtctttgttgctgacaatgatacagcattattcgtaactaaagcttgtgtattgaagctatgatttcgtgtaattgattcttactaaacctttaagatactatacatcacagtagtggaaaaataatagttataatttcaagtaaagcatgagtaagaaaatattagtgaacttggaggttttttaaattaaaaagtgtaagaaaacctatgaagtcattagatttctttgcacttaatccatcattttttgagattgtactaaatttatttgctggaattgccttaaagttactgagtctgagaaagcaaaactgaatttgaaacatgcattcatggaagatgttgaatcttttttttttttttgtctcttctaaaatcagctgagttcactgaaatgtgtcccaaagggaaaggttttgtgcctgctggagaatcatcttctgaagctggtggtgagaactataaaggtcagaatcaagtggaaacaaattttcagcacattgtgtacatgtcagatattcaagtgaaaacatggcttgggtttcacagaattagagttctttttagtcatgaaaactgattacaaagtccttaattctaccattaaaagaaagtccccatggacttgcagtcagaacacaaactgtatgatgctcggagtttgacattgggaggtgaacttctgagtttctgtctcttcatccctgagataggaataatttctcaaaggttataatgattaagatatatatctgaaagtacttaacaaattctgtacctagtagatacttactaaatattttattctagatgcttaatagaaatcatatcaattatgatcatataaatttgaccactgtttgtctttatggtcatcaacaaagctaaggttcttgtatttttagactttatcctactgttgtggggccttttaccagtgtgcacaagttcataatgagaaatggaagagaagacaaccaaagtagacatgttttatgtatttgatgctacggttatataattctaaaataaatgtgcggccttttaattttggtgaatatccacatgtatgaatatttcctcattaaccactcacttttgacattttcatgatagagatattaccttttatatacaaagtgattttttttcctttatagtttaatactgaggactgctaagtagctgggaaacacactgtaaaatcatttttattgtccatttttggaaaactagtgtttgaataatatggtataattcagtagctggataagaaattccatttgtgttcttttaaatacatctatgatttggtccaattaaataatgagaagatttggtttataatatgtgttgaatggtttccaaattcacaaatatacattactatgtttttgcagggatgtagttaaatctcacttcatattaaggtacagagctttgatttcaccataaattcatcttctcttttatatcaaaataaattccttgtcttcctattttagcagtgctgtaaatggttggaagaagattggattcagatccaaccagccatatgttctaggcttgactttgccattttccatctgtgttaactttaagcaagtcatctatggagtcttcaggttgtaaaatgaggactagatgaccttagctctaaaatgctagaactaatgctaataatagcagtaaaagcaatagataacacttttgagtatctgcttatgccagagcatataccgagtcctatccatggattatctcatttcatccttcctctcttattaggtagatgttcctattgtctccaatttatcattgagtaaactgagatagcaaaagctattaattctgtgggggaatgggtctgctaaccccctcagcaacttgtgctttcttttatcctcaagaaagacttgcattcaagttccaccaaactttattggaaactttctacatctcaactagtgaatgggccagaatatacattacagaacacatttcttaaaaggtatatatccttttgttgatgccactatggaaccatagaccatttcatcaaatatgaggtagcatctcagaaaccatatttacaaatacacttctcctataatgttttgggcattgcttctcaaatatcacagacaaactacatctgtttatgtttttatgcctgccaattaggccttattttaagaaggttatattgctgtttgtgtaggattctttggaatgtaaatattataatatctaacttaaagccccaaatctggttagactctttttaattgaaagatcaaacctaactcctttttgtatttctcaatttttttccccgtagatgcagatgaatgcctactttttggacaagaaatctgcaaaaatggtttctgtttgaacactcggcctgggtatgaatgctactgtaagcaagggacgtactatgatcctgtgaaactgcagtgctttggtaagctttagggggatatagtatggtgtactgtgaaaatatacagatggaaaaaataactatgctatgtagtaaaaacaatttccttgaatctaaatcatgtgttgaaaagatgtgtaaacgttttagggatctttttcttaagcacaattgaagaaaataaaaagaaaaaaccacctccatactactgtttgaatgtatttcaaacaaagagttaatattcactgtggaattatgattcaggccactggtataactgaagtgttcttttggtctgtggaacatcctgtttcatcactcataccgtgcaagtgacagccattttaaatactgacccagactttaatgcttaagcagaaaaccatatacactaggcagaaaaacatagcaaaaggaaataattttaaaagttatcataaagagccatttaatcttaaatttctaagcatatcctgttcatggatgttttctttccttatttaatgtcagcagcagcagcagcaatgttgtttttcagtcagagcagcttacatttttatagacagagccactctcttttggatgataatgtgtggttaattaaaatttggcagcacctggaatctggactaaatatagcaatgtgtaaagtttgggaagtgtatgaggtacaactgatggctgattttctttagtaatacttttttttgctcttaagatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacggtatgtttccaggagatgcaaacctgtgtccaaataactatcataagattttccttttaactaaaatgtgaactattggaaaatagaaaaatggattccttgggtattttgaaataactaaaatgagatacaatgagatacttacagaaatagtaataagatgcatatcatcagtatgtaggagatttaatagcctggacatactcattaagtatggactatggagtggctgagcagatggcagggttgttccatggcttagggttcatcatccctaacctgcagaggcagctgagggaaatgtaattcagggaaagataattaggtgcactcagcagagtggaggatgtggataaggctcagcagaacagagggtggagttcaacagggtggtggagagccccgaagtccactgacaaactcctgtcctccctgatgctactgataattggcaaaaagccgctgataattggcataatctgtcattcgcctcaggagactgctttggatgaagtcaattgaaaggtaggaattaaagactctaggatgaagggtcactagtccagggctttggcagattaaatggataagaaggcatgaatccaatagctgttacatggaaagaaatggtagggtttgacaggagtaaatgaaaaagtgaagattaggagagtgagaagcctgatggcttatgaaggacaagcaagatagtgggcattttatataaaagtaggaagctatagagaactattgtgtcgggaccggatgggcagctggaatttcaactgatggaatgacacccagttggagatgacagagaattgatccattgaaagaccagactggattcagacttttacttggaagtcactcttagaaatagagatggaaactttgagacttgctggcttccaacacagtgtttataaataggaataactgtgcgattttcatggaactatgtcttccctttcagaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcaggtgagcccatatccaattccttctgcaggaggcctttggggacaagttcatctcacctcctttgtagcctgacatttctcttctgtatctttgccttcactcctgatatcttactttcatcccgtgtgtgtgtgtgtgtgtgtgtgtagggcagaactgcataaacatttggctcctggtttacctctactcccgaccctgtcgttaatttttgaaactctcattccattaccccaatgaatgataaatgacccaaaaaaacataacttagcaatcagtggcataggcttagaatttatatttcctggcagttcattttttactacaattcttctcattcctaacagtttctacttagaccaaaatgtgtattagagacggtagaaaatcattctaggtcaaagtccaaattttcatgtcaatctctgtatgtggagatataagaaacgggttacaacaaaaagggaaaagtacagaaagtaattgaagaagtatttcaacaaatctcctttcctttcaagttctagatctatctgggtttaaacctttggtcaaatggaaaagatgagacaggctaagctcccagtttcatcccctctcccagtttggaggaggcctggaaggtgctggctttgtgcttcctggctaggctgtttggtgaccgttgagttgtgcactgattgctaatttcccttttttaccatcatagcaccttctcattaaaggaaagcactcgaaagtgtccagtatatccttttgtaaagttgacttgttaaagctagaaagatcatgtgcaagtagaaagcaaaggagtttattatgaatatattctcagaatggtcgagaggggaaaaattgcttgaaaagaggaaatgcattaatttttagttaattcaattagaatatttctttcaagctctttagaaaattagctttgcagcttagaaataacttaaaaccaacgtagcatgaaagagaaaataattgggaattcccgtaagaagaaaatgaatagccaaggataaagagcaaatacacaaagcactagatggcaatgatagcagcccagaattggaaagagggcaggtctggggccagttggcactgagtctggaatccagcactgccatagcagctgcatgacaaggggaaaataacttcaccctgtacagctcatttgtaaaacggaggcgtctacatctgtcctgttgggttgttgcaagggctgggaggatgtaggtagagcagggggtaattactagctttactggttgtttcgggccctggaagcagatgccacggggagataaaagtgaaatcactaagttaatgtgagttcagtgaggcttttgagtcattttctcacaatgctatactacctcaaatcttttttatttatgcagtggttttatattgtctaatttttttccaaaaatcacatgtattcctcctaaagtattaaaataatcaaagaggttatattcccctccacctaccccatcacagttgaactctgctccttaaagacactcacttttgacagttgggtttttatcatcctagcattttcttatatattaattatcattatatattgatattagttattgctgtatattaatatatttatatccaacagagtatttataactgaagtctatgtcatcaatctaagctacactttgcttgttattttgcacttcagcatccctgagattggggtcatctgataattatgacatataacaatgtccacgggttatttttcccaatttttaacatctgttatatcaagatacattttacaatctaggatctcttaaaatagatgaaagttagaacttaaaatttttttatattgatatatttaggggtgcaagtgtagatttcttacctgcaagtattccatagtggtaaataaagtctgtgttttttgtgtacccttaacaatagcgaacactgtgcccaataggtaatttttcaacccttaccccacttccagactcccacattttggagtctccagtgtgtattactccattccatatgtccatgtgtacccattgtttagctaccatttataagtgagaacgttcagtatttgactttctgcttctgagtaatttcaattaggatagtgacctccagttccgcccatgttgctgtaaaacacacgattttattcttggttacggcttagtggtattacatggataaagaaattttcttactgaggcattcctacaggtgcatatgtggaggttcattgcagcattgtttataaaaggaaaatcaggactggggcaagatggggcagggaaaggttaggggaggaagaaaaacaaatgcccagcacaagagatggctaaataaatcatgtacatctataaaacagattccatgcagctgtttaaaaattaccatcttttggccgtgcgcggtggctcatgcctgtaatcacagcactttgggaggccgaggcgggcggatcatgaggtcaggaaagatcaagaccatactggctaacacagtgaaaccctgtctctactaaaaaatagccgggcctggtggcgcatgcctgtaatctcagctactcaggaggctgaggcaggagaatagcttgaacctgggaggtggaggttgcagtgagccgagatcgcgccactgcactccagcctgggcgacagagcgagactctgtctcaaaaaaaaaaagaagttacatcatttgaatttaaattagtacagcctttatggaaaacagtatggagatttctcaaagaactaaaaatagaactacccggcgatcccactaactgggtacctacccaaagggaatgtctttatccattcctccattggtggatacttaggttgattctatctctttgctgttgtgagtagtgctacagtaaacacacaaatgcaggtatcttttggatataatgacttcattccctttgggtaggtacccataaacaatgctgcaatgaacctccatgtatgcgtctgcaggaatggcttagtaagaaaattttgacaaataaaaataccaggctaagtgtgtacactttaaatttatgatattattctggctggcaccatggcttacgcctgtagtcccagcatgttgggaggccgaggtgggtggattgcctgagctcgggagtttgagaccagcctgggcaacgtggtgaaaccccatctctacaaaacatacaaaaattagctgagcgtggtggtacacacctgtagtcctagctacttgggaggttgaggtgggaggatggcttcagcccgggaggcagaggttgcagtgggccaagatcgcaccactgcactccatcctgggcagcagagccagaccctgtctcaaatagataaataaaattatacccccaaaatactgtaaaaatttacactcaatttaattgactaggtttaaaaaccttcaagtattttgttatgagaaatgaatttttgaataatgtagcaatattctaaaaatgaattttattttaaatatttattctaaaaatatggatttcagaatattgcataaattgttttcaactaaagttttcaaaaaacattttaaaaagtagattagaacaaatacatatgaagtacatattatataatatttttggaaaaatacagaatatcaggggaaaaaagataacacatgccaaatttaaaaaaaaaagattagcttcattgctatactgtttctagtttgtatatccacagttattatgataaaatgtccaagaagaatctctagtgtacatggtcagccaaaccaaaatcagtgctttccaatccgttactttttaaaaaacaatggtagtttttttgttaactgtattgtaattttaacctccagcatacacattcattgacattaaagatgctgggtgggctggttggcgagaacaactacttaggctcttgaggcccctgtgaaggaccccagggttccaggaaacgcatgttgaaaactgctttcgaaatatatctgttggagtatataggaattagggaggtagccccaaaggaactttttttattttttgacagagtctcgctctgtcacccaggctgaagtgcagtggcgggatctcagctcagcgcaacctccacctcccaggttcaagagattctcccacctattacaggcgcgcaccaccacacacacaaaaataattttttgtatttggtagacacaggggaacttttcttttatactaccaaaattacggacctagaactaggcttatggatcatctattctgaatccagagagaagtacacagtgaaattaaacttttccacaggtcctatgattagttggcattcccttcattggcacctaatcatgtagtcacatttacacaaaaccatctcttgttgcaaagcacatgtttgctggagtggagtgaactaagaggagccccagggcatcagggttagcacatgtgccccagaaccaggttgccctgcctttgcatcctggtttggcaacttcttttccccatgaccttgttaattttctctctctgtacctcagtttctcatgtgaaaataatatctgcctttcagggtggttgtgagaattaaataatacgtgaacacttcaaatagtgtttgacacatggtaagttttcagaagatactaacaactatggctgccactaataggcgtctcagatcaaatgcattttcaaatgtaattaaaatccaaaggatcttataaaatctacagttacctaatagcatgtgaacataaattaagcgtagacaaatgcagaaataattgttcttaatgtaagactgtcttttctagaccactgcttcgtaaacattaatgggcatgtcagttacctgggggagcttatcaaaaaacagattctggtttctcacttgcaaaagatggggcggggcgcgagacacaggattctgcatttctgataagtcccaagctgctgctgctgctgctgcttcctctgaggaggaagcaaagctctagagccatctaatagcatctaactttattttgttaaaacctacgttaatgctggtagttatctatcataaaggaagcaaagaatatgtgaattttaaaactagtttgttcatagtttctgccattgaaccttttaaatatactgttcccggatatcttaatcgttgagaaggaccacgttgtctatctcttcatctaagcactggactaatcccagcctgtcagacatcatgcatcccattttccttaggagtgcagtactgctttggggaacaattcgttactgatggaatcagtgctggaggaatttaaggaataaatcgcaccacttgtcatcagctttaagcattaaagtgcagtgtaaaataaagctttggctccagagcgagctttcacacttctggtccaacaggtcacgggcactaattcttgctaaagcagcaactacatctgagagtactggtaggtgcaggaggtaggagtggctgcttaaatagtgttctctgaagttagatggcatcttgcatattggtaccacatgcaggggaaatgagtgtgatggattgtgtcaggggagctttacataaggagaattgcataattgtagaattcatacatttctggggctgcttaggatcccatttcaatgctccactacagaggccagaccgcagactgcactaggaggaagttcctgatttttccttcaccatggatgtatcatggactgactgtctccccattcagacttctggaggccttccttgccccattgcagcccctgactcctcttctccttcccctttcacagtacccgctgatcctgcccactcttaaaatgatttgggtggctaaactgttttgggaggatcctcaaatttgtggtctttattgtgatgtcatgtcagcctctgagagacagagctgtttgggaaaccaagtcaggaaaaacgagccattgtatccatttcataaatgaagacagagtggtcattgtttgatcttgctgagaatttctagcgctgtgagagaagaaagtcatagagttatcagaactttgaggcctttggttgcatatggagtttattggatatagattttttgttgcttggtttttctcagtctaagtgataataaaaatgataactaacatatacatagcacaatgcctggcattttcaacatgttttccatctactgagatatttaacttgccaagccatcttaggtatacagttacagtagtcctctgccttatctggtttcagttacccacagtcaaccacggtccgaaatattaaggggaaaattccaaaaataaacaactcataagttttaaattgcatgcagttctgagtagtgtgatgaaatctggtggtgtcccacccagcacgtggaccatccctttgtccatggtgtccatactgtgtatgctacttgcccattagtcacttagtagcagctccattatctgatagaaatcgatcgtatatataaggttgagtactacctgcagtttaaggcatccactgggggtcttggaacatatccctagtggataagggagaatactacccctcctttttctgacagaggatctgaggcacagcaagcttaagatgcctgtcagtggtcacgtaccagtaagtggaagcttcaaatccaggcacccttgctccagaatctacgttctaacctcttcagtgttactcgagtctctttccatgatcccaaagcacatcttaaatagtctcccttagaacagaaaagtaacaaagtgaagaattaaagctgagattttaaaattgtctcacacattgtgtgctaaaagaaaaactgattttagagctaacaatgagcataataagaggcaatgtgtcatcaaatctgtagccacagacacattggcaggaataacaaaaaactatatattcaatggactaatgaactaaagcaagtcaataattctcagtaaataaaacttttagtgatgcctatcacttaatctaaaatgattttttaatgtttttattttttgctactcttaaaagtataagcttaatcaccgggtgtggtggctcacacctgtaatcccagcactttgggaggcagaggtgggcagatcacttaaggtcaggagtttgagactggcctggccaacgtggtgaaaccccatctctactaaattagccaggcatggtggcgcatgcctgcaatcctagctactctggagactgaggcacaagaattgcttgaacccaggaggcggaggttgcagtgagcgaagatcgtgccactgcactctagtttggacaacagagcaagacttcatctgaaaaaagataacataagcttaaatgttctggaaaatgtacgtaagaatcacaagatagagggtgccattatctcatggaaatcaaaatccgttgatctgcaaatgaaagaaaattatacatatttgaacatttgaatcttaagtacccagggatcccagtgtctttttatattgttaaaataattagatttctgataagtaaattgttaaagtaattagacattgtaagtaaacggaacaaagacttgataaacgggacaactagtgtgttgggagaatgccacctattggcgatgtaatgtactacagcacaggtaatttcttgactactcaggtgtagaaagatggttttaaaacatgaggtcccaaaggaaacagaaggtgccacaaaataaattgaaaaatgttaacaaagtttaatgaaacacgaacattgatcaacatacagaggcatggtcctctcagtgttgctaagagagcagtttgaagagacagacttacacatctgaatcaaaaattctagttctgggactgatgaaagagcaaatggattttgtttaatgcctattgaataaaagaataaagcacaaaggcatgatgtgaataggcacttagtgaggatctgttgagtcaaagcaatgtcagtatgtatccaacttcctttgagaaaggtagactgtgctataggggaatagaagatatttgtcagttattcatactcctttaaataatgctaggaagaattatcattactgtatataaattatatacagcttgtggtttataagaagagataagtaaatgatctgaaatgaaatctaaattatttataacttacctgttttcagttttagttaaattacttacatgttctttattttattatttattgaatgcctactatgtactaggcaaacaattctggaacaggtgtaaagttgtatttaatgaaatgcataattagtataatttattcctaaatattatgtattttaaatctgcaaatgatactttaataaattcaccatttgctgtgacagaaaatttttcaatccttcctaatatctaacctacccaagtattcatatcattttgcaaaagtaaagaatttggaatgtcttcaaacaattcggctagtgatttcttccatatctgtgcatggctcttagacgctcccaaagatctcagggcaagaagtttcgtaatgcccttggaggtgtgaaggaagacagggatttgactcatggactaaacttgaaaaaatattgtaactgggccatagttgcaaaaggcctgtcagcagtcacggtttaaaggcttttccaagaaatatgtttccaaagaatgttaataatcactttggaacaccctacttgtgaaacaatgagtggtcactgcctttggtttaggcaatccagggatctctttctgcttttggtcctggctctgtgacattgcactgggcacattacttcaacctcctttatccaaagttgagacctcttcgtgaggttatgataattaatacaatcactatgaaagcatttatcatttcaatcatagatcctgaacattataattaaagaaacaataaccgctagtcacttacaatggaaaattaaaatcaaactagaaagatacaaaaggaaatcgagtggccgtcatgcgggcacagagaatatctataaaacaggcaagcgttccagttctgtgggactgaactcttggtatccatggaactagattgaatggatgttatatgaaatggccagtaagccagttatgttgttcctcattgaaaggactcttggcccggcacagtggctcacgcctgtaacctcagcacttgggaggccaaggtgggcagattctgaggtcaggagttcgagaccagcctggccaatatggtgaaacctcatctctactaaaaatacaaaaattacctgggtgtggtggcgtgtgcctctagtcccagctactctggaggctgaggcagaagaatcgcttgaacccgggaggtggctgttgcagtgagccaagattgtgccactgcactgcagcctgggcaacagagcaagactccttcccaaaaaagaaaaaagaaaggactcctgtatttatttagaaagctttctctcacccctcccaaagaaaggttgaaaatacttttactactctcaaaagattattgcaaaataaaattcattagtgaattcaaactgaaagtagctctttgatgtaatgtgatccgtatgttaatttcctcacttgaaatcctagtgatttcttccatatccatgcatggctcttacatgctcaagagggttaaatgtgataatgcatgggagaggattggcctacagtaaatgcgccatagcgaaaggcgttagcaattattatgaatcaaatccagttctaggaaatgagtcaacgttcatcatgcactgctccctggttatccagtgctagaagtctctttgaaaggggccaagaatcaaagacaatgagggataggagggtgttcagggaattgcacagacccgaatacccctgtgtacttgcagagaagctccacctgtgcccggccaggctcctacagtgtaagttaggaagtcaaagagaggctttatgcacacaaaggaccattatgttgagttgtttgtttgtttgtttgtttattttgagacggagtctcgctctgtcgcccaggctggagtgcagtggcacgatctcggctcactgcaagctctgcctcccaggttcacgccattctcctgcctcagcctcctgagtagctgggaccacaggcgcccgccaccatgcccggctaatttttttgtatttttttttttttttttttagtagagacggggtttcaccatgttagccagggtggcctcaatctcctgacctcgtgatctgcccgcctcggcctcccaaagtgctgggattacaggtgtcagccactgcgcccggcctatgttgggttttaatgaacattcaatgtactcaatttttaaatgttaaaacctagatattcctaagaatttgatttcaactttcacattttatcatcctatttataagtccaataaccttctataaaataagatcaattttatttgttgactgtttatatgtctcaaagaacggattaaacttaaaagttatttctacatataaattctattaattaaaattttgaacactttggtctccatctcacaatcctaataagcatttcctcataaatatttaattagctcttataagtctaataaaccaaacttaaaacacaacaaattgaattccctaataaatttaaataatgtttaccaacctaatcaaattctcctaatcctcattcaacttaaaatccaaaatctaaattcagttttgagttgaagttgcaaggcctgtcaggttctctgatgatatgattctcttaggcactaacacatgtacaataacaagaaaaagccctcaccctaagacgtgtcacagaaagtgttaacattctaagcttaattaacttcattatttctgtagcagaattactgtgttaggccagctgaggttagtggctgaaaaaattcaggaccctgattgccagttggaaatgagagaatgaaaaccaggacttgggacctgcatcctctcagtaatgagtctgccctgcccaccataggatgcggagcaccttcttgcttccgtgctaacgggatcccaggtgtttctcatgtgtgtttttttataatcagtatcttccattgcagtgactttcaagggaataataggacagaaaaaataaataggaccttttatccaactatacatgccctcccgtaggaatcagataccttctcctaaggggatatcctcaccccactgagattccctagtagatcaatagctgccagcaggatggggcttttatggatggtcagggcctcctttactaaactggggaagaggtactggatttgtgaaaggggccaaataagcaggaatgaatggcagagaagccaggtacaaaaagcagggacagtacgtacataagaggaaaaatactagatgctaaattgtgtgtttttaaaaaataaccatgtttgggcaggtgcattggaaggaaagaaagcaatgggcaaggaagccacattccagttatgatcctattgtagtcattgaaagcagaagaaaagcaaacatggtttgccgcaaggtgagaatagttaaaataaaatttttaaaaaccctgatagaggggaaaacttactccttcatttcttgctaaactgctgaagacagagctctggaggagtgtcctggaacaagctgccattcccaaaccccaaatccctggattgcgggtgagtcagcaagtatttggaacgccgaccagggaggaccagtggaccttgctagactgcactgtagcatgaactctctgttttgaaagctgattgaagctactgcctcagtgtcctcaccagccattagagaacagttcaaggcgagagaagtttgattaatgggttactcgttggtgacatgagcacttctgaaattttacttcttgtacagcttgagccttggagtgtcagttgtattcatggcacttttcctaagagctatactgcatggaagtgctagggaaagtatttggccactctctgttataaaaaatactctgaatagaaaataaatttcattatgataataatcttactgatgtcctattaaaatctttctagtttgagcgaaaggagagaaattcaggcatgcatgtaaacaatctgatcctaaaaagcaacacttatttttagttaacaagtgtatcagtctgtttttacactgctataaagatactacctgagatgggtaatttataaagaacagttcttcatggctggggaggcctcaggagacttataattgtggcagaaggcaaagccagacacttcttacctggcgacaggacagaaggagagaaagagcgaggaagtgccacacttgaaaccatcaactctcctgagaactccctcactatcatgagaacagcgtgggggaaactgccccatgatccagtcacctcccaccaggtcgggattacaattcaagatgagatttgggtggggacacaaagtcaaaccatatcaacaagcaatcatatttatctcaaaagtaaaagtcttagcagttttacctttctcctgtgaaatcagagattatgaataggcattccgttttctagaatcgcccattcagtatgatactaaatgatttggtctagtgaacattttactttcatatatatatatatgtgtgtgtgtgtgtgtgtgtgtgtgtgtgtgtgtgttttgtttgtttgtttgttttggagacagagtctcgctctgttgcccaggctggagtgcactggcacgatctcggctcactgaaacttctgcctcctgggttcaagcgattcacctgccacagcctcccgagtagctgggactacaggctcacaccaccacacctggctaatattttttattattattttagtagaaatggggtttcaccatgttgcccaggctggtttcaaactcctgagctcaggcaatccacccgcctcagcctcccaaagtgctaggattacaggcgtgagtcaccacgcccagcatactttcacatcttttaaataaaatttgctcttctttttttccttttgaaaatagggctagttgaagcatactctaagaagcatgaactgtgatgagtctgactttgagaaaatcactgtgcataattgcttaagcactgttctaagtttgaggttttgaattcaactaacgtttgaatttcttttgacctcttcttaacgaacctaataatacaactatggctagaacaaagctgctgactgcccatgtctgttaaacagtgacctcatggccagagcaggcaagccgggcagaggagggatgaagtaaattttattctccttttatgccgcagacagattgtgccccttatgattgggagaaaaacatctagaaagttcttagaatgaccaggttcttgtatttacaaatctgcagggagcagaagctagaaagtaattgttctgctaagcatcagtagccactaccttaagaaagaagcagattacaaaacattagctcattgggagggcttctgacacaacaaagccttctttatgcttccttctgggcttcaagtctcagtggcaggctgagctgttttgagcagttgtgctgattgtacactgctcatttcaagaaaatactaggttggtgcaaaagtaatttcagtttttgccattgctttttttttttttttttttttttctttttccaagacagagtctcattctgttgcccaggctggagtgcagtggtgcaatcttggctcactgcaagctccgcctcccaggttcaagcaattctcctgcctcagcctcctgaggagctgggactacaggtgcctgccaccatgcccagctaattttttgtatttttattagagagagggttttaccttgttagccaggatggtctcaatctcctgacgttgtgatccacccacctcggcctcccaaagtgctgggattcataggcatgagccaccgtgcccggccctgccattacttttaatgcattcatgtggtaatctgtgagccccttccaaagaaatcactgccagaggcagaagttgctaggactgtatctgatagtgaacagatccagaggggaaggaaagaggagggtcatctcagattgaagtaaatggcagaatacaaagaaatcataaaacagaatcaggatttcaagatagtccatcttttactttgcagtgatgtcttacttcctgttattgaatgaaatacattttcatgactagtcattgactatgtttagtgttattttcatattacattgattagaacttgctcttccaataatgttaatggatagtggtatatctttgttattcagaaccttgagatctgaacttctgaatattaagagagttttaaatattagaagagctttctctgctatgaagctttaaaaaaataagcaagattaaaatacgttaaaacacaattttctttataatttaatagcttattacttttagtaaaagaaaacaaaatttatcctggcttgacctttggaatatcataaaatttctgtaaacttcagtttcctcagcaaaataatacatgggaagattagatgtccacgcttacagtttgttaaattacatgtttgtcatcattctgaaaaatatctagatgggcaccacctgcaggtaacagcgtcatctagtggtgattaccttatattacagccacaggtttcaaagacaaattgtctttccaagagttttgcagcccatgataagaatgttttctgctcaggccagatgcagtggctcacacctgtaatcccagcactttgggaggtcaaagcgggtggatcacctgaggtcaggagtttgagaccagcctggccaacgtggtgaaactctgtttctactaaaaaaatacaaaaaaaaaaaaaaaattagctgggcgtgatggcacacgccttctgaggcaggagaatcacttgaacccaggaagcagaggctgctgtgagctgagatcacgccattgaactctagcttgggggacaagagtgaaactccgtctttaaaaaaaaaagaatgttttctgtttaaaatcatagaatatgcaagctagaaaggaccttcgagatcatctagtcttattgcctcattttgccagttaaagttagttgaattccagagttaacatattaaatattttcccctcctgtattttttgtttctcttgactttttaaaaattgcagtgaacttcacagaacatgaaattaagcactctaaagtgaacaatttagtggcatttactacgttgacgatgtaatgcaacctcccctttattcttaagcacatgcttagttcctgtttttaaacaattcttacttggttaatgaagaaaaaaagttctttgtatgtataacttaaaaaaaaaatttcagcttgtcagattgttgcttcagagtggtatttaaagagcaggaaaggggaaatgaagtggtttacctgtccttgcagctgaaaaaatatgaagtagatcagtttggaaatttaacatgctgaacactcttttcatttgcctctttgtttattgtgttgttcagtcttgtctcttatcaattttagaagcctcattcctgatttcctatgaaattgcttggatgtaagacttaatatatttcctatgccccagatacattggcaatcattattttaaggttattgtgtgtggcataatttaatactattacagtagtataaatgtttggatccaggttttaaaatgcaaaggaaccactatttttttggcatttctacccaacaaatctcttttttcattttgtcttgctaaataaacagcagtctgttgggaaactctgggagtaactaaaatgaggagggtaacattaggtgaaggttgggagtggggagaacgtggttggtctatggcccgtgagtctccttagagtattaacatttacaggagtcccacagaatataaaccttgccaagactttagacttcattacttccctgtcctcgacaagtacaatttaattgaacattaagcaatttgatctctttcacctaataaatcgagcaaattcaataaacataaatcctgctaatgatggagctgcccctggtggagctgagctcatcagcattcatggttattactctccctggaattttagtcacaaatgcttattgctgaactaagtgcttacctgatgcttaaggtctagggagtgtatttaataatttttttcccagggtttcaaaaggacagctggggagtagaaagaacatggtttggcagatagaccactttgggttcaaatccctcacctgaccttgggcaaggcaagttatgctattaaaaagtgtagttttcttattggaaacaaaaggagctaattacaattatttcatagagttctgagttttaaatgaaacagtgtatgcaaaagtagtgtctggtgcgtaggaacttaatagtgcgtgttagctaactctcttgtttttaattgttcagtagcctgcatctacagcagttagcgccctactgcttcttttttttttttttttttttttttttttttttttttttgagacagagtctcgctctgttgcccaggctggagtgcagtggtgcgatctcggttcactgcaacctccacctcccgagttcaagcaattctcctgtctcagcctcccaggtagctgggactacaggtgcacgccaccacgcctggctaatttttgtatttttggtagagacggggtttcaccatattgttcaggctgctctcgaactcctgactgtaggtgatccacccgcctcgggctcccaaagtgctgggattataggcgtgagccacggtgcccagtctagcttccctaatgctttcttatctattatacatgcttatgactctctctgagttaccttccttcctcttctacctggttaacctcctggctacagatggtgttttcaagctgaagcctttcccagctcttccaggatgactttagtcatcgtctctgtgatcctgataagttattgcatgtgccctgattgactatcatcacatctttccgtactctcaggtcccaccctgtccgtaatgaagcaatgaatgaatcacttttaatagagctaaggcaaagagtaccttaattccgtgcaataaatggagaaactaaggctaaaagaaccgtgtccagaccaagaaactaggaagtggagaaacaaggactagaacccaagtctttggattccaggtgtttgcagtgtatccagttttgcatcacaacaccacatattttagttttagggaaggagggttgctgcctgttcaccagagactgtaagcagtaatgtattccgggataaagagcaggacagacacccaggcagacatccagtctcacagtattgtggcaatacccaaggaggtctctcttccacctttctttactggtacagagtggaatgttctgtaaatggccaccgtttttctaatttcataacttttactaatttcatttaaagaaaagtgcccattggctgggcgcagtggctcacgcctgtaatcccagcactttgggaggccgaggcaggcagatcacgaggtcaggagctcaagaccagcctggccaacatactgaaaccccgtctctactaaaaatataaaattagccgggcatggtggcgcacatctgtagtcccagctactcgggaggctgaggcaggagaatcactcgaatctgggaggtggagattgcagtgaaccgagattgcgccactgcactccatcctgggtgacagagcgagactccgtctcaggggaataaaaaagtgtctattacaatgctggcttatcagtcactggaggagacagtcatttcattctctttatctcctccctctgtttcctagttgtgtgttttaaacaccattgtcgttaatccatgtttaaacctgtaagaaaaatacctggtctagaaattgtagtagcatgtgacccacttttctgcttctttttctcttttttttcttttctttctttttttagatagggtctcactctgctcaggctggagtgcagtggcacaatcacagctcactgcagcctggacttatctgggctcagatgatcctctagcctcagtgtgccgctatgcccagctaatttttgaatatttttttgtggagacagagtttcaccatgttgcccaggctggtctcaaactcctgggctcaagtgatctgcccacctcagcctcccaaagtgctgggattacaggcgtgagccactgcgcccagccctgacctgtttttcttaatgcatgaaaattggtccttgtttctcttatatttgaaaataacacagttcaaacttcagagcgttgcatttttagccctgatgtgtgcaaaacgaaattgcaacctctctaccatttctaaaaacagctgaatttaatttgcctcagtcagaactaaaactttacctcctggtctcctcacatgccagggtagcattgtgacatgtgactgtccagactgccctgcacatgtgtctgtcatcaagaatggagatttcttatagtaaggatatggtaatgttccttccattgctgccaacagcaggggccccacacccacaggctccaggggataatttttaaaccttttcttttttcaatttaagatgaaaagcaacagcatttgtcatatgaatcagccatgccagggaaattaatgtgatcaatggcctggatcttgtttagactacttagcgacggcgtcccatagcatcccttatgtatctttcatagctttgatcaagagctaagcatttgcgcttggggcatggggaatgcagtgggtcggggagggtctttgaggtgtgactgtttccatttcctgttcatttcacattggtatttggctagattccagatggacacattgtatggggtctcaaatgggattgcctccaaagtgcacctctcagggcaagccctgctaagcaaaaacttttcctttgcaccgagccccagacaaggaggtgactattgttcttgatgcacagaagtcaagggtgttttggagaaagagaaagattctaaggacagaaaatgtgttcatctccacatgttgagctggataaagtagcagccaagagtttcttgtgggaagttatggaaatagtttagggatctgctattcttgggctctgtactctcagccaaccacagttcatgcagttccccaagctggactgtagcagtgacctagtcatcgagataaccaaggccaagcacctccaagctgtaatgggttctgcttgtggcttggggtgcccagaggcccagcacatgctagaaatttgcctgtaccgagatcctaaagaggatgacttgcccaagtcctgatatttccattgctttcctgaaagatggtgaaatccacttctataaacctattctcttctgttaacttattctctatgtaagacatttctgatttaggcctatattaaaaattcttggacatcagtttttcccctgtactttgagttctgatgatctaatgttaaaatgtactattgttcatactttatcactgcacaaccaagtaatgaaatttaccaaggcagtcaacagttttgtgccttgtttgagaggaagtctaggaagacttctctatttactgagctagtttccctctacctatttaaaaactccaaatagtcttgaaacaagatttaaaaacacctgtggaccgttcttccattgctctttactgcacaattatttgcctgttgatcactgcttttacgttttgttaacattaaaatgtaaatcactcactcattataatactgtctttaaaaaaaacttcatttatttccaaatgttcactagggacttagtgatgtcacccacaggaaaaaattggattctccattttcttgatgcttcaaatttttaaaatagtttcacaacattatctcatttttttacatatcagtaacacagatgtagtcaaacaagaattcttgttcctgtgttacagatgtggaaactgaggcttgcccaaaactgctaagctgggaagtaagtggtgcagtcaggacttgagcctcagcttccacctctgaagcccatgttcttcccattaccccacgatcctggccaagaatcagggcagatgtgcatgatgggaagggcggcgtggatggattaggacagacctgtgcaggctcccagaaaaataattcaaaatacatttcctggtgatgacgggactttagcacatcttcagatacagaagagaagacatggtgcagaaaggatgttttgatcactgaccaaaactgtcttggagcttggaatgtgaatgtgttagagaaaagtgaagcagcaaagggcaacacgctctagcattttaagaggaaaaaacgcatggcaggggaagaaaggaaaggaaggaggatgtggaatatcccagaagtacctcccccaacccattaccctccactgcccgcttccctagccttggtctagtcagaagacttctttaggaaccatttggtagttccaaaaaacaacttagttttctttcttgatgcctttgggtacgtgcttttaaaaactaatccaaaattctgcaacataattcctacatacctacttagtttcagttcaggtccaccttttgcagggagctgttcctaaacattgcataggaacaggagcctgcccttcctcttcaccctcaccttcagtcctttcctctggcgttgctgtagagtgacagcttagagactcaagcccatctcatttctttggtggaggaagcatgtctaggggagtgcactggattgaaggtggctgccctggccagcccctgatcatggcattcgacatccccggacctcaagtctcagcaaggcttctctgacagccaacaggcatcagcaggatgctcagccatctctggatttcactttataaaataagtaccttggccaagcacggcagctcgcacctgtaatcccagcacttagggaggccaaggtgataggatcgcttgagcctagaagttgagaccagcttgggcaacattgtgagaccctgtctctacaaaaaataacaaaaattagccaggtttggtagctcatgcctgtagttccaactactcaggaggctgaggtgaaaggatcgcttgagcccaggagtttgaggctgcagtgaaccacgataccacaatggtgccactgcattccagcatgggtggcagagcaagacccttttttttttttttttttttttgagacggagtctcgctctatcacccaggctggagtgcagtggtgcaatttcggctcactgcaacctctgcctcctaggttcaagcgattctcctgcctcagcctcctgagtagctgggactataggtacgtgccaccatgcccagctaattttgtatttttagtagagacagggtttcaccatgttggccaggatagtctccatctcttgatctcgtgatccacccaccttgacctgcgtcatgagccaccatgcccggccgacagtttctttaaaaataagtaccagaattaattcatttttaacatctcctctagatcacaactgtggcttcaatataaaatatggaacaagtctgtctttcagatgtacaacaaatgtatataaaaaataatgggagaagatgacctcagctcttgaaacttgtaaacatttcagcaatcttgctctcgcaaagaaatccttaattctgcgttttcaaactttaagcagaactgacagccatttgtgctctctctgtttgaagtagttcttttcttttgagtcaagaatctttttccaggttcggctatttccttaatgaaattaatatttcacacagaatggtttcatgcaaaagtgctgggacgcctggagtctggatgttgttcctggaatgcttccacataaggagaattttagacaggggcagccagaatcctaccctatccagtggttcaaggtcttttctggcctcacgcttgctttgggcagttctcagaatgtgtgtgtgcacgtgtgcacatgcatacacacacacctttgattcgtcaccctcattcctccagtcatttaagtaggagctgataaaagaaagccttcagggttcacagtattgccttggtggggttttttttttttgtatgttgcaagaataaacacaataggggaaaattccaggcaaacgtggccattgccttgcgcgacaatagaggaaaattccaggcaagtgtggccattgccttgcatgacaatagaggaaaattctaggcaagtgtggccattgccttgtgtgactgccccactcatgtccatctggtcctggggcctgtagcctgcctgcacctcacagtcctaacagagctgttgacatccgtggagccccagaatttcaccaactgctagatgtatctttgggaagtgtattttgtggaacatactcagaacatgaggctgtcctttctacagctttcctccctagaccttctcaataactctgttcttaaatgtagacaagagcctgggatcatgaaaagcattgaaacctcagtaaccccgggacaaatggagaaccaaaatcctgtgcactggtgggtccttgggggaggagtaaaggggagtctaggagtcagggggccgtggggctgacccagtgtggaacagcaatatggcctcaggaggtgaaaaccacagatgggtctagctggggtacagagatggtaaggacaggaattccaaaggagctgagatcattgcaggggagacaaatgtgaaaactgtacactctggagcttcgtttctgacttcaaatcaggttctgccacatggcagctgtcatgtaacctctctgtgcttttgtttcctcactggtaaaatggagatggtagaacataggatggtgtgcgtcttttagtgcatcgatgtgtattaagtgcttagaacagtatctggcatagagcaagcattatatgactggtagctgttgttattaccactaccacggctgttcttattatcgtgattattatgactctcagcatagctataatgctatccatagagactgtagagttataatcgtgactactaaatttaagcagcatccttgcctggtgctgtatcatttttggacaccagagatatatttattcctgtctctagagagcgaaaaagcacctctctgtcagaatgactactttctactttaaaaatgtttttgatgataactcttgatggctttagataaagccatccttccaaaaggcctgaagcactctcagatggctccgttttgtcagccctttactgctctgggatgtggtctacccactgttaagctaatatttttgatcttcaatttggaaccttaattatgctgtacagcagtcgttgtacgtggatgcataaaattcccatcaaaagatattcagacactttccaggctcagtggtacgcaggagatggagacacacgtggaagggtgtgctggcagattcccgttgctctgagctgcgagggggtggggcaggtgcgagctaacagtggtggggcctcatgctgcttgtctactccttagatgactatgctcagctgtgtaacatccccgtgacgggacgccggcagccatatggacgggacgccttggttgacttcagtgaacagtatactccagaagccgatccctacttcatccaagaccgtaagcaaaataaccttgttcctttgatactaagttgtggttgaagattaatcagtggtcctcaaaatgtaatggcaacttgttagcaatgcagcatttctggtcccaccccagacctgctggtcagaaagtctagggtgggacccagccatctttgtttcacaagggcagtccttctgcgtgggtgagtctaagaaccactgcatcattcgtgagccgagatcacaccactgcactccagcctgggcaacacaatgagaccctatctcaaaacaaacaaaaagaaccattgcatttgatgaatagtcttgctggtggggatactgttatatttacttttcttaaagttttgagatggagtctcgctgtgtcacccaggctggagtgcagtggcacgatctcagctcactgcaacctccacctcccggattcaagcgattctgctgcctcagcctcccaagtagctgggattgcaggcacgcaccaccatgcccggctaaattttgtattgttagtagagactgggtttcaccatgttggtcaggctcttcttgaactcctgaccttgtaatccatccatcttggcctcccaaagtgctgggattacaggcatgagtcaccgtgccctgcctatcattataatttctataacaaaatcatttctcttctctttaagtggtggactagtttgagggccaaggtttccatgagagcccagttgtattgcagcctttttttcctacagggaaatgcaaatgttaactgtacaagttgatcattattataagtgttttagagtaggaggtaagagaagaattgcccttttggtcagaaatgactttttaaaatacattggtgaggggatttatggagtaagaaataatgtgtgccaacttttcctggattagtgagcacagctttcatgggggaggtgggagtgtgtatctgcaaattgtgatcccctttagaacgtaaatgttgtgtgaggaagcctacaaacacacaagctcaaatcagacttttcaaatacagacaatttgaagtctgaaacagcaggaggtccacaatgaaatattagtagatagtagatagtctcacttcaagaacgagaacaggaaaacgcccattttgagagcctcgtccacagctcacagaggggccatcctcacgtgtagcttcaccacaaatttttttttttttgagatagggtctcgctctgttgcccaggctggagtgcagtgccatgatcacagctcactgcaactctgcctcctgggctcaagcgatcctcccaccccagtctcccgagaagctgggactacaggcacgtgccactatgtgcagctaatttttgtattttttccgtagagatggggggtttcaccatgttgtccaggctggtctcgaactcctggactcaagtgattcatccgcctcggcctcccaaagtgcttataggtgtgagccaccatgcctggcctgcaccacatttttaagataggtaattgctgccgaccgaggagtttgacttaggactttagagaaaaatgcagtgaagcttttttctgtcctgggccctgtcacctgtgcacgaagcgtcctagccaggacccagttctggggcaacagcatgagatttctagctgaatttaggatctatttcagttctgcatcaagagcttttattttttttttccttctcttctctttctcttttccctttctctcccttcttcattccctccttgtccttccttcccctccacctttttttttttgaaggatgtagtgtattgatcatctggtagaattaaaaatgttttaaaatgtccatgataagaacattctattaatccagctaggctgcttaacacacgcctgtgtaactcccacccaggccaggagcagtgccagcctccagaaggcccctggtgccttttcccacccccctccctagggtaaccactatcctgactcctaacaccatagatgaacaacactctttcttttcatccacagcacataaccatgcagctctttatgaaatggaccagaatgcactcacagctacaagactgtgcacttagggtttgatgcttctctgtatatgttacgggtcagtaaacgtttacttaagaaaaaaggaagggagaagaattattaaggttgaaagaaagcccagcttgccccattaatcaggaataccaggttaagtctatatgcaactctgacaatcccgtggcttacagctttcctccctagacctcctcaataactctgttcttagatgtaagcaagagcctgggattatgaaaagcactgaaacctcagtaaccccaggacaaatggagaaccaaaatcccaggcactgatgggtcctgagagtctaaaagtcagaagcctctatggcattatagtttggattccaggaattttcatgttgaaatgtctggcttatgtaccttctttttaatgctggcattgctttaaagctcttttttttaattaactacacatgttaagaaataaacatgttggtgtcacatcaatctcttatttagcaacataggaaattgagatgcagttccaagacctccagcttggacgatgtaatggcctttacatttcttacaagttgcagagaaatatttcccccttcccagccagttttctgacctccagcaagggcttttggagcctgctgcaaaaatgattgtgttgggtagatagtaacatagacggaggctgagtgaggtttcttatcgcctttatggttcaccatctctgttacctttagggagagcagtacttctaaaactggaatttgcttgagcagagaataggcaaacatttgccctttataagggccaggtagtattttttttttttcttttttgagacagagtcttcctctcttgcataggctggagtgcaacggtgcaatcttggctcactgcaacctccacttcctgggttcaagtgattgtcctgcctcagcctcctgagtagccctgggattataggcatgcaccaccatgcccgactaatttttgcatttttagtagagatggagtttcaccacgttggccagggtggtcttgaactcctaaccttgtgatccacctgccttggccttccaaagtgctgggattaaaggtgtgagacaccgcaccgagcccagatggtaaaatttgtaggctttgcaggtcatgtggtttctgttgtaggtattcaactctactgtagtttcacaaaagcagccctagatagcacagcagcaaatgggcgtggctgggtttatttacaaaaataggtagcaggccagatttggaccagagactgtagtgtcctgacctgttttagagtcctgcagaagtattttggggagcctgcctgatgtgtggggagtttcaagttttactttttatgttttaatttctgtaataataaaaaaggtattagatatgaagtagaaatcattttgctgtgatacatgggatctgaaaatattgtcgtagattaagtctttattttgtgtgtttcttaactggctttgagtatgtggtgtcacttttttttttttttaaattggggtctcactatattgcccaggctggtcttcaccccatgagctgaggagattctcctgcctcagcctcctgagtagctgggactcttgttctcctttaaagttttaaaatgggcctgccatggatgtattactcaattttttttttatggtacaaatttttttaacttttaggttcaggggtacatataaaggtttgttacataggcaacatgtcatgggggttagtggtacagattattacatcacctaggtgtgaagcccagtacccaatagttattaccttttctgcttccctcctcccaccctccactagtgtctgttgtttccttcttcttctttttttttttttttttttttttttgtggtatttggttatatgagtaagttctttttttaaattttttaaattatactttaagttttagggtacatgtgcacaacgtgcagttttgttacatatgtatacatgtgtcatgtcggtgtgctgcacccattaactcatcatttacattaggtatatctcctaaagctatccctcccccctcccccaaccccgcgaaaggccctggtgtgtgatgttccccatcctgtgtccaagtgttctcattgttcaattcccacctatgagtgagaacatgcggtgtttggttttctgtccttgcaatagtttgctgagaatgatggttttcagcttcatccatgtccctacaaaggacatgaactcatcattttttatggctgcatagcattccatggtgtatatgtgccacattttcttaatccagtctattattgatggacatttgggttggttccaagtctttgctattgtgaatagtgccacagtaagcatacatgtgcatgtgtctttatagcagcatgatttataaacctttgggtatatacccagtaatgggatgactgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattgtaattggtgtgagatggtatctcattgtggttttgatttgcattcctctgatggccagtgatgatgagcattttttcatgtgtcttttggctgcataaatgtcttcttttgagaagtgtctgttcatatccttctcccactttttgatggggttgtttgattttttttcttgtaaatttgtctaagttctttgtagattctggatattagcccttttgtcagatgggtagattgtaaaaattttctcccattctgtaggttgcctgttcactctgatggtagtttcttttgctatgcagaagctttttagtctaattagatcccatttgtcaattttggtttttgttgccattgctcttggtgttttagacatgaagtccttgcccctgcctatgtcctgaatggtattgcctaggttttattctagggtttttatggttttaggtctaacatgtaagtctttaatccatcttgaattaatttttgtataattttgtaaggaagggatccagtttcagctttctacatatggctagccagttttcccagcaccatagcaccatttattaaataggaaatcctttccccatttcttgtttttgtcagatttgtcaaagatcagatggttgtagatgtgtggtattatttctgagggctctgttccgttccattggtctgtatctgtgttttggtacgagcatcatgctgttttggttactgtagccttgtagtatagtttgaagtcaggtagcatgatgcctccagctttgttcttttggcttaggattgtcttggcaatgcaggctcttttttggttccatatgaactttaaagtagttttttccaattccgtgaagaaagtcattgctgtttccttctttgtattcataagttcttatcatttagctgccacttacaagtgagaacatgtggtatttggtattctgttcctgcgttagtttgctaaggatgataggcctccagctccatccatgttcctgcaaaagacattatctcattcttttttatggctgcctagtattccatggtgtatatgtaccatattttcttttttatcccccaaacttatgccaaatctcatttaatctttacaaggtagaaaagtgttcattcattacaaaatacttctactgagtgcagacattgtgttcaatgttgggtatgccattctacatagcatcgtttctctatttttaaatgaggaacctggtttcaacaaaatcaagtgacttggccagggtcacaggcatgagcagaagaccgagttcctctgattcaaatcccatggttcatttccacaaaataaacctataactgagtggggctttagagatcctaaaattcagtgcttttacttcatacgtgagaaaaataagctttctgcccaagtttacaaggtacacatagggaaatgggaatgggaactcaagtcccccaataccagtgtattgttcttacccaaacagataatttaagattcacttattgtatatttttcggtcatctctaaaacccactttcttctctgaagggcatgctctaaagtttcttcttcacctatctcccctcagggcacctaatcttagaatgtaagagaaactctgaccaaatttgtcttcatgttgacctcaggcactttagtcattgttgaaacttcttttttgttgtagttaagagaagtaacaagtaagtctttatttccttgtttagaaaaaaaaaaaaaaagctggctaagttggttgctttttggtgatcaaggagaccaaactccatatccttgtccaattcctccaagttagaccttattgccctccataagcaatgatattttgctgcctgctgccccctgcagttccactggagaattacttcaaaggccagatagaaagttctagccatatattttttttttttttgaagctactttgtggtactattgggaagagacaggagatgagaggccacatgacagtgtgttgggtcactgtggatttatgtttagaactttcctctgcaaaatgagagctaaacactcttgatgcctggctaaattgtttttacatcacaaaaactctaaagtctagctctgacttggtttcaagagatctaaactataaaaagagccaaacaagagtttctttgtttccttaaaaaaaaacttttggttctgtttttttttggtgtgtgtgtgtgttttgttttgttttgttttttggttttttgtcttttgtttttttgacagagtcctgctctgttgctcaggctggacagtggccgtgatctcagcacactgcatcctccacctctcaggctcaagcgattcttctgcctcagcctcccaagtagctgggattacaggtgtccaccaccacgcccggctaattttctgtatttttagtagagacagggtttcaccatgttggccacgctggtcttgaactcctggcctcaggcgatctgcccgcctcagcctcccaaagtgctgggattataggcatgagcccagactttgggttttctaaacacaagtatgatgttctttctcattcatcaggatgttttgaggcccttttactgaatttttcctttgatcccctgggagcccttttgtaaggctcattccgtagccagagcaaacaaacacatggcagagccagcctgcttctctctggtcttacaaacgccggctgaaaacgtattgcctcacactcttacggaccttcttagcaaatgcttactagactccgatagtgaattctgttggttctgttctgagagtctgacacttgccctactgcaaactcacgaagtttggaactttggatgaacacttttaataattaagagcaaaaacaaaaaccatacttgctttctcgttttatgtgattttaacatagaatatcagaattcaaaatgaggctactctgcacaaaatatacaagttttttatttttatgctattttacacagcaacattcagtatttctaatgctaactttaagatgtctgaaatatgtatggacatatatgtgtctatttggaaaatgaaccatcatctaaatatcatttacaaaatgatataggaagttgagaagctctaacttagcttctgccctttcctttccaggttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcggtaagaatgacgtgtgttttatgggacattaattttttcctgacaccccgtatctcagtcagtagagaacatttaagatagatttgctgagtttcagtttgagaagatgagaaaagttctggagatgtacattaagtacagtatgaatatacttaatgccactggactatatacttaaaaatggttaaaatggtaaatatgttctgtgtattttaccacaattcttttttttttttttttttgagatggagttttactcttgtcgcccaggctggagtgcagtggggtgatcttgactcactgcaacttctgcctcccaggttcaagcaatgctcctgcctcagcctcctgagtagctgggactacaggcacccgccaccacacccggctaatttttttttttttttttttttgtatttttagtagagacgggatttcaccgtgttagccaggatggtttcaatctcctgacctcgtgatccgcccaccttggcctcccaaagtgctgggattacaggcgtgagccaccacgcctggcctcttctccatcttgaagcagtccttttgcccactttgcttttgttagttttaatccatggtgtgtctgtaaaataggtaacctagcttcttaacagatgtttcaagtgagtgagagcctaaatgggtctcatgtagaaggaggtctgtgaatgttatggaaggctttagacaggctgtatggagaggcctctgcgtaggtatctggttcctcttgacaaatctagcagttcctccatacctatgggaaggaatttggaagtaatatagttcctccaacttccttgaggttctactagaaaatgtcaagctcacaaaatgctcatgttttgctagataacagtgaaagaagttctagaacctccctgataatctgcctctttaagatctcaaaaaagtcatcttcgtcttgtctgtgactgaagcaatgacgagaaagcttccttggggtggtcgggggaagggcctcaggtaagcctcaggttatgtgtcctcacagaataatatccaagattgtttacctgcatggcttgacttattgcagatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaa

SEQ ID NO: 932 - DNA, 264912 bp, Homo sapiens; identical to SEQ ID NO: 931

SEQ ID NO: 933 - DNA, 264912 bp, Homo sapiens; identical to SEQ ID NO: 931

SEQ ID NO: 934 - DNA, 264912 bp, Homo sapiens; identical to SEQ ID NO: 931

SEQ ID NO: 935 - DNA, 103697 bp, Homo sapiens
  misc_feature (41689)..(42688): n is a, c, g, or t
  misc_feature (91184)..(92183): n is a, c, g, or t
gtgaaaagagagtcctgccaagggctacgaggcagaaaactgatattattaaagtggtcttctgaacggtaagtatcagccattttctaatcttttgtgatgttattgccagaaagggggaggggggggtaaatcatgttaatgttgttaaggatctaacccatgcattgctaactttttccagatcgagggctcagatgcacatcagtatctataggcacacagaaattattgcacagcgctgttcacagacagatgtgcttcttgaagactctattactgtgagactcgaagaagtttcttaatgtctgagcctcagttccattatctgtagcctgttagtgatccatattgtacaggggtgttatatacaataccagttgagaagatgcatataaagtgctttaaaaataaatgatatagaaacatgatgcaagcaagagtgtcttcgaaaccatttgattattaacactgacaaccttttctgtgccccactcagaagcctgatgacattcagtgctgctgggctgtgataccaaaatgtttattagcattttcattctatagcaaccttttccccatttctgggtggcaagtggtgataagggaagggataaagaagaaaacatgatggatttttatgaagtaaacgagaaagaaccaagttcccatcattaggatttctcaggttggtgctaagaaaaggaaagaaaaagaggatggggagtaacaggcaaaagcaaaacaaaaaactgatgaaatggggaagtggctgactaggatgaagtcagagaattagaagacctggatgaagtctcagctttaccgcctcctagctgtgaccacacctgagctcctgaacctctcagccccaatttcctcagctataaaaatgcaaatacccaccctacagaccagactgaatttatcagatgatgtatgtgaagtactatgtgagcaactgtgtacaattagttattgttatgatcaagagaaaggggcattgtggatggtctatcggttcccaggggctggtggagtccctggataggagtatgcagcaacttggctccagtttctgtaatcccatgggggtcagaaccctggggtttgagaaacaatgctgcagaatatctttcagtcttgtccttcatcactctatttactgaatcaatttggcctagaggatatctggtgccagggttgataaaagctgtcttgggatttttacagctgtctggtcagaagacatgcttatgccataacagctccagctccttctctcactctctctctctctctctcacacacacacacacacacacacacacacacacacgaacagcactagaatgtgctttacatatgaagttgattcccctgatcattatcagtaggacatagggtgatttcttcagataggtatgctctgattaatgttcaccctcctcctttaataaattgcagaagtgtcccatgtttatctccaaaaaattagaaaatacaaataagcaagaagaaaaaaaatcatccaaaatcccacccctgtagaagttaaccctgttaacttttttgtatatccttccagactattatataaataaatacacatatatctgagagatattggctttttgtttgtttttacttaattaagcttttcagtaaaacacatggaagcaggcccttcattaacatttgtggagctccaggccagagtacatatagaggcctgcttactatatatctaaatatttcaaagttaaaaatcaagcaaagaaatggttaaataaaatttgttttatgctttgatcttgacagatattcctttataatgacttggaaggacatattttaatttggagttctcaaacatctcagaattcaaccaaaaaggggtgcagagagagtcagctcccttcccctatcctgcttttcagggtcccaagtacacatgtgcacactccagctgcaggtgtcaggcatgtcttcagcacccacaaacagctctgcatggctaccactcagacctgggagtgcacagaccagacgccactccaccctcaggattatgggcacagaagagaggcacatgcagcttctggatgcaggctttgggcctgtgggcagggaactcctggggtcccagttacctgagcgtggtctagaagatggggctaatacaggctctaggcataagcaaaaagtgtctggaggagggacagaaacagaaagtcccaaagcatagggatttcttgccttggtttaagggtggtactgacgggaaaatggtgtcagatacaggagttgttgggaagaacacctattcctctttccttaatattccttgaaagtgagaaaatttctgttccacaaggtaggaagcaaaagaaaaggagcctctctctactccatatttattccaagggaggaggagcaacttaaggaactaaggaaccagacaaatccaactctctctctccctctttgtgtctgtgtgtgtgtgtgtgtgtgtgtgtgtgtgtgtgtatctctttctgtgtctctctcaagataggtaaaaccatgacactgttggcatttgggctggataattctttgttgttgggagctgtcctgtgaatttttattttttatttatttatatttatttatttatttatttatttgagacggagtcttgttctgttacccaggctagagtgcagtggcgcaatccccactcaccgtaacctccgcctcctgggttcaagcgattctcctgcctcagcctcccaggtagcttggactacaggcatgcgccaccacgcccagctaatttttgtatttttagtagagatggggtttcaccattttggccaggatggtctcaatctcctgaactcgtgatccatctcagcagatcacgacaccccaagtgtctcctgggggacaaaattaccctcttttgagaaccagtaggttaaacaacagattagacagataaggagagaattagtgaagggaaggatagctctagagataattcagcacattctacatcagacagggagagaaataaaagtaggtaagagacacagaggatagatttccagaagaatatatctaatcagaatttcagaaggatatgaaagagaattgggaagaagtatttgaagagttaatggctgacagttcttcagaattgatgaaaattattctcaaaatcagaatatccacatagactttaaaatcacctctcaatttacacatacgcatagcctacaggatttttaaaaggaaaaagttttaaattataccatttataatggcatgaaaaattcagatactttgcaataaatatttttaaagattgataaaggcacatatatcagcaggaaaaaacattttcaggcagactatacattatatgtgttgaaacatcactatagcccataaatatctgcatgttattatatgtcaattagaaaataaaataactcttaaaaagtcctaaatttaaaaatggtgggaaataccatgttgatgaattggtaaactcagtatagtaaagatgttgtttttcctcaaattgatctatatattcaatagtcttaataaaaattccagtctacttttttgtggaaattaaaaatatgattctaaaacatacaggttgagcatcccaaattctgtatctagaaaaccttatagtccttccttcagctgataaacaacttcagcaaagtttcaggatacaaaattaatatacaaaaatcagtaacattcctatgtaccaacaaccagccaagctgagaaccaaatcagaaacaccatcccattcacaattgccccaaaaagaataaaataccaaggaatacagctaacgagggaggtgaaagatctctgcaatgagagtacaaaacactgctcagagaaaccaaagataacatgagcaaatggaaaacatcccatgttcatggataggaagaatcaatatcattaaaatggcgatactgcccaaaacaatttatagattcaatgctatttgtatcaaactaccaatgacattcttcaaaaactagaaaaaactattttaaaattcatatggaaccaaaaaggagcccaaatagccaaggcaatcctaagcaaaaagaacaaagctggagacatcatgttacccaacttcaaactatactacatggctacaggagcaaaaacagcatggtatttgtataaaaacaacacataaaccaatggaacagaatagagagcccagaaataaggctgcacacctacaaccatctgatcttcaacaaagctgacaaaagcaatggggaaaggaatccttattcaatgaatggtgctgggataactggttagccatatgcagaagattgaaactggaccccttccttataccatattaaaaaaaaatcaactcaagttggattaaagatttaaatgtaaaccccaaaactataaaaaccctggaagacaacctaggctataccatcctggacataagaacaggcaaagatttcatgacaaagacaccaaaagcaattgcaacaaaagcaaaaatggacaaatgggacctaattaagagcatctgcacagcaaaagaaactatcaacagagtaaagagaaaacctacagatagagagaaaatttttgcaaactatgcatctgacaaaggtctaatatccagcagctataaggaacttaaacaaatttacaagaaaaaaaaacactaaaaagtgaacaaaggacatgaacagacactcttctaaagaagacatgcatgcagccaacaagcatatggaaagaagctcaatatcactgatcattagagaagtgcaaatcaatacaatgagatgccatctcaaacccagaatagctgttattacagagtcaaaaaataagatactggtgagactgcagagaaaagggaacacttaatatactgctggtggcagtataaattcgttcaatcattgtggaaagcagtatggtaattttcctaaagacagaaaatccattcaacccagcaatctcattactaggtatatacctaggggaatataaatcattctaccataaagacacatgcacatgaatgttcattgcagcactattcaaatatcaaagacatggaatcaacctaaatgcccatcaacggcagattggataaagaaaatgtggtacatatacagcatggaatactgtgcagccacaagaaaaaatgagatcatatcttttgtgggaacatggatggagctgaaggtcactatccttagcaaactaacgcaggaacagaaaaccaaatactgcgtgttctcacttataagtgggagctaaatgatgagaactcatagacacgaagggaacaacatacactggggcctacttgaggatagagactgggaggagggagaggagcagaaaaaataactactgggaactaggcttagtacctgggtgatgaaataatctgaacaacaaaccccccctccacgacacaagtttacttatataacaaacctgcacatacacccctgaacctaaaagaaaagtttaaaaatgtaaaaactatatatcaataagaaaaaaatcaagtgggaaaaaacaagtattttgcaaaagaggataatatccaaagaaaaatacaaaaatacactcagtcatcagagaaatgcaaattaaaataaagagataggaccacatactcaaaagaatggctaacgttaaaatgactctgcataccaagtgttaggatgtggagtaggagtaactcttaacaatgctaatgggagcaccacttgatagaaacactccggaaaacagctgggcaatatctgcaaacttcgaagatatgcataccctatggctgaacagttttactcctggggtgcacacacatacccaagcacaaatgcaggcaccaaaactctcatacaaaaatgcttatagcagcgttatctataatagtccccaaattgagaaaatctaaatatctaccaacagtaaaatagatgcataaatggtgggatattcatgcaatgatgtggtctgcatcagtgaaagtgaatgttctagccataccacggcaataacatgagtgaatctctccaacactatgttcagcaaaggaagccagatgttaaaaacattaaaaatttaaaaagtgcatgctgcatatttccacatatataataagttcaaaaagcagattaaattaaactgtgttatttagtgatgcatgcttagtataaaaactataaaggaaagcaatgaagtgatcaccaccaaagacaggctaatgactactcttgtgggtataaatgggtggtggatgaatggtactaaaggacttccggggagctggcagtatcatagttattaactgggctcatggctaacatggttcttctggcaaatcatcaagttatacatttttgttttgtgcattcttcccaaatgtgtgttgtgtttcacagtaaaaagcattaagatattaggaagagtgcagtcaactcttaatgtgaacctgaatgtctgccttctcctctccacgtttttgcacttttctacctctttgtcttttccttctttttgaggagacctgagctctttcctcaagtaatttttctcacaactcataaaattgacttttgaaaaatcatactgcattttgaggtgaaacttggcaacacaaacccaaacttaactccatgtaactttaactccccacccacccccactaccaaacacctccttaaacaaaatataacaacattttacaactataaggtgcttttaccctaaggcaaaaatgtggataatttgacattgcactctaaattctttatttcttttgtctaatacagttaagatcctgtgctgtctggataaataggggggtactaacctaaggcaacccaggccagcataggcagtgattgagtgtggtcatcttggtgaccaaagccagcttctcacatttcttcttgaaaagcatggtgctgacatgtttaatatcctatggcattccctttgggctctgtagactgatggaaaaggcccctgttaacatctgatggccaagttgaatagcacagccttgagaccctccacttcacagctccggttaggggggtgatttctcaccaagttgtagtagaaataccgatagtcatatcctggcaggatccacataccaccggttatagggagaacacttttgtgtgcctggatggttttggacaaacaaaggtgaaatctcacccacaacttcatagggaatgataaatcaaaatccagcacactacaaaaaagaaaaagataaagctaaggtttgaagtttttctggaagaattccaaaaatgcatatttcaagggaatgtctcagggcaaccctaaatagactggtgacctacagatcaaagacactgtattttattagccgtctcctgacccagccaatccaactgtccttccctaactgttacatgcatccagataaaccctcccctgtctgtctttactttcttcctccgagaatcacaaatcaaccctgacaacatttggtttctcatcttaaggaatgttgctggtacattctttatgtgaaagaggcaatcccaggaaggggtatgaaccagactgaatgaagagtatcttatttcatctgcacagaacaaaagagtgtctttcctttcccaatgcctgcaagagtctaaggacttgaatgaaagcagactggctgagcttagtcctaaggatggatacaaggctggcagggaagaggggttctctggggtctgtggggtgactttccttcctccatgattgttcttataatggagtcctgtcttgctaaggggagcagtgactgacagggttatttatctttgactgcttccccacactgatcccacgttcttttttttttttttttttttttttttttggagacagagttttgctcttgttgcccaggctggagtgcaatggcgcgatcttgctcactgcaaactccgcctcctgggttcaagcgattctcctgcctcggtctcccaagtagctgggattacaggcatgcaccaccacgcccaactaattttgtatttttagtagagacggggtttcaccatgttgatcccaagttctataggtacggttgggatataattattttgaaatgttatgagtgtttcataagtttactctgacctgggaattttgtgaagtgtcaatgtggcaggcagcctgaaagacggttcccagtgatctctggctcctggtattctcagccttgtggaatccccatccctggagtgccttgtgtctatataaaatattgacaacattgaaaggatgtcatttctatgagtaggttacataagacagtgacttctatcttgcgagcagaaacacttcctggctgcctttgataaagcaagccaccattcgggagaggaccatgtggtcaggaactagggatggccttgggccaactgtccccatagccctgaaggaagcaaggagctgaggaagtcaggtggcccagcaaccctaaaggaaccaaatcctgccaacaaacacctgagcttgggggcaaacccagatgggccttcagatgagaccctagcccaggctgacatcttgactgcagctctgtgatagaccctgaggttagtcctggctcatctgtgcctggatttctctccctcagaaaccatgagataataaatgtgtgtggtttttaagttgctaactgtatcttagcactgcattataaagcagtaggtaattaatacagtagatttcacttagtcactaattattacaaaatatatttctggatacattttatcatctcaaagataatagatggacaaaataattaaactggatatgctttcactctatgtcacattgtgtcaaaataagtcatctccttagagaattatttgtaaactaacagattatataagggcaggcattaagaagcctctgtggtctaaaatgtgactcctctgattaaagaccttctggagttctgcatgaaatacatactctttgctgtgacattcataatgtgactccaaaccaccctcccaagattcttccccatcacaccactccttgttggtaccttatgcccaaggggtggttcctgaccaccctttccacactgcagcctgccctccccatctgtcttttctcctgctgcccttctggtgctctccctgctttactctacctcatgtctgctgtggaaagcctgtctcctcaagaccaccccttcgtgagatttcttacaggtcccacatccacctctaagccgggtactctgcctcttccccttacactgcaacaccacttttggccttgtttagggtatttgcatgctcttcccctcatcctgatttgctctctgactcttctctgattcagcctcttctgatttcccatgtgagaccaaaagctacatgagggcagaaactgtccctcattcttggtggcccttcctacaacctagaacatctccttgggcatagtgaagagatggtcacacagtgtttgcagaattgaatttcatgaagggcagattgtgatgtggtgcagcattacctagatggtgttaacagaatttctgtgttaacagagattctatggccaaagtagtgtgagaaaccaagtgcgctctgtccctttgctatggtttggataattgtccccagcaaatctcattgtgaaatttgatccaaatgttggaggtggaacctaatgggaggtgtttgggtcatggcagtggatccctcctgaatagattaatggcctccctcaggggtgagtgagttctcactctgttagttctcaagagagctggtgtttagaaagagcctggcacctcccctctctcttctgcttcctctctcaccacgtgttctcttcacacacaggctccccttcactttctttttttctttttaaacagacggggtttcactttgttgcccaggctggtctcaaattcctgggctcaagtaattcacccaccttggcctcccaaagtgctgggattacaggagtgagccaccgtgcctgtccccctttgctttccatcatgagtagaagcagcctgaagtcctcaccagatgcatatgccagtgccgtgcttcctgtacagcctgcagaactgcagaggcaaataaactccttttcattataaatcacccagcctcagctatttctttatagcaacacaaaatggactaagacaccctccatgaagagccgccctgggcattagatgactaaagtctctaagaagctctgcagtaaagaaacaggcagagcccaacattccactctggctttctgtaatgctgtgatttgggcagaaggtgtggaagctgcctacttacctctctacgggatctctgcccatgtagagctcacctgagagcggatgctgtatgttttgttttgttcttttctctcaataaggctgtgagtttatcacactttgtagtctatactcatttcccttgtttagtcacaggtgattccagggcgatttcaattgatgatgcttcgaacggatactcaactcctaaaaatacacaaatcccgctgttagaaactaagccacttctattgcatttagaaccgtatttaataactagtttgacatggtgactcctgtcctcaagggactttttgctcaagagtgcagtgactaaagatttcagatattagacacccactttttcaccagtctttgccagatttaattctatttaatggatgttgaataagcctttcccatgtgtcaggcactatgctagatgcttagggtacaaaacgtaataataaactgttcctgccctaaagaatgtctattctgactcagagcataacatattattttaatatacttctgcgagtgctgaaactctgttatcacctgcacataagcaggagatggggaggcaccagttgaaggcgcttagctgagaggaaagggggaacctgggatgagagttagttgaaagatgcagaaaagttaccctgagaataaaggtagcagaaagaaaatctaatttaactttttttttttttttaatatactctctgccagcaactctctgcaaggtcctaagggttctaagttgaataaggcccactccctcccttccaggactttagctgaggttggttggggcagaagtcgggcaagactcatcggaacggattaacagagacagaatccagaggcaacggggtgaattccaagtataggtaatacttctaattttaatttaaataatcatttatttcctctaagctttattattttttaagagctagcatcattcctctgggtgtcttgagcctgtagactcagcagctgtgaattgaagaatttctgtctggttcctggtcaccttttccctgctgaaaacactgtccctcccttctctctcttcttgtgcttcacttccatgaaggagggcattagaagaaaggaaaaggaaaagtgcttccctccctctgtgctcctggcaactctaatggtaggatctgttttggaggacttgctgtaaagcgatggcagttagccacgtctggaacctatgtccatggctgaaagagccacaggctctgccgtcaggagacctgtgttagttttgtctctgctattcactgattgtgtgcgcctggcatgttaactaaggctctgtgtgtttaccttatcttcaagatggggtaaaaagatactcacaggggtgtgtgcagattagtgcttatgcgctgagcacactgtccaaaaggctattttagatgtaattctcttcctctttttctttaaatcagaaaagacacacttggtctgagggtatgtttcagctcaggcatgctgccatcaggaccacgtaaagctggatttttctacgctagtccatttgcacgtaagctcctcctttctcctccgaagtacaattgttatacctagtagttgggaaaattgtgtcattgtgtttgtacctaacacagatgacttaggaatttttttctactccttggatttatcttctcattttctctgggttaccttgagaaggacaagaagctggtgtttatattggcgtgcaggattgagagagaacataaaaatgggtgggacatatatatgccgtgatggatggagtcgtgaacacttttggcttaaaaatcaaatttcctttgctattatactcaggtcaaggaagcaccaattacttcaggtctttcctggagtaattaattcacctataatgccttcctctcctcccttcctgttatcccttcccagtagcttgtttttctttattcaaagaacatatactgagggctcttagggacacacactgtactagggggagagctcccaggaaaaggcagcaggggcaggaggaaattgcggggagaggcacacaggcgctcacagcccccatccttgtctgagtctgacacatctgtcctgggtggctcttgaagagctccacagatgcagtaataagagaaagggggcaggaaagggccctgggctgcaaggatcagaaggcgataactcagagaggtggagtgagtgggcacaggccccacaggatgaactgtgcagagaggactgagggggcagcagcagaaccagcctggctggtggtgatggggacagcccaggccaatgggggtgacttgcggaagagtggagagaaaccagcaagtgcgtggccatcggtggggcctgctctcctcactcttctccgcaggtctgacccctttcattttagctccagataatgagtttccatcacttcatttaggaaagcaccaaatgggacgggccctgttttgggactggggatgcaaacacaagcaggaccttgtcactgctcccagggagcccgccgcgtggtgctgcggttcctgttcagggctgcgtagcagaatcaccccggggagcttttaaaacacacaccatccggagattcagattcagcaggacagggtggggctgccatttccctatctgctggtgaacctcgagctaatgaaaatagaaagagaaggacgaggaggtcaacacccctgttttccaggcactgtgctaagtgctttatataagaggaagtgaaatatatgaacagtggtgtgcttccgctggctcacaccagcccggaggggtcaactctgtacctttcttctcaacttgacattcagtgacatcacactagtactttgaaatgagccctggtgggaatattacagcatggaaatggacaaatgctaaacaccggggcattttcccctctagaaagccagttgttaaacatttaccagaacaccactgtgtatatgtatgtttcttatttagtgtaatcttcataataaacccagatattatccatggactaacacttgacagctttcaaatcacttttaaatacgttgccctactctcgcaatgccccgtgaggtatccttgtccccattttaaagaaacattggctccaagaggtcacacggccaggaagggacagacctgacatgaaaggccaagcttgcctcctatcagccttgttcctgctatggcaggcccagcaggcagatttctggttctgagccagggtcctggtcacaggggctggagggactaggcctgaccccgttctcagatgtctgataacaggaagtttccccccaacactgggaggcttagcttaataaatgagtttcctgttctgcttatttgcgtacattgaggattctcatgctacgtttgggcctacataggcaggcttccaggggcctccaattcaggggcttgctgtttccagggggactggctgtgctagggaaatgtgcccttggctgccatggaaagaagggaatctagaactttttaaaacctgccccttcaaggtcttggccaaggccatgggaatttccaaatatttcacttgtcccaattgaggtagcaatgaggacgctttgctagaatgaggcttagagatttatgtccccatggaaaatccccagaagtgagggaaactcattctaaaatgtcgaaaatagcagcaaaccgaaccagccctcacagatatcacctgctgtagaaacagagtgtcctgaggaagaaggcaagaagaaattcctaattcccagggtctctctccccataatttaggttttgtcaggacctactggtatctgttgggacagacaactgagtgaaaagctagtcgtcatggaaaaatcagtgaaagacctttttaagacagaattttccttcatgttaggggtttggacagctggggctattccactcacatgatgcccactctgattaccgcactcagaattcttagtttgtctcatattcagtcgccactacctggagtttccacagagggtgtcaaaggtgacctcccttacattctgaaggatgtcctgtctgagggatgggctcccagaggtcactagatgggaatagtggtgtgtattgctgaggaccccagaggttttagaacggaaggacttgacgccatgggcttgctggtgggaggtggatgatcccttaccaagctgtggcctcacaccctcctatgctcccgaccacccccagcactggcttgactccagtgtgaatctttcttttcttttgaatcctaaacacatgtcccctgaagtgtttcagacagttgggatcagcagcaaccctagcagtgtttgtgcagaacccccagagctgacactgctgactgggacatgtgacctggcacccccaggtgggtgggccccaggtgagtccacccgggctccagcagaggaacctgcctccggagttcggaggctgtgatgcgtggtaccgatggactctgagttccagactcgggacacaaggggagatggaaggcaactgtgtaaaccaaagaggcagcagcaggaaggtcccagcgaaagcagatccactggccagaattccccaaagcctctctgcagtgtggttctcagaccagcagcatcaactcacttggggacttgttagaaatgaatctgcctgtcagtgagaggcccaggggttcctgtgcttgacggcactgcactaaacaaagctgagcctttgctaactcctctaggtctctacccactggctaagactcggccaagggcacatctagggctggagtattatacagtgagcagaagatgtatgcaacttaaagaataatgttaaggagtgggggaatgctgatttttttctctgcctctcttgtatattctatcataaaggatctggactcagaagagatttaagtttcaaatctggctttgtcagttaatgcttgtgggatctcaaccacgtcactgacttctctgagcatgcttccatatttctacaaaggaaacaataggtgactctgctgagttgagcacttgcgagtaccaagcagtaagtgttttacacctatttactcatttaatcctcctgaaaatccgtgtgacacctgtgttgttattacccccatttgacaggtgaggacctgaggcacagatgctaaccagcttgctggagatcacacactcatgagtggcagagtggggcttggaaccgggtagcctggctctggagccctcactccatccacacaccatgctgggacccagtcgagtgaccagcagaccggttgtgtgggttaggtggaatggtggatataaaccacacagcccagctcctgacccatgctgggccctcagtaagttactactttcattattatacatgcgtagatgaaagttgggtggtaatagtgattttccctaagatgatggaactttacgtgcctttgccttttcttacctgtatattcctgaaatcaacaggttctacttttgtcacaagaagagaggaaataattgtacttttttttttttgagatggagtctcaatctgtcacccaggctggggtgcagtggcacaatctcggctcactgcaacctccgcctcctgggttcacgccattctcctgcctcagcctcccgagtagctgggactacaggcgcccgccaccacgcctggctaattttttgtattttttagtagagacggggtttcaccatgttagccccttgatatggttaggccttgtgtccccacccaaatctcatcttgaattataatccctgtaattctcataagcttcacatgtcaagggagagaccaggtggaggtaattgaatcatgggggtagttccccatgctgttcttgtgatagtgagttctcacgagatctgatgattttatacgtgtttggtagttcctcctgaattccttctcattcctgccgccttctgaagaaggtgccttgcttccccttcaccttctgccgtgattgtaactttcctgaggcctccccagccatgctgaactgtgagtcaattaaaactcttccctttataaatttataaatttataaattctttatagcagtgtgaaacgggactaatacacccttcttgacttgcttatgtgacttgcttatgtgacttgctcatttccagcatgaggcaggaaaggatagaagcctttcagagcctgagccaagttcctcctcacagaagcacagaggacacttactccatctctgaaaaagctgcccacaccccacctccatccagccttccaaaagccaccacgaatgacccgtaggaggggcagagtgtgccacttgctacggaccagaacctctggggagcggggatcatctctgtgtctctctgcttcaactgcatttaaaatgaacattcttaatgataaacctttccgtgtgtaaagaagggcgtggaaaaatgtatgtactggagactcgggtaatgactttctaagtgtggaaaattttcccccaaagtgtttccaaatatagaaaagtcacataataaatgatgagggctcataaacctttctggcagcagttgcaggggtcagaacaaggaagaaggaattcccagctcctagggcctcgcatcccacactgtcttctgggctactgtgcaaccaatggttccgtatctgtacgtacccaggggctccttagataaataattgaagtgaaatatcaaatgtgttactggttttttaatgtcactgataaaacccctaaaatagactgcatgtctcccagctcttctgaaccaggagtgtttgggaagttgagaatgtcactggtcacattgttcctttctcttgtgtctctaaagggttttgttgttttaggtttgttaatggttgtcaaacacatgcctcagacatttttaacctcctggaagcctactggactcaacacactgaaaccagccctgattctctgctgactgcatttgccaagattgagtcctataattgtcaggttgctgccaaagctaaagccctgccccacctgccccgccccgccacccacctgccccaccccaccgcccatagccttccctgagaaccatcttcaacttcttggcagctgtgattctcctcacctctatgggtggaggaaaccagtaggggtgcagaagatcagggggttgtggaaacctgcatcttcttcatgctccccaaacctttcttccttgaagcaaggaagggcctagctctgtcacagaaagggtactgaaagacataacagaaatgcccaaccaaatggagattatgagtgaatgtggtcactgggatcacagctggccctaacaggtctattctaactattctaactctggtgagcccccaaagaatgagggaccccctcagacgctcccaatttatcacttcaaaaatcttcgaagagctcccagagaaaccctggagcttacacaggcctccagaacaaggcaggagttttggtcctggacagataaccttgtcagagcatcagagacacaggcaccatgttgggtatgagcaagtccctcttgaccaccctctcccctcattttatgaacagagaaagtagctctcatgtccggagagactaccaagaagccctgggcatgtgttttgactcagaaagtcctagaagagtagacagaaaggtcaccatgttattttaaacccaaacttgatacttggatgtattcatggcctggcatataagagctgagaaatacctccccactccacttgtcacagctcaagtcctcacccatgtatcagtttgaggtttgggctctaggttttgagatagaatgaaggatccaaagagttcccaagaagatggaaagctatgatacataaagaaaggatgaagattaagcctatgcattcaaagttcttgtgacccatggaaaaaataaaaataaaacccaagcagaatgctgaaatgcattgtgattcctaagcttgggaagaaaaagccacaggatgataaaatctctgtgtttaagtaaaagaaggagactggttatctgaagagtgctgatctgttttctattatcagctaattccatgattttattgccactctctcctgagtttctatcatgggcagtgtaggcattgaatcagagaatcttctatgggaaaactcagagttcaattcaggggagtgatgccgagggacagagttatctccatggctcatgcaaacaagggcctctcaggtattagtggtactttttaagcctacccagtgacaacacatggtggagaatcagggttccattctagagaggaggcttgaaagacatgttggctaagagaaaagtaaggaaatacatcatctccaggttacttaataatataatttggctgtgtccccattctaatctcatcttgaattcccatgtgttgtgggagggacccggtgggaggtaattgaatcatgggggcaaatatttcccgtgctgttcttgtgatagtgaataggtctcatgagatcggatggtttcataaagaggagtttctctgcacaagctttctctcttagtctgctgccatccgtgtaagaaatgatgtgctcctcctggccttctgccattattgtgagtcctccccagccatgtggcactgtaagtccattaaacctctttcttttgtaaattgtccattcttgggtatgtctttatcagcagcatgaaaacagactaatacagtaaatttttgacagtagagtggggcactgctgaaaagatacccaaaaatgtggaaatggactttggaactgggcaatggggagaggttggaacagtttggagggctcagaagaagacaggaaaatgtgggaaagtttggaacctcctagaggcttatcgaatggctttgaccaaaatgctgataacgatatgacaatgaaatccaggctgaggtggtctcagatggagaggagggacttgttgggaactggagcaaaggtgactcttgttatgttttagcaaagcgactggtagcattttgcccctgccctagagatttgtgaaactttgaacttgagagtatctggcagaagaaatttcttattttttttctttctttctttctttctttttctttttttttttttttgataccaagtcttgctctgttgccaggctggagtgcagtggtgtgatcttggctcactgcaaccttaggcggaagaaatttctaagcagcaaagcattcaagaggtgacttgggtgctgttaaaggcattgagttttaaaagggaatcagagcataaaagttcagaaaatttgcaacctgacaatgtgatagaaaagaaaatcccatttttccgaggagaaattcatgctggctgcagaaatttgcataagtaatgagaagctgaatgttaatccccaagacaatggggaaatgtctccagggcatgtcagaggtcttcacagcagcacctcccatcacaggcccggaggcctaggaggaaaaagtgggtttgtaggctgggcccagtgtctcctgctgtgtgcagcctaaggacttggtgccctatgtcccagctgctccagctatggctgaaaggggccaacatagagctcagcccatggcttcagagtgcaatccccagcccttggcagcttccatgtggtgttgagcctgtgagtgcacagaagtcaagaattggggtttgggaacctccacctagatttcagaagatgtatggaaatccctggatgctcaggcagaagtttgctgcaggggtgggacccccatggagaatctctggtagggcagtgcagaagggagatgtggggtcagagcccccatacagagtccccactggggctgtaagagggctaccgtcctccagaccccagaatggtatatccaccaatagcttgcaccatttgcctggaaaagctgcagtcactcaacgccagcccatgaaagcagccaggagggaggctgtaccctgcaaagccacaggggtggagctgcccaagaccatgggaacccacctcttgcattggcatgacctgggtttgagacatggagtcaaaggagatcattttggagttttaagatttgactgccctgctggatttcagacttgcatgggtactgtagcctctttgttttggccaatctctcccatttggaatgggtgtatttacccaatgcctgtatccccattgtatttaggaagtaactaactcatttttgattttacagactgataggtggaagggacttgccttccctcagatgagactttgtagacttttgagttaatgctaaaatgagttaagactttgggggactgttaggaaggcatgattggttttgaaatgtgaggacatgagatttgggatgcaccaggggcagaatgatatggtttgtctgtgtccccacccaaatctcatcttgaatccccacgggttgtgggaggaaccccgtgggaggtaactgaatcatggggggaagtatttaccatgctgttctcgtgatagtgaacaagtctcatgacatctgatggttttataaagaggagttcccttacacaagctctctgtctttgcctgctaccatccatgtaagatgtgacttgctcctccttgccttccaccatgattgtgagtcctccctagccatgaggaagtataagtccattaaacctctttcttttgtaaattgcccagtctcgggtatgtctttatcagcagtgtgaaaatggactaatacacttaaatattgaataaaggctatgaaagaaagagtagggttttcttgggggatcttaaggatgatacccactttccttgtttaagaatcctcttgcctggggatgaagggctccacttatttttaggtgtctacagtgtaatagaactctgaggacagaaatccaactctgattagctttggcaaaggggcagatatttgaggctcacataaccagtctccaagggggtagggatgtggttgatctggggacatctagaaccagggagtggcatgccactagcactctgtctcacctctccctttctctatgtgttggcatcagatttttgtttttatttttcacacactgcctttatgtctcaatctttactatcaaagaggagctgcatctctttccttagttgcatgccaaaacattccagagaacagctgtgtattagtcaggattctcttagagggacagaactaataggaaatatatatatatatgtataaatatatatatgtatgtgtgtgtatgtgtatatatatatatatatatatatatatatatatatatatatatgagtttaagcaagcaaattaaagggggggttattaagtattaacttacccaatcacaaggtcccatgataggctacaagctgaggagcaaggagagccagtccgagtcccaaaagtgaagaacttggagtccgatgttcaagggcaggaagcatccaggacgggagaaagatgtaggctgggaggctcagcccatctctccttttcatgtttttctgtctgctttatattctctggaagctggttagattgtgcccaccagattgagggtggatctgccttccccagcccactgactcaaatgttaatctcctttggcaacacccacatagacacacccaggattaatattttgtatccctcagtccaatcaagttgacactcagtattaaccatcacaagctgggtcaagtgtgcacctctgagggcaggtggccagggccctcactagaaccatgtggctggagcggacagagaagcagatcccagcaagaaggactgagcagacacagccacaatgtccagcatggcactgcacaagatgccaaattctatgtatgaggtgggtcatggagctgggggagaaaaaaagaagagaaatagatcttgagagtaggggtggagtagggtcaggagaggggtcatcctgcagcataagcaagtgaattgaaaggacattcagttctgctcttgaacaaggatgcctcaggccatatacatttcttgccagtttcctctcaagcttaactaataacttttcctccttaaattctgtctgagctagttggcaaagtgaaataacattttctgtttatttgtgcttggtattgctggaaagattcctatgaagttgtggagtttttttttttcccctcatcattttgtttgtaaatttctactcaacataagccatttcttaataggctacctgggaactgtgacatgtactagtactggtcagtagtagctacatctttctacttggtggaatctgccttccagctatgaactctagctgtgagtctgatggaagctgatatggtttggcggtgtccccacccaaatctcatcttgaattgtagctcccataattcccatctgtcatgggagggacttggtgggaggtaactgaatcacgggggcagatctttcctgtgctgttctcatggtagtgaataagtctcatgagatctgatggttttatgaaggcagttcccctgcacatgctctttcttgcccgctgccatgtaagccgtgcctttgcttcttttttccttctgccatgatgaggcctccccagctgtgtggaactgtgagtctattaaagctctttccttaataaattacccagtcttagatgtgtctttattagcagtgtgagaacagactaatatagaagcatacttgcagttgaaggtggacagaacaacaggatcttagctttcccagaatgggtcaccagcctgacagtggtggtaacaaggacatgcagtggagatgatcaggactttggagccagaaagactaggatttagatccaggctgtaaaatgaataaggactgttatggaggatggggcacactgcccagatgccccttcttgatcatgatattcattgccccagctgttgagggtattgactggtgatggcttaaaactgaggcctttcctgggtgctgccgtggctgagggacctacctcacccaaggttacacacgtccccagagtgcctgagctgattcaaggactcaaaggctcaacagtctcatctcaggtcagggcaattctgaagttatcccagctctagagcttctgtgggacctgctgtgacctttgttgtgactgcacaggtgttcagcctctctctctgccccatcctgtttttgtttttgttttttacagtgttgttttagagagcattcccaataaacctcctacatgcaaatgttcatctcagcatctaagacaggtaaattctacatttaccttgtaggattttttctaccaggattaaagtcaatgtatgtattaagcaaatgctcattgtaatgctttaaaagccatgatctacatagttcagtcctagaattaagccagaattaaaatacagtatattcaaacagaataattccaaaataacttcagttctttacttatcctattaggagcaagactcttgcttgtaagttacaagaaagccaagtaagacttgtttaaggaaaacacaggcttatctacctatacatgtggttggtggggaccattcatgaacctatagggtccaggggtagactttcatgcacatctggatccaggggacattagctataggcagtcatctagaggctcaactagaacaccagcatatctgggtcttttccttctccatgcaatggcagcgcttcttcttccccttgtgctctgtcagcaggctagctagacttctggtatggtcactcgggactcctaaaagtgcaatagtcactgctgtgttatgatatgcagcttcctgttgtgtgccatgccatctcaatgtttggttcaaaaatcccagaatgtcactctaacacctcctgaattagggttgggttctcaagaaaaatccccgaatgtccctctaacaccttctgaattaggattcttaagagaaacaggaccaatagggtgtgtgtgtgtgtgtgtgtgtgttgcaaggaattggctcacatgattaggcaagctgaaaagtttcaagatctgcagtcagcaagctggagacccaggagagacaatgctgtagttccagtttgagcccaaaggcctgagatccaggagagtcaaattacgtaagttacaatttgaacatcagcaggcttgagacccaagagccagtgtttcagttcaagctcaacggcaggaaaagaccaatatcccagctggaacactcaggcagaaggagttccctcttacttggcctttttgttttagtcaggtcttcacatcttctattgattacatcaaatcatgggccagaacaactacacagaaaaccaatgaggaaatagcagacttgaactacactatcatctgttagatataacatacatctatagaacacttaacaacagcagaatatattattctcaagtatacatggaacattcttcaggataaatcattcactagatcgtaagacaaccctcaataagtgtaaaagaactgaaatcaaacaaagtacgttctccacagggcagccctgtgggactacacagaactacacaagagtgagaataccaggtgttcactggggctcatcattagggaccagctcccaaaggctacctggacaaaatctacttacagacaaaaagcaaacagttttgggcatgtcgctggctgctccctgaaactcctttggttttccatgttcaggctttggatcttggtaaatacaaaagttctttggaggactaacacaccaaacttgtatcagtcacttatatctttgtaaaaccaaagatcttcaatgatgtgataaaggaaggatatacatcaaagccctgggactcaagatgggaataaaggagctttactgaaagatgcgtggggcaggctggatggcaaaatcagattcagaaactgacctcactcacttttatagtttccatagtgctaggcctgcttaggtccttcataggtagtaatagccaagtttctctccttcggggcatctttaataggaatgtcagcccaagtccaaagccatgcagctacaatagcacaattttggacaggtaccaaaattgggaaggaatggggttgggggcattagagccttcctagagccaccaaaatcacaaactaactgcagtctgttgatagccttttaatggacatcaagatatacttactagagcaaaggttctgtccttttcccttaagatgatgcctctcttagggattggagagcaatcctaatttacaaatcagtttttggaaactggtttgtaaatattgacatcatagttagtttgacctcagtaacccaaagctaccaacaatggcagaagagccaaagggttcagcgtgattggccagtctgatcgtttttctctttgatttcagaaggcaatgattcctcaagtgtgcttggaatggaaattataaacaagtcattgctttcttcttatgtggaggtctgccatgtgagccgcatatttcaagtcttacctgcacctagcctttggcctgaaatgtgtcattgaatcaattaatgcttttaaatggctcactttactccatttttctgcatacattcagttacctaattctgttagcaaaggctattgatgggtctaagaaaaactgaaggccttcatctctggcaaagattcgtaatttgtgatgttggtggttactgcacccaaagtttccaacttaattgggaacagtgggaagtaatttagttgtgactgtttctctagctgttaatttagctgattttcattctattaaggctttaagggaaacaattccaaactaattagccagaacttccatttggtagtacagtagtcagttataggtaggacatgctgggtgtttcacttgtccaggcttcttatggtaaattctgcaagggtgcccaccctcagctctggatacatttggcatctagagacagatcttcgaaaatgctggtgtttataattaaaaccagagtctgttcggtgaccaaacactaaaactgcttgagttttgtttttctagctgaatttccaatgacaaaatatcacaggcgttttgtttattggctcttcccaggagaactgctgctaagataatatctaaagcttacaacattgtttaaaaagagaagtaagcattgtaacttctctttaaaaaagataaagcaaatactttccacttcattattttattaagactttagtgattttgaaaatctgatttttgtctgctaatgcttgtgaactaactgtggtttttctaagttttccacaggactgttcaagcagatgaggcacccccatgttctgagatctttacaaggcacagagaatggtccagctcacttagtcatcttccaaagccaggaagggggctcagcccagttctgcaggaacagacctaagcaccaatgatccctgcgtcaggtagttctagcagctgtctttccttcttgcacaggtaattctatgctacacagccccaaaacaaaagcttcctcagtggggtcatggtaaaaaagacttttttttttttaagacagagtcttgtgctgtctcccaggttggagtacagtggcaagatcttggctcactgcaacctccacctcctgggttcaagcaattctcctgcctcagcctcctgagtagctgggattagaggtgcccgccaccacacccagctaatttttgtatttttagttgagacagggtttcaccatgttggccaggttggtctcaaactcctgacctcaagtgacctgcccaccttggcttcccaaagtgctgggattacagccaatgtgcccagccccagaccgtcaattttaagctgcaaatttggtttggcaaatttggccaaaatgagagaaatctgattgcatttctcccacctgcaccatcagccactccctttgcagctgagtctggtaggtgcttctccttccctgccaaggacacactccactgcttcctaattgcctgagttttcagtggcagcttagatgttggccaggctttaatcagcctgggaaacagagtcctctgtcagcacatttgccactgaggcctgatgggaatgtgtgtgactacacagcaacaaaacggattcaccagccacatggggaaaccagcctcattacttcagagtcacgtcacgtggtctccttgggccagcaaccgctcttcttaattcctgctttcatcaggccatttgtcttaaactacatgcttgtctcatctcaaaattcattgtttagcttacatacagtggagacctgaggattaacacatcacggcactgaggggaaatgacttgttctcattcactcattattcagcaaccatttatgaatgtctgttcagccattagatagtctagattttccaagatagctctgtttaaggaaattttgaggctgggtgtggtggctcacgcctgtaatcctagcagtttgggaggcaaaggcgggcagattgccaggagttccagaccagcctaggtaacatggtgaaaccccgtttctactaaaacacaaaaaattagctgggcatggtggcgcatgcctgtaatcccagctactcaggaggctgaggcacaagaatcgtttggacccaggaggcagaggttgcagtgataatcaacctcagctatcacagctgagatagcgccactgcactctagcctgggcgacagagtgagactgtctccaaaaaataaaataaattttgatattttacataaaagcaatttattaactatacattaaatatgttcttaatacttgaggtgtagcatcacgattctgagaaaatgcttatcacaactgaatgacagaatccataaacagagccaaactgagtcttaagacaagaaatgcccttccaaaaatgtaaccttacaccttctctaggggagaagagttcctggtgaataaaaacacagggtccattctgtgatatgaaacaggactttgcaaagtgttttcacggatagctcatttctagtttttaaagctgccccttgtttggaaacaacagccacttcttgcagaaagaagacacatgtgactgtgtttatatctctgaagacagaggcaggattaaggtagtctgcaaaatctgactttttacaggaagaataactcttataaatacacaaaataggaaaacaaggggagaggttgcatgacgtgccccaaatttgcgatttgacttgctgtatattagtatctttgttaggagcaaagatggataagccgtaattcctgcttctaatgtgttcactgtagcaggggacaggaggtgtatataccaaccgttctaataggagttggaaagggacaagtgttacaaggaagaaaacacgggcactgccgagaaggacattaccttctgccggaaaggccacttagaggaagcatttcagccagtgttgaaggacccaaaagctttgcaatagcagagatgtgtggtcaggtgttgaaggcagacaaaatgtgtgagcaaaaatctgccaagaagggtaatagagtccaggtcgtgggaggacagtacagtgagatgaagagggagtgacaaattgatcaatacatctcaggttagcgaacctggacatcatttagcaagcagtgggggaagggtaaacctgaaagttattaaggttgggagtcgggggtggggcatgatcggagacgctaatacggaggtcttgagtagaattgggagagacgggagatacagggaggacaagaggaatgcaggggactgagaaggcagacgagaccttccacagtgtgcaggaaatggtcaggccccctgtgcaggaggaagaggactgttgatggaaacctgtggccacagaggcttctggcatctcacaaagcctttggtgtcagtctggcaaaacactctggccgggaacaagggatgctgggtgagtgagagcagtgcccctcaaaccttaatgtatgcacaaaccacttgaggattttgtaaaaatgtggattctgcatctgtaggtctgggtggggcctgagagagtgtacacattttcaacaacttccaggtgaagctcatgctgccggtccagggaccaccctttgagtagcaaggagctagaactactcacatttgctaattttaggcagtgatttataacagttggaagatctgtgagacagtgacccaattgcgtctaagtgttcttatttctttaaatctcactctaaatgtagcaggaagctggcacatgattaaacttgcatttgtttcttagattctaatttgactcatggaaactgcggtcctctccccaggagggtgtgtgtggacagcctttctgggtgtagaagttgtaagcaacccctcaggacaatctgcttccccatgtatgggggagtgggaggatgccaaaaaggggaaagagtcccagaagcctcccttctgtattagggggcctataggagcagcttcgggaccctgcagaagtcaaggaaggaagaatactcatccagaagtgatggatcctcgagcccatcctgactcagtgtttggagtcagtttgcagcctggaagaggctggggattacctcgaggtaatagtctatggtgggaggctgatgaccaaaatggcagcaggaaagcaggaatgtcacgtttggggcgggcacttgcaggctgatggcatctagagctgctcttcacagctccaaaaagtcctgccagcttgttccctgttactctatggggccctttatttctgggagaccagctgtatcttcacatcagccctcctggagcagaggcccctggcctttgtgtgagtcaagagggctggctttgagcttctcttggagctggataaggggtgtgcatgcccgtgaatgtattttgagttgtctacttataggataaccgtttgttcctcttcatcatcttaggccatatttctcttaatgatctacttggaccattttggggtcatcctattttcctctcctgggatggccatgccaggctgcttatttgcataatgtggccctggccccttctaacctcacttctgaggtcagatttccagctcgacccagtaagcctggaggaccaggcactgccctggacagtgaggctcaaggctcccgtgcagaacccatgcccaagcaatcatcaattattctaataattagaggtgtggtgtaacatgtgggggctctggacttaaacagcaagggttcaaatcctggctctgccaaatagttacatggcctgcttctcaaggacctgcactttggggccagcctaaccgggatctctattctgaatcctcgccttctccttgtgagaccttgggcaggtcacacgatcactcttgagcataggtttcctcggccataaagcagagatgatgacactctctccctcatagggttgtggtaagaattgagttatggaatgggtgggaagcatctcaaactgtgtgtggcgcaggggaagcacccaataaatagtagctattaccatgaaatgatacttagttaataagtaaggagttgtagttgtgggttttattagaaacaaagtaggtacgtctgcttcttagtccccatccctctgggaagccagaccacgagctcgtaaatgcttagcatggcgtccacctggtggccgcatccccaaatctctcatcaaaaacctggaggaaatgaaaaggcttgtaatttataaatcaaggcttctcatgggggccaggggaggagaggggagggcaagcacacactctggggccttggtaggggcctcacaggcagctcgaaaacaaagcggcactttgtcctggggcccggctttgctttttgtcataatatttaattaattttgaaatttcacataacattaaagtgtgagatatttacagctgctaaagaagggaacataggttaaaaaggttgagaaatcatctataacctataaaacacagcaaagcccccaggaatgtgataggtacagggaggcattgggctcagcacgttctgccccctctgcccagtgcccacctatccccagggtggcagggggtggtggagcccacgcagtccagcaagctgcctaattggaaaaagctggcacttctgtgttctggtcatttccttttgctttgtaatgcaaatgagtgaaacttgaaaaaatgttctttaaaaaccgtttgaaacatgatgcccagtcatccttgggttttcattattcttccacttatgccttaggatgtggggcatacatcctttattcaccctgagaagcccatttgccaccctggctaaatacaaccccttcataactcttttattcactcttttaatttttttataccacaggcttaataaaatttaaaaagtcaataaaagtgaaaaaatatacttgcaggagaatgcacaagtatatggctttttgaattgttgcaacgtgaatttgaccaatcacaaaacagaattaccaccgccacccccccagagggtgagcacagtcctggcttagaatggcacagaatcgctttgcttgattttgagctttatgttgtaaatggaatctcacaggatgtactgtgttgtacaggatgtatgatgttagggacacacatcatccatgttgctgggtgttgttatagacccttcattcttgttgtatagtgtccatggtgtggtcctccatggttggatatgtacccagtggaggtgcgcatgtgtcccctgacaggatcggtcccagggattggcatgtggcctaggtgggcccactgggatttcccaaattggaagggaaattggataggtatctctcctcctcatgagaaagggtatatcatagcagattggagtcaggccatctgtgtccaatcctggctgtgtcacttactaggtagtgggatctggtatgagttattacacctctctgtttcctgtgttaatttcctcttctgtaaaaggagataataacagcatctactccatagggtgatttcaaagattaaatgagtgcgtagaactgtgccaggcacgaattaagtgctgataagtggacttttattcctggatggtgaactgtgaaggtgtgaggctgggctgtggtggtcactgagctgcttgcagtaagaacgttgatttccctgaggttccctctgcaccctgttgtctgtcatgcctctaagcctttgcacatgctcttccctctgcccagcttatcagcttcccttttattcccacagaaaatttccattcctctttcctgtctcagctcaaagggatggaccagtcctgcaggcatccttcccacattctcccaagcaaatgctatccccatccctgctttcattgttgtgccacagcagttctcaaagtatgatctacaaaccccttttaaaataaaattttaaataaaaatttaaaaattaataaaagtaaaaaatatactgcagagaagtgaacaagtgtatggctttttgaattgttgcaaagtgaattcaaccaatcacaaagcagaacattaccactaccacccctgggagggtgagcacaaccctaagaggtgatttgccttgttcactgtgttgacatttgcactgatgatgcaaaaccattgctgaatgaatgtaacggcatttgcataaatcaagtggcacctggccgggtgcggtggctcacgcctgtaatcccagcactttgggaggccaaggtgggtggatcgcctgaagttaggatgtccggaatttattccttctggcgggttcttggtcttgctgacttcaagaatgaagccgcggaccctcgcagtgagcgttacagctcttaaaggtggtgtggacccaaagagtgagcagtagcaagatttattgtgaatagcgaaagaacaaagcttccacagcatggaaggggacccgagagggttgctgctgctggcttgggtggccagctttttttcccttatttggccccacccacgtcctgctaattggtccattttacagagtgctgattagtgtatttacagtcctttagctagacacagagtgctgattggtgggtttttacagagtgctaattagtgggtttacaatcctttagctagaaacagagcgctgattggtatgtttttacagagtgctgattggtgcttttacaatcctttagctagacagaaaagttctccaagtctccactcgacccaggaagtccagctggcttcacctctcattaggactttgagaccagcctggccaacatggcaagaccctgtctctactaaaaatacaaaacttagccgggcgaggtggcaggcatccataatcccagctacttaggaggctgaggcaggagaatcgcatgaacccgggaggcagaggttgcagtgagccaagattgtgccattgcactccagcctgggtgacagcattaagactctgtctcaaaaaaaaaaaaaaaaaaaaaaaaaaaaatcaaatggcaccaaactgtactactagtcattggactttcatcatcatgtactcattgtaaagaaaggaaaaagaaaagccagtttcgtttaagaatgtctttgatgaggcagtaaaaattgttaaattttgacccttgagtgcatgtacatgtatttttaaatattctgtgtaatggaataggaattatgcatgaaacatttccgtatactgaagtaggatggatgtctcaggtaaaaacacctgtgtgaatgagttacaagctgaattagctgccttttctgtgggacaccatttttacttgaaggaagaagtgacagactatagttattcagacttggatatctagcagagatttcctcaaaaatgaataaagagagcctgtcacatcaagaaaaataattgtcagtacttggtgccaaagatcaaagtagaactttcaaataccaattaaaattttagaaaatatataaatgccaccatgagtttaaaagtgtcctgtacttaaaaacttttctggtgagatacatggagatattcatgaatgggaccgagccagaatcttaccttgcactctttaaaataattaattaaggagacaaataataattgtatatatttatgggatacaatgtggttttgatatgtacatttctacattgcagaaagattaaattaacctaattaacacagccatcacctcacctgcttattcttttgtggtgagaatgtttaaaatctactcttttaacaattttgaaatatacaatatattattatggattatggtcacctcactgtgcaagatcagatcttattcttcctaactgaaactttgtatcctttgactaacatctcccctttcctcaaccctgcccagcctcactgcctctggtagctgccattctgtttctaacaacttgtttagactccacagataagtgagatcatttggcatttatctttttgtgcctggctcattttgcttagcataatggtctccaggtttatctatgttaccatgaatgacagaatttcctcctttttaaggccagatagtattctatcatgtgtatatataaattttctttatccatttatctgttgatagacaggttgttttcatatctttgctattgtgaatgatgctgaaatgagcatgaggatctatatatctctttgacatactgatttcaactcctttgggtatatacccagagtgagattgctggatcatatggtagttctatttttagcttcttaaggaaactccatactgttttccaaaatggctacaccagctggatgtggtagctcatgcctgtaaccccagctacttaggaggctgaggtgagaggattgcttgaggccaggggttcgaatctagcctgggcaacatagtgagacccccccatctctagaaatagatggatagatgaataaataaccaaaatggccatactaatttatattcctaccaacagtgtaccagggttcccttttctctacatcccggccaacacttacttttttctttttgataatagccatttaaacaggtgtaaggaaatattgtgattttaatttgcatttccctgatgattagagatgttgagcatttttcttgttgtttatctgttggccatttgtatatcttgttttgagaaatgtcgttctgatcctttgccattttaaagttggtttttaaattttcttactatttacttgtttgagttccttatacattttgtgggggttttgttttgttttatttttcttagagccaaggtctctgtcacccaggctggagtgcagtggtgtggtcatagctcactgcagccttgacctcctgggctcaagcaatcgtctcacatcagccttcctaatagctgggaccacagacacatgccaccacatgcagctgattttttttaaaactttttgtatagacagtcttgctatattgcccaggttggtcttgcactcttggcttcaagcaatcttcctgcctcagcctcccaaagttctaggattacaggtgtgagccactgcgcctaacccctgagttcctttttggatattagcctcttatcagatgtatggttgcaaatattttctccaaatccatgggttgtctcttcagtcttaattgtttccttcactgtgcagaggattttttagtttgatatctgtttgtctatttttgcttttgttgcctctgcttctgttatcatatccaagaaatcattacccagttttgttccactctttgtacataccttcccctctccaggttgtggcagtcctcctcctaataccaatgccataccatccacgatcttcctcccctctagttactattctgcacttcacccctcagacatactgtgccactgtgattgacagaagaattaacctggggaggagctgggctgacttccaggggagcagcccctggaccttagccttgggaggatgacacctgctgtttggtcagcccctttgcttgggggtccaggagggattttaattccagtagtgggaggttaaagccagcccatgggaagaggctagtgccttggaggctgacaggagagaatggtggggacaggctcccgttacaagcccttgtactcacatccttgcttctgcctagaagtccatgttggggccgggtgcagtggctcgcgcctgtaatcccagcactttgggaggccgaggcaggcggatcatgaggtcaggagatcaagaccatcctggccaacatggtgaaaccttgtctctactaaaaatacaaaaattagccgggcgcggtggcgtgtacctgtagtcccagctactcagtaggctgaggcagggagaattgcttgaaccagggaggtggaggttgcagtgagctgagatcgcgccattgcactccagcctggcaacagagcaagactccatcacaaaacaaatcaaatcaaaacaaaacaaagaagcccatgttgggaagcagttgtgaaagggggagggtaactggtgtattctcttccgcttttttaggagatgggcagggttattgtccagcatgtctttatttgaaactgcaagtaggaaggaaacttcagagtcaccaaaatctcacatctttagtctacagggaaaaagactctcttaaccttcagtaatcatagaaaagccttgatattaagtatttattggtaactaatattattctttggcaattattgtgaaataccttttaaaatcccttttgaagattatttttcttaagacatcaggatctctgatgtattattccttttttgttttaaactttttaacatattattttgaaatctgacactcaaaagaaggtgtgaaaatagtacagtgagtaatttcctttatgtttgtcaccgaactttccccagtgataatgtcttacatgatcatagcacattatccaaaccaggaaactggcattagtacaatactattaactaaactatagaccttatttgttctattgccacaaagaaactctcttgtgctacccctttgtagatgtgttccattagtcttttgtgtgtttgtgtgtgtgtgtgtgtgtgtgtgtgtatgtgtgtgtgtgtgtgacagagtctcactctgtcacccaggctggagtgcatggcacgatctcagctcactgcaacctctgcctcccaggttcaagcgattctcctgcctcagcctcccaagtagctggaattacaggcatgcaaaaccacgcccggctaatttttgtatttttagtagagacaaggtttcaccatgctggccaggttggtctggaactcctggcctcaagtgatccatctgcctctgcctcccaaagtgctgggattacaggtgtgagctaccacccccggcccattagtctttaaaatactgtttttccttatttgagtgaaagttatactttatataaagtatatgtgattagaatcaatggagtctagtgtagtgccatgcatgtagcaaattgtgtggaatttaaggctgaagaactagagaggccttctgcaaatattgacttgacagcccaggggctgtgtgattttaggcaaggaatgcaacctctctgagcttcagttttatctgtaaaacacagttaatgactcccactttgtagagatgctgagcagattagatatgaagcatatgaagatcctgggacgtcccaggtttcctgttcatgttcaatgtcttaagtcagtttgcccaggaagccgactctgagatggagaagtgtatgcaggtcatttgtttggaaagtgcttgcaggatcaacacctgtgagctgggaggtacacaggatttgacagagggagaagttgaactatgatgcagttgccatacaaggcctctgaagatgctccagggagctgggatggccctccaaaattgtccaggcctctgtaccccggcaccaaccagctgttgtattgtgggctgctcttggggagggacgaaatcttgagcaggtcagctcccttcagctgagcgcaagacctgaagacacagaactgtgagccttcggcatctaatgctcccggcagctggaggctgggcgtcttagtactgaacaggaatctgggagcgagtcacagctgctactgcagtcattattaccatgatggctttgaggaaggaggactcaaatggggagacaattgatcatagatttttcatcctccccacatgttagccatgttaaacccaggcaactgaatggcttgataactccacaaaaagctgtttctttttctgttttagggcattagaagggatctatttacatctttaggaagagctattttagaggagggggaaaaaaaagcaatgggtctcactcttctttatagctgctgatgggaatttcctaaatttctctttgccagctctataaaagaaccccatcgtgtgcaatcctcccctatataaggactgcctagaaatgagttctgaaatcagacttttaatgacttttcaagaaatcccttctcagactgccaaggacgagttggtatcagaaatatgcagtaattgtgtttatttagtaatagttggacgtctaccagaaggctctgagctaaggccactgggggataccaaagaagagaggctaatcctccaaccagaaggttccattttgtgccttctctcaatacatggccaatttgtgatagagtaaataagggaattttgaaagcaccaaattgagtacttagtagatgtatcatacctatggactgattatgatccttatggttcatatttaaatttgatttggtgtaatctataaacatcatgatgtcatgatcccttttctaagggaaagatcttacatgctagagtaaagcacatctcttctgtgcaacatcatgagttttggaatggaataagttttcatgagttttcctgatttgttagtctctctggagcaaattcctttagccagttattcaagcaactatgtgcctttatttgtttataagatacagtccacagcacatactaatagtgaaatgataacatccaagaattttcagccggccacagtggctcatgcctgtaattccagcactttgggaggctgcaacggaaggatcatttgaccaggagtttgaaaccagcctgggcaacatagcgaaacctcgtctctacaaaaaatttaaaaagtagctgggcattggggcacacacctacagtcccagctacttgggagactgaggcaggaggatcatttgagcccaggagtttgaggctgtactcagctatgatcatacaactgcacagtagcctaggtgacagagcaagaccctgtttctaagaaaaggggagggggtgcatttttctgccagaagggttgataaacactttttgtctttctctaacattcatgctgggtattatagggtagatgtcttcattagcacatagtgtcgtatctgtgacaaaggtataagacctcatgctgcaggtcactgtctacatctctccctctgtctgcctctctctctgtttctcagccagaggagagcccctgcaagatggaggaaggtgacattaccctggggggacttaagtggcacatgtcaccacttacttcctcactcaaggaaaagtctggggagcaggagcaagatctgttgtccctttgtaaccccacagggacttgcacaaatagagttggtgattaataactgttggaggctgaacagacttttctgtgaccccttattagcagtgccaggatgcgaagattgctcatcagccatggtgagcaccacaaattagtcatgtttggaggcagcaggtttctgatggttacatcagagatctgggctcattcctagaaacatcactgggcaattttcctttttaaatcagaatcgatggtgaacttatctactggatcagttaaaatgtcctggtctgagagtcagacaaggcctgagtttagaggcttgtgaagccacatgaccttagataagtggccaaaccacctaaaggtacacttttctcatcagttaagttggttgatactaacgttactgccctcataggcttgttttgtgagtcagatgagctaatacctgcaaagtgctgggctcacaacaaatgcttgataaatgttggctattattatcattattagggtaaccatatgttttctaaatcaagatactttgacagttaaggagggcagaaaaattagaatgttaacttttctaaaagatttatttcttgaccagtaaattggtttatattagtggacctataaaatagttctattcaaaaactattttcaaagataaaatactttcaaagaaaaaatagcaggaagtcctagccagagtaatcaggcaagagaaaggaaaaaaaggcatccaaataggaaaagaagaagataaattatctttcttcactgacaatatgatcctatatctagaaaaccctaaagactccaccaaaaggctcctagacctgataaatgatttcaataacgtttcaggatacaacgatgtacaaaaatcagctgcactttctatacacaaataatgttcaagctgagagccaaatcaagaacacagtcccacaaaaaagataaaatacctagaaatacatctaaccaaggaaatgaaagatctctacaaggagaactacaaaacactgctgaaagaaatcagagatgacacaaacaaatgtctaaatattccattctccctctccctctccctctccctctccctctccctctcccttttttttttctttttctttttttttttttttctttttttttttttttttttttttttttctttttcttttcttttttttttttttttttttttttttttcttctttttctttttttttttttttttttttctttttttttttttcttctttttttttttttttttttttcttttctttttttttttttttttttttcttttttttttttttttttttttttttttcttttttttttttctttttttttttttttttttttctcttctttttttttttttttttttttttctttttttttttcttctttctttttctctcttttttttttcttttttcttttttcttttttttttttttttttcttttttttttcttctttttttttttttctttttttttttttttttttttttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactacaacctccacctcccagccgcctgccttggcctcccaaagtgccgagattgcagcctctgcccggccgccaccccgtctgggaagtgaggagtgtctctgcctggccgcccatcgtctgggatgtgaggagcccctctgcccggccgcccagtctgggaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccaccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccagcagccaccccatctgggaagtgaggagcatctccgcccggcagccaccccatccgggagggaggtgagggggggtcagccccccgcccggccagctgccccatccgggagggaggtggggggtcagccccccgcccggccagccgtgccatccgggagggaggtgggggggtcagccccctgcccggccagccgcccggtccgggaggtgaggggcgcctctgcccggccgcccctactgggaagtgaggagcccctctgcccggccagccgccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcggccccccgcccggccagccgccccgtccgggagggaggtgggggtgtcggccccccgcccggccagccgccccgtccgggagggaggtggggggggtcagcccccctgcccggccagccgccccgtccgggaggtgaggggcgcctctgcccggccacccctactgggaagtgaggagcccctctgcccggccagccgccccgtccgcgagggaggtgggggggtcagccccccgcccggccagccgccccgtccgggagggaggtggggggggtcagcccccctgcccggccagccgccccgtccgggagggaggtggggggggtcagcccccctgcccggccagccgccccgtccgggaggtgaggggcgcctctgcccggccgcccctactgggaagtgaggagcccctctgcccggccagctgccccgtccgcgagggaggtgggggggtcagccccccgcccggccagccgccccgtccgggagggaggtggggggggtcagcccccctgcccggccagccgccccgtccgggaggtgaggggcgcctctgcccggccgcccctactgggaagtgaggagcccctctgcccggccagccgccccgtccgcgagggaggtgggggggtcagccccccgcccggccagccgccccgtccgggagggaggtggggggggtcagcccccctgcccggccagccgccccgtccgggaggtgaggggcgcctctgcccggccgcccctactgggaagtgaggagcccctctgcctggccagccgccccgtccgggagggaggtggggggtcagccccccgaccggccagccgccccgtccgggagggaggtgggggggtcagccccccgcccggccagccgccccgcccaggaagtgaggggcgcttctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaatattccatgctcatggataggaagaatcaatattgttaaaatggccatactgcccaaagcaatctacacattcaacactattcctatcaaactaccaatgtcacttttcacagaattagaaaaaaactaccacaaaattcatatggaaccaaaaaagaacctaaatagccaagataatcctaagcaaaaagaacaacgacagaggtatgacattacctgacttcaaactatgctatcagactacaagaaccaaaagagcatggtacttgtacgaaaacagacacatagaccaatggaacagattagagagcccagaaataaagctgcacacctataaccatctgatctttgacaaagttgacaaaaataagcaatgggaaaaggactccctatgtaacaaatgatgttgggataactagctagccatatgcagaagaatgaaactgaaccccaacttttcaccatacataaaaattaacttaaaatggattgatgatgtaaatgtaagacctcaaactataaaaactttagaagaaaacccaggaaatgccattctggacattggccttggcgaagaatttatgattaagtcctcaacaacaattgcaacagaaacaaaaattgataagaggaacctaattagatgaaagaggttttgtgcagccaaaggagccatcaacagcataaacagacaacccacagaattggagaaaatatttgccaactatgcatccaacaaaggtctaatatccagaatttataaggaacttaaagcaaaaaacaaccccattaaatagtgggcaaaggacatgaacagacacttctcaaaagaagacagacaagtggacaacaaacataaaaaagttcatcactaatcattagagaaatgcaaatcaaaaccacaatgagataccatctcacaccatcaaaatggctattattaaaaagacaaaaaacagggccaggtgtggtggctcatgcctgtaatgccagcactttgggaggccgaggtgggtgaatcacctgaggtcaggagttcaagaccagtctggccaacatggtgaaaccctgtctctactaaaaatacaaaaattagcctggcatggtggtacacgcctgtaattccagctactaaggagactgaggcaggagaatcgcttgaaccaaggaggcggaggttgtagtgagctgagattgcgtcactgcactccagcctgggtgacgagtgaaactccatctcaaaaaaaaaaaaaaaattaaaaattaaaaaaatagacaaaaaataacagatgctgacaaggctgctaggggaagaaaatgcttatacactgttggtgggaatgtaaattagttcaggcaccgtggaaagcagtttggagatttctcaaagaactaaaaacagaactaccattcaaccctgcaatcccattactgggcatatatccaaaggaaaataaatcattccacaaaaaagacacatatatgttaatcacagcactattcacagtagcaaagacatggaatcaatctatgtgcccatcaacagtgggtggataaagaaaatgtggtacctgtataccatggaatactacatagccagaaaaaaagaatgaaatcatgtcctttgcagcaacatagatgaatctggacaccatcatcctgagtgaattaatgcaggaatagacaatcaaattctgcatgttcccacttgtaagtgggagccaaatattgggtacatatggacataaagatgggaaaaatagacactggagacttttagaggggagagatggggaggggacaagggctaaagaactatcgggtactacactcactacatgggtgacaggagaatttgtgccccagacctcagtgtcacacagtatatccatgtaacaaaccttcacatgtaacccttaatctacaataaaagttgaaattattattagtattattattttttgagacagagtcttgctctgttgcccaggctggagtgcgatggcgccatctcggctcactgcagcctccgcctcccaggttcaagtgcgtctcctgcctcagcctcccaagtagctgggactacaggcgctcgccaccacgcccagctaatttttgtatttttagtagagacagggtttcactatgttggccaggctggtcttgaactcctgacctcaggtgatcctcctgcctctgcctcccagagtgctaggattacaggcatgagccaccatgcctggccaaaattattttttaaaaagaaaatggcatatatttgtgttcattaaagcaaatttgaaaacttatgttacctgaaaatttaaaaatttaaaataataactcgatatattttacatattttaatttcttggtctatctgtcatggtatttttctgcagagtgtattttttagtagttttactatttctaactttttttcataaaattatctgtatttggggcttaaaaactttgaaatgaatacttgcaattgattcttccttatatataaaaccacaatatatttaattgaaaaaatttctctgtagaagtgatggtgccttgtaagttgaaaactattctgctaagtaaagaccattctcaattctaatttttaaaaatattaaatgtgtgaccaagcacggtggctcacgcctataatcccagcaccttgggaggccaaggcgggcggatcacgaggtcaggagattgagaccatcctggctaacatggtgaaaccctgtctctactacaaatacaaaaaaattagctgggcgtggtggcgggcgcctgtagtcccagctactcaggaggctgaggcaggagaatggcatgaacctggaaggcggagtttgcagtgagctgagatagcgccactgcactccagcctgggcgacagagcaagactccgtctcaaaaaaaaaaaaacaaacaaacaaacaaacaaacaaacaaaaaaaattaaatgtgtgacgaatctagcttaaatattctcttaggtacttttgacctctattcagagagcctttcattgatacaacttgtcaaataggttgtctctatttacgattcttttgaatggttcaccaaatttaggtagttcaaaattgtaaaccttctcaattacattctattctgggacagaatctaaatccaaataaaaatagaggctccatcaaaatattcttctcacaagttgagatagtccagtgcacaattatagcatttccaaatttgtactttattagagctgtcattaacccccctcccctgctagctttgagggacacattccagtgtcttcctttgcagagctagcttgatgggcttatgaaccgcgcagtcacatggaacccagtgcttagaaggaccccgcaatgggtttcatgttctgctgccaccatcttgaaattcttaattttatttatttaggggacagagtatctctctgtcgcccaggctggagtacagtggcgtgatctcagctcactgcaacctctgcctcccaggtacaggtgattctcctgcctcagcctcccaagtagctgagactacaggtgcctaccacaacacctggctaatttttgtatttttagtagagacggagtttcaccatgttggccaggctggtctcaaactcctcacctcaactgatccaccctcctcggcctcccaaagggctgggattacagatgtgagccaccacaccagccaattcttaatttttgaccaagggatcctacaattgcaattttactctaggtcctgccaattatgtagctgattctgcctatttgtcaatttggttttcagtaattgtaattctctaaaactttcaagctcaaaagctgaaggtttaaaaagaacccatttgctcaatacattaattcccgtttagaaaaaaaaaaagtgcagcttgctgccagtgctcatttaattttacataaacacactctttgaggctaaagcaaatctgactgattttcaatgtgaaaataaaatataaaaactggttcttggagttacttctaaacagaactaacatcagaattgcctatctcggaaaaatcagattcatcaaatgactctttggccaataactgtttgagaacaatgttaacatcaggcataggagtgctacattttctaagatttgacattttcagtgatcgagaattacattttgtaaatggaaataccactactaaaattggatactgtaaataaaatgatatcttttgtttccaaagttgatatactcgagcagcgcgaaagtaataataaaagcaagatatttcgtggcaaagttatctcagggtaaacgctgcagctgcaagcgctgccggcaagtattctcggggcaaacggggaaagggttaaaaacttccaaattattttgaacaaaatgcaaccaaaattcggagcattgtagaacatttaggatgatttttataaagtagtttatcataaaggctttgctgtttctaagtcaatgggtaggcagcagggagaattttgtgatccgtgtgtgtgtgtataaaaatttgacaattcagctttcatttccattggcaggccactacagcttgtttgtacaatgtgctaattatacacattccactgcagtccaagtacatttctgctccacaggctcttgatttagtaagaatactgtttcccccaggattctggccactaaaacttattacctcaacagcaaactttctcttcagtgatgaaactttgaaactggatttatgatagcggtcaaaatgatgacagatttttttacccaaaggtaaaaacagaatgaactttccaacattttaattttatttaatacgttcattttttaaaagaactattattacaatggactgatttctcattggaagcagctgatgaccctgatataaactggtgtcaaacctgttagcatggctataattaaaaagttgagataatgtgtgttggtgagggtgtggaggaaagggaacccttgtacactgttggtgggaatataaattagtacagtcattactgaaaacagcatggaggttctgcaaaaaattaaaaataggactatcatatggcccagcaatccctctgccaggtatttatccaaagagatgaagtcaggccgggtgcaatggctcacgcctttaatcccagcactttgggaggccgaggcgggcagatcactggaggtcagaagttcaagaccagcctggccaatatggtgaaacccccgtctactaaaaatacaaaaattagccaggtgtggtggtgtacgcctgtaattccagctacttaggaggctgaggcaggagaatcgcttgaaccaaggagacggaggttgcagtgagctgagattgtgtcactggactccagcctgggtgacagagtaaaattccgtctcaaaaaaaaaaaaaaaaaagaaaaaaagaaaacaaaccaacaaaacacacaaataaccaaagaaatgaagtcaacacctcatcgagatatctgcgctcccttgttcattgcagcattattcacaatagccaagatatggaatcaacccaaatgtctatccaatggaggaatggataaagaaactgtggtatctgtatctctctatatagatcaatacaatgcaatattattcgactttaaaaaagaagatctttccactgatgacagcatggatgctaagtgaaataaggcagacacagaaagaaaaatgtgcatgatctcttttatacatggaatattttttaaaagttgactacatagaaacagtagattgacagttactagaggtgaagtgggtgcagggggtgcagaatggagagctgtagatcaaagggcacagagttgcagttatgtgttaataggatgaataaatctagagagtggaagtacatcataatgattgtagctaataatattgtactacatactggaaattttctatgagtagattttacatgctcttaccacagacacaaagaaggataactgtgagatgacagatacattaattgacttgactgtagtaatcacttcatatatcacttcaaaacattatgttacatatttataacataaatatattcaatcaaattgaaataaaactggtgtcatgtcactgtttacacagtactcattctgctaaaggagactcatttgcagctaatacttaatgtttcaggcatgcaccagaaaattgggagtggaaaatgaatgaaattattttagaacagttattgcatctatgtgaaaaattaagcttcgcagaataatataaaaacacacctcatgcagctgtgtgtgttataataatctttgggcatgatctacttaaggtaactactgacttttgaagtaaattctgatgcttcttcagaaaattcgcgttttctggttttcaggtgaccagtgttatcattatgacatcccagcagtggatgctagatatcaacaaatattttttgcaagttacacattcatctacaacctaatattttaatttttcactaaaaatgtgctttgaccttttcaagctgattgattgctgccaaggggtttattgcaaaagaaatgtatgttaccaaacaatgcaataaataaaggttgtagataaattataaagtaagtgacaaaaccactgtacacaagaacattcaaactacggtttctgtgctctgtgatgggctactcagcctccctttcctgcacatatttcacttcacctaaactatactttcgcacatttcccactgaccctgctgacatgtggccaggcagcttcatggacctcccaggctacagcaggcactagtgaaaggtggctggcagcagggtcagtacatctcccaacgccactgagtccctggaaacttgtaactggacacactgtaatttgtccagctgtctttcagagaccgtgttaattgcaccttatcagggaatggttgagaaaagagagaagggtattatagctggtcttccttagatttttatcaggagttacagtgagaactcagtttattgcacaggtctcatcactattgttcaagactgctggcaactgagaatgccaaggagagggctactaaacccatcccagcttgtcgaattccactgttttaatgtttttctaacaatgaagtgcccgatagacgtcaactgcctgggattgtcttgagaaaacctggatgtacagtcaccccaattgtgatccattgctctgcttatcctacaacttcctgatgaaacatcatcttgcactgattttacacacaacctctatgtactaaaaatgacctttcatttaaatgtaaaggaaagggtgaggctgcagttaaaaatgagacaatgtgaagctaaaagacagatggcaactcagtgggcgcgttcagatatcccagctaacctctcctggaagccaaatcccagggacaatttctggtcattttcttgctggagctattttcagttacagcaggctgaattctccaggggaagaggaaaactgggtaatttgtcttacttttccttcctaagtccagggcctacacaagtttgggcctacagcactgaaatcccctttgaactgtgccccgagtgaagtgtcaggaaaccgctgcttttttctggtgggggaaagggtgttgtaggtccaaagttgtattggagaccagctgtatacaagtcgtgtaaactttattgtctgaggacttcatcacctgtataaaggccctcacagtacggactgccaacacatctgggtcagaacagctgggaacaatttttagttggaaaaataacttacgtggaaaaggagcataaactttcatcatatattggctggttgtaaactaaggccatggcaagaaaaaatgcggatggcttgtttttctatttggttagagtcagctatttctggggcacatacggcacacagttcttaggtgacaggaccctgtcataaaatgaactggtcaccttattagcttttctgagtccttcactagtggattttggaaaacagatgctaaatgtttaacaaaatccacatacagtttattaaggcttttccacagttacccaatctacacaatatgccagtaggaaaaagcatttcaaagtaaacaaggatgaattaacacagattaaaattgtatatcttaatatcaaataatgccatgtggacttaggagaccagatgactgactggagatggccagacaggagaagatagcagagagggtcctgtccagaggcagaggaaaaccatattgtaaatttggaatcactgactgttttaatcatcagatagcttgctcttttcctggtggagaaagcaaaaagcatgaggcagcctcaatccacagagtgtctgagaaatagaactacccatggtacttggaaacttgaccttgtcaactccgaaagtgctgtttgcccaaaagccatataaatggttagtttttttaaaacttcacttgacctactattcaactattctttagatattttaatgtttctaatctaaagaattttttattgtggtaaaatatacataacatttaccatttttgccacttttaactgtacaactcactggcattaagcactttcatggtattgtttaaccatcaccattatctatttccataactcgatttctgatttttcgagcttctccaagatacaatatgtatgcccaaagagagaaagatgcacgattttgctgggatcaataagcaattgttggtttgcattcttctggctaggcatgtagactattacagagaccagctcttgttaggaatgcctgtatctgtcaacatattgtactttaccctcttttgaactttgcttttattctaggatgattgtaaaccagagaaaagcaacagaaatctataaatgccctaaaacatttcaacaggactatatgactggcatgggagctgtggggactttattatgttcatatttggaaaaagtcgtttaagccctgcaatgattagatgtgactgtgtgggttaattatgtaggagaagagatagtttcgttttaaatttctgcaattcaaactgtgtataaatatcatttaaaatgaagatccaaatcatcctggagaaaaactcactggccatcagagaaatgcaaatcaaaacaaaaatgagataccatctcacaccagttagaatggcaatcattaaaaagtcaggaaacaacaggtgctagagaggaagtggagaaataggaacacttttacacagttgtgggagtgtaaactagttcaaccattgtggaagacagtgtggcgattcctcaaggatctagaactagaaataccatttgacccaaccatcccattactgggtatatacccaaaggattataaatcatgctgctataaagacacatgcacacgtatgttaattgcggcactattcacaatagcaaagacttggaaccaacccaaatgtccgtcaatgatagactggattaagaaaatgtggcacatatacaccatggaatactatgcagccataaaaaaggatgagctcatgtcctttgtagggacacggatgaagccggaaaccatcattctgagcaaactatcgcaaggacaggaaatcaaacaccgcatgttctcactcaaaggtgggaattgaacaatgagaacacttggacacaggatggggaacatcacacaccagggcctgtcatggggtgggggaggggggaggggtagcattaggagaaatgcctaatgtaaatgacaagtttatgggtgcagcacaccaacatggcacatgtatacatatgtaacaaacctgcacgttgtgcccatgtaccctagaacttaaagtataaaaaaaaatgtggtaaagctttaggctgttccagttaccattgcaaacatgaaagaactcatagtggagaaaaactacaaatgtaagcaatatgggaaaatatttaattttcccagttttcctcaaagatatgaaagcaatcaaactggagaaagaaaacctataactgtaagaaacatgatttgaaaaagtgaaaggactcacactgaagaaaagccttacggtataagaaatgtggtcaggcatttagttcttttgtttgtttgattttgtttttttgaaacggagtctcgctctctcacccaggctggagtacagtggcacaatctcagctcactgcaacccctgcttcccgggttcaagcaattctcctgtctcagcctcccaagtagctgggactacaggcacatatcaccatgcctggataatttttatatttttattagagatggagtttcaccacattggtcaggctggtctcaaactcctgacctcagataatctacccgtctcagcctcccaaagtgctgggattacaggcatgagccaccacgcctggcccatttagttcttttagttgcatttgctgacttaaaatatctcattctggagagaagctctgtgaatgtatgagatgtgggaatgcctttgcttttcccatatcctttcatagacgcgtgatcatgcacacaagatggaccctataaacaggagaatcacacctgactggatcccgagtagtgtggaaaatacagaaaagttctcaattttaacaattactttcaaagtcatgtgaaaactcgtactggaaggaaatattgtaaataatattgaaagcctgttgcaaattcattattgtataatgcttgaaaaaaatttacaacatgaaagaaatgttatatgaattatatatatatattgtgtttatcagtggctcattattaaagaaggtctctggactatagatttccactgtttttgcgataaaagattgaggtgaaaattctgtaggtaccttttgagtgataattgtttaattaatctatgattaataggcctttgaaaaatgaatctttgttaattgtcaaaatttttcttactttatggggcaggttttggacagcctcacccattgtatatattccaactttttttttttttttttgagacggagtcttgctctgtcacccaagctggagggcagtggtgcaatttcagctcactgcaacctccacctcccaggttcaagtgatcctcctgcctcagcctccgaagtagctgggactacagacatgcaccaccatgcccggccaatttttgtgtatatatatacttttttttttttttttttaggagagacgaggtttcgccatgatggccaggctggtctcagactactgacctcagtgaaccacccgccttggcctcccaaagtgctgggattataggcgtgagccagtgtgcccggcctatattccaactttttattattatggaaaaaacttatcttttttgttataaaaaaaggttttttttttaataaagagttgatgtcagtttgtaaaatagtaaaaaatcaaaataaaaatgaagatcattgtaaaatgaaatgtcagaatatgcgtgcattgaacgaaatcaacaaaacacagacctgagtaactttagaattttaatctccatgaagctcaagatattcagatctaacaactttggtgcttacagaacatttatatcttctaactgtcccatgtgaatatcccacatagactctcaccagccatgacccaactccaggtagcaatgaaggcttgttgaagtcccatttggagcatttatggtctattcctggcccctactcttctattctgaaatcatggttgcaaaaggctcagaatttaaaggcttaattataaatgtctcttaaagagaaaaatggaaaggggactagtttaatggaacaattcattttatgagtcaaatagtgatatccatcattaattacatgtgatgcaaatatggccaaatgttagcacttgttaaatcattatggctactatatgggtattgtttttattattttctgcgctttctggacctaccattccaaaagtgaaaaaatgtaatttatagaattgacaaagcagagaacattttcctcctggggtaagcaaggaaaatttcaacattatattatttttggaattgactggacttcctactcctaagcaatcttacctgcacatcttttgaaatagacttaattgctgcctagagctcatagaaggatctcacagcactgctccagggcactgaagcttacagtgaaagcacattttcagcaagtactgaagattgtctccacgttggctggtttgaaactgtggtgagtgaattcagaaaataaatagtgttgattctttagagctttgaggctttgaagaaaataataacccttagtaattaacatgcctgtttgtttttagatcttttgaatgtaatccaggaaaggaatggaaaggaaagaagtgctcagaaagctcccagaagcattttggcactcaccaaagcagccggaagatgaataacacagtggggatagatggctaagtgggtcctatttatgtgttattcatcgacactagaaaacgtgctttaattcaaagcattgttttctcttcaagtgtctccagtcagcatcacgtagctttactaaatgcttttggtaatgctagagttatttcagcgtaccaagtgtctttgagtagtcccttaaggaaataaagctaagaaaagaagagggcagacagagggcattcgaccacaaagagtgagaatttcattggcttgtagaagaatccttcttggaaatggaatagtttatagcagagattcccaggcacacatgttcttaagaacaaaggggcctttggaatgctgtatcagtgaggatgcttttagttgcaagtaactgcagatccaactccagactggttaagccaagaggagatttattatcttgcgtaacaaatgcttaagtagccgtgcttcacccaaggcacactgggcttctggttccacttctctgtggcttctggatttgtcctcttctctttgtgggcttcatcctgcagcagctctgagcatcacatccactcacaacagagtcttgtggtctgtttggccccgccttgcctggacatgtgtatgttcattagggagtactgattcttctcaatgaggaggtgctggaaccagctgccagtgaggacagcagaggttgaaaagactgagaggtactagaaaagtaagaaaggaatgtataattgtgaataggttaaccccagctcttgaggaggacgtgcctaccttcagtcacctttttccgacatctgggataaaacaaaccagcaaatcaagtgagagcaataccgcactccacagtttactgctggcataaccccttaaaagaagaaacaaaatcttaagtgatcgtaaatgaaagaggtactctaagcagagacacatgttttccaagttaaggcaagagcaatagcattattgccttatatttgtttttgtttggttggttggttttattttttccttgacacaagttctcgctctgttgcccaggctggagtgcagtggaaccatctcgggtcactgcagccttgacttcctgggctcaagcaatcctcctgcctcagcctcccgaatagctgggatcacagtggggtcttgccatgttgcccaggctgatcttgaactcctggcctcaagcaatcctccagactctccaagtgctgggattataggtgtgggccactgtgcccagcctttttatttttattttttaagatacggggtttcattctgttgcccagactggagtggagtagcacaattacagctcacagcagtctccaactcttggcctcatgggatcctcccacttcagcctcctcagtagccagtattacaggcgcatgccatcatgccctacctttatatttgttaatataagcattatgacagcaggattttttttttcttattcactactggatctgcagtgattagaccaatgaataacacactgtatattctcaataaatatctgtcaaatgaatgagtcatggtgtgggcagtttaatagtttaaaaagacccagaaagagacagagagggatctgggttacagtgccaactatatcatttactagctgtagaatcttttttgttgttgtttgtttgtttgtttgttttgagacagggtctcactcttgtcgcccaggctggagtgcagtggtgtgatctcagctcattgcaacctcgacctcccagactcaggtgattcttccacctcagcctcccaggtagctgggactacaggcatgcaccaccacgcttggctaattttctgtattattattatttttttagagatggggttttgccacattgcccaggctgatcttggactccttggctaaagtgatcaacctgcctcagcctcccaaattgttgcgatttacaggcatgagccaccaagcccagcctgtagaatcctttctgtgcctcaatttcctcttctgtaaaatggggataatagaaacctgcttcatcgggttgttgtgagaattaaatgaatcaatacatgtaaagtgcttagaacagtgccaagcccatagtaagccctcaggaattgttgactgttcattatcactgctaccacttactaagtttttgacttctataagcctgagtttcctcacttgtaaaatgggaataataaaaggtacctcattttgaggatgaaatgagacattgtttattctttcctcacaacatcaggcacgcgattaggaacaacttggccaaaggtcactataattccttatctatctcagtgctttttatttacaaacttatttttattcccataatatattgattcccacaaaaacttaatgagagaacaggtcaactatatgccccttttacaggtggagaaactaacacatggagcagctaaaagcctgttaagactcactttatagacagatagtagagccagaagtcaacacagcagccacccgatgcttctcattgcagatcttccacattctaacacaatttttaagcagagacttcatagctggagagtgactttattgagcaaacgtacaatattggctcagaaatggaggacttataaaaactgtttctaggtgggatagtgtctggaatttgtgggttcttggtctcactgacttcaagaataaagctgcggaccctcgtggtgagtgttacagttcttaaagatagtgtatccggagtatgttccttctgatgttcagacgtgttcggagtttcttccttctggtgggttcgtggtctcactggcttcaggagtgaagctgcagacctttgcggtgagtgttacagctcctaaggcggcgcgtctggagttgctcgttcctcctgtccggagttgttcgttcctcccggtgggttcgtggtctcggtggcctcaagagtgaagctgcagaccttcacggtgagtgtcacatctcataaagacagtgtggacccaaagagtgagcagcagcaagatttattgcaaagagcgaaagaacaaagcttccacgttgtggaaggggacccaagcaggttgccactgctagctcgggcagcctgcttttattcccttatctgaccccacccacatcctgctgattggcccattttacagagagccgattagtccgttttgacagggtgctgattggtgtgtttacaatccctgaggtagacacagagtgctgatgggtgtatttacaatcctctagctagaggtaaaagttctctaagtccccactagattagctagacacagagcactgattggtgcatttacaaaccttgagatagacacagggtgctgattggtgcgtttacaaaccttgagctagacacagagtgctgattggtgcctttacaatcctttagctagacataaaagttctccaagtccccaccccacccaggagcccagctggcttcccctagtggatgctgcgccggggcaatgggtggagctgcctgccagtcccacacagtgcacccgcactcctcagtccttgggcggttgatgggaccaggcgcggtggagcacggggcggcgcctgtcggggaggctcgggccatgcaggaacccactgcaggggggcttgggcatggcgggctgcaggtcccgagccctgccccgcaggaaggcgtctgaggcccagcaagaatttgagcgtggcgcgggccggccagcagtgctgggggacctggcgcaccctccgcagctgctggcccgggtgctaagctcctcactgcctggggccagcggcaccggccggctgcttcaagtgcgggcccactgagcccgcgcccatccagaactcgcactggccagtgagtgctgcacgcagccctggttcccgcctgtgcctctccctctacccctctctgcaagcagagggagccggctccagcctcggccagcccagagagggtctcccacagtgcagcagcaggctgaagggctcctcaagcatggccagagtggatgccgaggccgaggaggtgctgagagtgagtgaggcctgctagcacgttgtcacctctcaggatgatgtaggggaaggagggaggaagtgaccaggacaggaaataacatttcacaagaagtgctcttaagggaggaaggttagaatgatccatgtggtattggattagagttagagacatcagaatgaactcacgaatttagcttaatatagctacagatggttacaaatagatatttgcagatatgtatcgattcatggattagtatgtatagatacatacattttattgctctgtcagctaaaagggcctagaaaccacaacaccccaatagtaatgagcacccctagcacccagatcttggtttctaataccattctctagtaaaagaaaccaggaatcactggagaaatggctgattctagggctgcactaataacatacaaaaggaaactatagtgccagaaagtaaggaagtgctggggtaaaaagataggggtatgtcaaagggatgcaagagccaactgaaaaggttaccaatggccaaagcttgaacaacttgagcaataaagtaaataatgtagtattggctgataacccaaagtataaaataaatgttaatccacctaacagaaatacatgattgtatgaataaataaatgggggagaagagataaatctcccttgcagaagaattccaaataatttatgtagatactcccccatcaaggaggtggaagatattcttaccccttaagtgggggctgcatataatgacttctttccaaagagtccaggatggaaagaagggagaaaagagtaactttacagtggagaagtctgataaaccctacctcaatcagaagatcaagttaatatcaatagtgataagtcaacttgatagttaggtacccttcaggtgatgccatgagaatggtactttatctcagtggtcttccttccaaaaacccataacccctatctagccatgagaaaaatgccagacaaactcaaagtgaagaatattctataaaatgcctgacacctgaccagtatttctcaaaactattaaggtcatcaaaaataaggaaattctgagaaactgtcacagccaggaggagcttaagtagacatgacaactaaatgtaacattgtatcctggatgaaatcctggggcagaagagagatgtttggttaaaactaaagaaatttgaattaactaaggactgtaattaagaagacatcaatattttttagttttgataaatatgccatatgaatgtgagatgttaataagagaaaccaagaatggaatattcaggaactttctgtactatattttcttttctgtaaatctaaaactattctaaaatttaaagtttgtcaaaaattaattgggctgctagggcagcaacaacaacaataaaaaagacatggaaaacaaaaagcaaatgagaaaatagaaaacaaacagcaaaatgatgaatgtatgctcaaccatataaatatgttcattgtaagtggtctaaacactgcaattaaaagccagatattgtcagagaattttaaaaatacaatatccaggctggatgtggtggctcatgcctgtaatcccagcactttgggaggccaaggcgggcagatcacttgaggtcaggagtttgagaccagcctggccaacatggtaaaaccccgtctctactaaaaatacaaaaattagctgggtgtggtaggacatgtgcctgtaatcttagctaccccaggaggctgaagaaggagaatctcttgaacctgggaggtggaggctgcagtgagccaagatctcaccattgcactctagcctgggtgacagagcaagactccatctcaaaaaaaaaaaaaaaaaaaacaaacaaaaaaaacaatattcagtgtatgctgtctatacaagaaaccactttaaatataaagatacagatagattaaaataaaagatggagatacatataccaatcaagcaataatcaagagaaagctggagtagatacaaagtagagttcataacaaggaatatgatcatagataaagaggacatttcataataaaggcgttatttcattaagaagacaacagttctaatgtgtatgtacttaataatggagctttgaaatatacacaacaaaaactgatagaactgaaaggagaatagagtaagagttttcgttggagatttcaatactcttctctcagtaatgatagaacaagtagaaaagagaaaataagaatacaaagtaagtgaagataaagacttgaacaaattcccacccagaacatcagaataaattgcacgtcttttacatagcacattgatggctgtcactttttaatccagtctaaaaatctatactttctaatttcagtgtttaatctcttacatttgattgatgtaatttctggtggtgtgagtttatgaatcatgttgctttgttttccatgtgttctttctttctttgttccttcttgactgccttctcttagattattttcacattctttttatcttctttattgcttcttacctatgtctctttgggtttttttttttaaataatgatggctctagtgatttcaatatgcaaccttaatttatcattgtctacactgaataaatattatagtacttcatggacagaataatgacttaaaacactataattccatttacagcctttatccctttgtgctattttgttatgtgtttcacttctacgtatgttacaaaccccacaacacttgctattatttttatctaaacactcaaacatcttttcaaaattaaaaaaataaaaactagtcttttatatttacccacatatttaccttttttagtgcttttcattccttcctgtagattccttctgaaatctggcttccatctgggataacttccctttagctgaaaaaaactctagagattttagtgatataaacatataaacaaaatggcccatttcttgtagtttgggtctgttggtaacacattctctgagctttttttttttttttccattaaaagtgtctttatttccccctcattctgaagtttattttcacaggatgtagaattctaggttgataattgttatgtatttttaaaacacttggccaggcacggtggctcacgcttgtaatcctagcactttgggaagcccaggcggatggattgcctgagctcaggagattgagaccagcctgagcaacatggtgaaactcgtctctactaaaatacaaaaaaaaaaaaaaaaattagccggcatggcagtgtgtgcctgtagtcccagctactcaggaggctgaggtgggagaattgcttgaacccaggaggcagaagttgcagtggctgagattgtgccactgtactccagcctggtgacagagtgagactccgtctcaaaaaataaaaacaaacaaacaaaaaaaccatttcaatgatatggttttactctattctgaattctattatttctgataaaaagtcagttgtcatccatgtctctcctcccacattccaaaccccctctttctcccaaatataaagtgtatttttttctttgacttttttttttttttttttttggagacagggccacagttctgtcccaggttagaatgcagtgagttttgtttttgccacaactcactgcagcctcgacctcccaggctcaagtaatcctcttgcctcagcctcctgagtagctaagaccacacaccaccatgcctggctaattttttattttttgtagagacgaggtatcattatattgcccaggatggtctcaaactcctggacacaagcaatctgctcaacttaccctcccaaaatgctaggattatatacctttcaacatttattttatccaattttctttgtccttgctttctgagactccaattctatgtatattagactatttgatattgtccccccaaattaatatttttatttttaatctttttcttctctgtgcttctgttaagataatttctattcacttgtctttaaattttccaatgctttatccccctgtgtccagtattcttaggaatttagttcacatatcctccttttcattgttcactggctttaaaaagtagacagacagacagatatttttcccttggcttgagtaacagtcttttacaactgtctacattttaattggaaatagaaccttgagtgggtcttaagcagtcttatatcatacaaagaacatgctaaaaatgtagtatttctgggaaatactatcagacatcagacaatatctaggatattaaaaaaaaattccttaggtggttctaatgcaggagtccccacacacccttaaagaaacactaatttgttgttagaagctgaagtcaaaataaaagttagcagtcaaatgcaaatgagtttcaattgaggcctcaggaagaccatcaacaaagctatcagattgctttactaaattcaactttcgaaaactcatagccattatgaaaaccagtgtggaggttcctcaaaaaattaaaaatgtaactaccatatgatccagattagtaccttcacctatgagcagacttctgggtatatgtccagaggaactgaaatcagcatcttacagagatatctaacccatcatgttcatggccgcattattcacaatagccaagatatggaatcatcccaagtgtccactgatggatgagtaaataaagaaaatgtagtataggcacacagtggaatactattcagcctttgaaaagaaggaagtcctgtcatctgtgactacacggattaacctggaagatattatgctaagtaaaataagccaggcacagaaagataaatactgcacgatctcatttatatgtggaatctacaaaagtcaaactcatagaggcagagagtagaatggtggttgctaggggctggggagtggtggggtggtagagtgggggtggggagatgttggtcaaagggtacaaagtttcaattagacagaataaataagttttggagatttattgtataccatggtgactatagttaatgataatgttttgtatacttgaaaattgctaagagaatagatcttaaatgttccaaccacaaaaaaaggataagtatgtgaggtgacagatatgttattagcttgatataatcatttcacaatgtatatgtaagaacatcaggttgcacaccataaacatatacaatatttatttgtcaattataccttaataaagctggtggagggacaacttaatttaaataaactggtaaatatggaaacagacatggcctgtaatttccaaaagccatgtagttactccatttcatttgttcttgattttatgctgggctgtagctcctcagtgaaccaactaaagtcataattagacagttttaggagacaagaacgtcttcagtgatgtgtataggcaggcttgcataactctttgaaagatctccaaagaggaatatgaatgattgagaacacatagatctgctatttaccaattaatcctaaggttccatggcctggaacaattaccaagagctaaagacattaacttggatattgtgtggctatcaagaaaggactctaatttttgaacaaatataccagaaattatgcactcaaatgagtgcagttctcttcaacaggcaaaaagaaattgagtatcaaccctgcttcattggtttcactccctagagagttgcattggggattttaaggtagaatatagctcagcgggaaagagtcatctatgagcatggtctgccatgaacatggctagggtccatggcaacagaagtggtacataattgcccttcctgggttaatggtaagagcctcgggtttgaagccttgagcataaatttggctctgccatctactaactgtgagatcttgtgaaaacacattctctgagtctcaatttattttatttaatggtaattggtcacaaaaaatttccactttctatttcataggtatacatgtgatatcccctttgaaacttaacagtgcactaatagcaagttgttcttcaaggaagtcactttggtaggctatgatcttatttacaacaattctgtcattgcacattctttgggagtgcatttataaacagtttgagcaatttgggagaagcacttttacatgtccctgtgatggctaattttatgtgtcaatttggctatggtaagggatacccagaaaatgaaaaaaaaattatttctgggtgtatctggaagggtattttcagaagatattagcatttgaattagtagactgagtaaagaagattacctctcatcagtgtgggcaggtatcagcaaatccatcaagggcccaaatagaataaaaaggcagaggggggcgaattctctctctttttcttgagctagatgtccatcttctcctgcccttggacattagagctcctggctcttgtgcctttggattctaggacttataccggagccctcttgcctccaactgggagatacaccattggctcccgtagttctcaggcctttggatttggactgaaccatgggaattggctcacaaagttatggaggccaggaagtcccatgatatgccatttgcaaactggagaaccagcatcatgggacttcttggcttccataattgtgtgaaccaattcccatagtacatctcctcttatgtatccataattattctatttgttctgtttctccagggaatcctgactaatacacggtgttttgataattcagctagatcacctacaaatcgatcaggaactttggattcaaatgatatcattgttgccaaaaatcgaattcactattagtggatgaagatttgttaccactgggttattaaaaagcgtaggccacaggcttttgaagattcttcccaaagaggaattccaaaaatgatttatgcaattgcagcctcattagtgtaagagtatggtctcccaagggagctatgttgaaggctgaaactcacttgaatatgtaatcttctgttagcttgtttaattaatcggtcattttgcgttagaatctcatggatgtatagcagagttaccatgctttgaatgagaatgatggtcacacactgatcctgcagtaatctctaagaatataaacaaggtagcccagatgaactctcaccctctgatagagagggaattggagctttctggcgcttactgataacataacaagaatatcttcagtgatgtgtataggcaggcctgtataactctttggaagacctccaaagaggaatatgaatgataagtctccaagcaaacaactatttgtaaccccagaattataaaatatagatgtaatacggttgtgaaaatcctttctgtttgggccaggcacagtggcttatgcctgtgaatcactttgggaggccaaggtgggaggattgtttgagcccaggagttcaagaccagcctgggcaacatagtgagatcctgtctttacaaaaaaattaaaaattagccagttgtggtagcacatgcctgtggtcccagctgtttggaaggctgagatggaggactgcttgagcccaggaggttgaaactgcagtgagccatatctacaccacagtactccagccacttcagctttgaggacagagcgagaccctgtctcaagaaataaaaaaaaaataggaatgaaaaaagaaaatcctgtttgttcaaaagtaactactatggttaggcaaaggcaggaaatgttagaagaaatgcagcgagaagtccttggaaggagtatattttagcattggagtctgggctacgtgaaggagatgttgacacagatccaatcctaaactgttagggagggtgcagtatctctctgagactgtgtcatgagggatctctgcccttttcctgagctttagagggtcatactctagactttttctctctatgagaagaggagtccacgggctaaagggttgtgccccccttaagcccactgtggtagaaggaattctaagatggcacccaagattcacgcactctctatcttccccctctttgagtgtgagtgtgacctatgaatcacactccatgattaggtgacattatatggcaaaagtggagggatttgcagatataattatcgtttctcatcagttaactataagtcaacaaaaaaagattgtcctggatggaccttacttagtaaggtgaaatcctttaaaagagggctgaacccttcatgaaaagagagaatctgctggtcttgaagaatcaagttgccattagttctatagccacaaggaaatgaattctgccaatgaccatttgagcttgaaagaggactctgaacctcagatgaaactgcagccctggttgacaccttgactgcagtccagtgagaccctgagcagaggaaccagttaagccacactcagactcttgacccaaggaaatcatgagataatggacatgtgttgttgtaaggcattaagttggtggtgacttgagatgcagcatggaacaggaattcacccatgcctcatcttctagtctaatggcacgcaaagtttgatctgtttactgctggtccaggatgagctaagtatagaaagtgagagtaagtggtactttttatggcaatttaacactgctgaaatatttaaattatattttacaaaaatgtggatccacagtagagtgaactttttaaaaaaagcatttttcaccagataagtactgttctagttcatgatctgccttcttagaattctgaattctctgcccacctgaccctgaaagaggaatgaattagctcttcaagggcctgctcagtcctctttctttggtctgcctgtataagggcagacagtgctgctgctgaactaacccctagccctgacagttggccaagaaacagctctttatgggggttgaagatggagcttcagatgtgtgggttggcaggttcacacatgactataagcacctggaagtgctggatagaaagatgggaagagaagagaggaataaccaggggccagaagctatgaatggctgttcatatgtaacctcaaaattccctgctaaaacatgggaaatcccaaatttttaagttcaaatacagctttcgggtcattgtgaaggtctattggccaaagtagaaggaaagaacatattttatttaatattatgctagcttggcttatgtttttaaacattctagacatatgctatgccggccttcatttgttctcctgtactggccttgtaaatatgttaagagtgggcctggagagtggtctcttctggaacacttccatctacttctcccagagattgcaaacctagaatctggagctgctgaagtggaagggttttgttcttttttgttgttgtttttagtgatgcctcatcataattaacacaaaaaggttttctgcactaatgatgcttagatttttttaacccatttttctctaactgcatgatggtaggtgctatggtttgaatgcctcccaaaatctgcatgttggaaacttaatactcaggcagcattgttgggagttggggcctaatgagaggtgattaggccataagggggaagtaaatggattaaaacccatttatgcctagtgttccattattggaacactaagcatgtaggagttatttatatctactgctcaaggtctgattggcaaaaattcaaaaaattgcaacctcaggcagaaatggtttaatactgttatcatggaaatgggtttgttataaaagggtgtgtctggcccccttttatctctctctcttttgcccttccaccttgggatggcacagcaagaagcccctctccggatgccggcccctcttggacttcccagcttccagaattgtgagccagtcaatttctgttcattataaattacccagtctcaggtattctgttatagcagcacaaaacagactaagacagtgggttatcctaaatccatactatgccagcgagaaccaaggggtgtagcatgtttcctgagcagtgtttcagatccccagcagaaggtaaatgctgtaaattactgtgcatttgccacagtgtagtagactgaatagtggccaccaaagatatccaggtcctaatccctaacacctgtgaatactaatgtaatgtgtcaaaacaggctttgtagatgtgattaagtcaaggaattttcgatggagagagtatcctagattaacttggtgggacctaaatgcaatcacaaatgaccttataagagagaggcagagggagacttgacaccatataaagaaatgggacattaaggcaagaggctgaggtattggctttgaagatggaggaaggggccacaagccaaggaatgcaaagagtacatctctagaagctcaaaagataagaaaaaggattctccccaaaagcctccagaaggagtgcaaccctaccgatgccatgatcttgggctaatgtaactgattttacattctgacccccagaactattggagaataaaagtgtgttatttgaagccactaagtttgtggtaatttgtcacagcaggtaaagtaaactaatatacacagcaaacaatgagaatatttttaaaatctgaattaaaagtctgggattttggtgtgtgtgcaaccactaccagttttctagatactcttctagagacaaggtattgtgaaacagacaatataagtgagaatggaagagagtaacacagacccaaagggcatgcttcaaaagccacaggggaggccagatcccagctgacacaccactttagaataagagtgtttcctcaaaataactgaaggaacaccgagaagggctatagatgtgttcagctttattcccacagttgacatttataatgtatcagtccctccctgttaatagcttgactgacagacaatcaaaggatgtgtgggactcataaatagtccgaagcacacccaagagggagcatttgtaatgcagccttcagagactaggtagaaaggaaaggaagggagcaaaggaaaactcagggaggaatttaagggacaagtgttcctgaccaaaatgtcagagcctggactaagctcttgatcacaaagaaatggtgagaagccccgtagctgaaattactgtgagagcccgttggagtcagaggaagtatttgtggtgggattacagggaaacttttctacttcttgtctccacataagccccaggttagtcccaaaggactgtggatgctgttgaggcttagtgaacacccagtaatgggagaagaagagactcgctttcagtaccatattcccttgggtacagagaaaaagctcaggccgttttgaaaacagctgctgcacttttcccaaatgacctttctttgttcccttcagctccaagcccttggactcattctccatttttctctttatgcaggtgtatgtttaagctcaggctggaaaaggatcactgaaagtcacttggatggtgtctcgtgtgtctgtgatgagcttgctgttgctttctttctccttgacaggtgggtttatttcttatggaatcagaccttttggctacagtgttctctaaacagctgtaataccatctcactcagttaacctaactttggatctgatgtacatcagaataaaacctatagagaatagagctgacttccccaaatccatgtgcctccactaacccccaaggagcttagtgtggctggttgtgaatgacagtgatctccgtgatgagaagtaatccctcctctagaaatactttacctgttttctttggtgcttaacaccctctgcatgagacattgctctatgggctttcatctcccctgtgacaaaggacacatctttctcatttccacattccctcctcttgcttctcccccatgccacctcccctttgtccctctaccaacacataggtacctgcgtcagttaggcacctactctacagcccatggaacaaataaagctttcaaacattagttatttaatcaatgggtcaaaaaaaaacagtatctgaatatgcgcagcatctaacctttttgatgggcttttgaatctagtgcctcattttgtctcttcaacatccctctgaactcagtataacaagtagtaatagccccattgaacatataaaaaaacctgacatctgggaaagttttaacttaggaaaaggtcacattgcagattattggcagagttcacattagaatctgtttcttactctgttgtcctcaccactatactatggtgctttcgttcattgagttgacctatggtaaagttataagccttgctgtttttgcaagtggggagactgggacttgggcatctgaattttgacctggaggttaatggtgtcaataggaatgtaactgcatgcagtctcttagatggatggatggtaagaaaacctttactttctatataactccagaagacaattctgtcattttaaactacaaatatcaactatggtttttttgggaggaatatttattatttaattttaaaaaattatttttgatacaaagtcttgtgctgttgcccaggctggagtgcagtggcgccatcttgacttatgtagtctcttcctcccaggctcaagcaatcctcctgcctcagcctcctgagtagctgggactacaggtgtgcaccaccacaccggactaatttttatattttctgtagaggcgggtttcaccatgttgcccaggctggtctcaaactcttgggctcaagcaatcctcccgcctctgcctccaagtgttgggattgcaggtgtgagccactgcacccagccaattttttttttaagtttcttgtgggtaccctgtaggtgtatatatttgtggagtacatgagatgttttgatacaggtctgcagtgtgtaataatcacatcatggagactggggtatcccttctctcaatcacctcccttttgttttactatttatttatttttaaatgaactcttatttatgtgagatgactttgttaagggtgaggacagggacagatacttgcttccttttctgccatgtcactgccagtccatattagagcccactctggaggctaatgaatttttcttctctctgtgtcccgtcagccccagtcccctctgcccattggacccactcttcccaggaccccgggttcacagctaatgcctttcagtcagaggcaggagtagattatttagtttcttcccagagaaactccccacagcccaaaccacatttatcctgcaaatattaaccacttttcatagcagtgcatccatgagttattatgctaacagctgcctctgcttcattgtgcaaaagatattttcccagcaaagggtggggacgcagggcagaggagggtgagaagggaggaaaatcccaccctgtcacgctcgtttaaagttatcatgtgccgcccgccccccattcattcaacacacatttaccttctggcagcaactgcgttatgagatataaatatgaatagaatgcaatgctctacctaagggaattcatggctaagaaaaagaaatagacacaaataggtttgttgtaaagcgaagtggaattagagcaggtccagcaaagaaaggcagcagggacaagggacaggcattccaggcagcaggacagggtgagccgaggcatggaggtgggaaacagctcactgtgtgtgtcgtatctctccaggcaaagctccctgaaagaggaaagagccagggaagtgacaagcagagcccagaggggcttgcaagccatgttaaggagcttaggggtggggtgggaactgaagggtttcaagcaggggaacaatggcagatgcgcagttgcgtggatggtagatgggaggatggatcagattagggcaaaactgaaagcagggaccagtcacaagaggaacttcattccagggagagatgttgagggtctgaactgaggcagtgcagtgggaagagaaggatgaattagaaaacagttgcagagggacttgggaggtcatgggagctagatggggatgagggctgagggagaagtagcagtctggaggggtctttgagtaaggctggaacccctctctagaactctctgcccagtgcccagagaacctcacaggagataagaagatggacacacagagttgatggctgctcaagacattgtcccctcccctacaatcccccgttcaaagctggtgaggagtatggccaagcagtctgaccccaggactgtggtcctcagcagggcgagggtggggaggatttcgaaagtgggagaccagagtgaagcaagaggctgtcagcggaaggactggaagggccaggcccacgtggtcacgtgtttgcagctttagctaattcatcctcccaacgtctctatgagggtgacacagttattgccccattttacaggggagaaaattgaggctcagcaggtaatctgtggccaagttacagaccacagtgctggcatgtggagggcatttcctccagctcagcataactggcatgggagaaagactggcttcaccacagcaagccccacagggccatcagagtggaccagggaatagtgcagccggggagacctaagcagaacttccagtgacaaggagaggattctctggaggcagctgggaggggcccatgagacgcctttgggcattcacaaaaggtgtgagggctttggggtcccagcagatttcctcagggtggggtagggtagaggtagggaaagaggctgaaaaagatcatgattttgttgcaattttattaaccatctttcttagtttttacctgcatttatatgcaggctaacagcccctgaaagagttcataaactcagcctctgaatctgtcccatcatccccacaagcatcctgggaaagagagtcttttcattttctctgtctctgtctctctctcaacagatgagaaaacagtggcttcaaaggttaaacaacttgtcttcgattgcacagctaacaagaggtaaaactggaatttgaatcgtggtactgtgacttcagaggccaggttcgtagcgctacactaacacagagaccagaagaagccttgacattatcataaaaccacagacatgatacaaggccaggaagaaggaggcttgggagcttattagctgaaatatattgatcaccttttcacagctttctcttattatcctcccaatgtctctgtgaggacagtacagttatcaccccattctagagatgaggaaactgaagctcagaggtgttaagaaacttgttctaggtcacacagctagtaatgcttgggatcaggatttgaatttagatttgtcatattccaaagtttacctatagtctcagctactagggaggctaaggcaggagaattgcttgagcccaggagtttgatttcagattgagcaacatagtaagatcccatgtcaaaaaagaaaaataaacaggtgaaattaattttaacaatatgctttacctaacccaatatatgcaaaatattacattttaacatgtaatcaatattttcaaagttaataatgaataccagaaataacacatgtgctaataacatgtacgctgcaacactaatatcttacctgatacaacagttaaaatcaagtcccaccagagcaataaagttgtgtctaccagaaaaatattttacactgcttccatttttaaatttacatttaaattaattgacattaagtaacatttaaaactcagttcctcagtcacacgggctacattttaagtgtgcaacaaccacatatggctagtggccacagtggtgctggttaatgagcacagctctaagccttccttgtgtgtttttttaaaaattcaattcagattccacttccattgtttgcttgtttaaccttaaaatctgtgtgttttaacagacctgtgtttaagccttataagtcccatcacaaagtgtcagtggtttggagagaggttctagaacgttctctttgtaacattatcacaaatctgtggttgttaggctgctcttggtttatgtttgagttaaaccctttgtgtggtgtcagaccaattcaggcttatgttttccccggagagaggaataagctgctattttggaccctgtcgtgatccctgcccagagtcaaaagtaattcccaagcagactgatttttacagggtcatgctcctctgatcttctctccaggagtgtgattttcaacgggatagagaaaggcaaactcctgaggaaaaatttctctgggaaagcccaggctgaagtcgaggagggaagaggacgaaaggctgacagggttgccgtctctgagggagatccactcacacacctcaggaggcattgtgggatggtcaaagtggggaggaagaaagggaatcttcgaaagaaacttgcggcggggcacggtggctcacgcctgtaatcccagcactttgggaggctgagatgagtggatcacaaggtcaggagttcgagaccagcctggtctggccaacatggtgaaaccctgtctctactaaaaatacaaaaattggccgggctcggtggctcacgcctgtaatgccagcgctttgggaggccgaggcaggtggatcccctgaggtcaggagttcaagaccagcctgaccaacatggagaagccccgtctctactaaaaatacaaaaaaaaaaaaaaaaaaaattagccaggcatgatggcacacacctgtaatcccggctacttgggaggctgaggcaggagaattgcttgagcccgggaggcagaggttgcggtgagccgagatttcaccattgcactccggcctgggcaacaagagcaaaactctgtctcaacaacaacaacaaaaaattatccgggcgtggtggcatgcacctgtaatcctagctacttaagatgctgaggcaggataattgcttgaacccggtaggcagaggttgcagtgagcagaaatcgcaccactgcaccccagcttgggtgacagagcaagactctgtctcggaaaaaaaaagaaaaaaagaaagaaacttaggctgaaaggtttaaatggacacagaacagcaaactcaaggacttccatagctactgggaaccagcacagggctgacacctccattgaactctctttgctattctagaatattttaataatgagacacacccaaaacatgtttagaatcatgccacctgctgcttctcatggccagcattatttgtcatcaaatctgatcccaatgtttgccatattattggatatcctgtgaaatagaatctaaaaatatacattttttccctctaaatcggtcctaaccttacagctagggttgcaactgtaatattgttgtctgtttcattttactttccaggattaggtaataatattaaattccccatctcatgttagtttctgtttgaacttggcctggtatttgaagaatatatttagaagttaaagcgtgctactttttatcccatgcaagccagttgtgggttcatagatctgtggtatctcataacattttctgtcctaaactgaacacatccagtctctccaaattgaagttcctcagctgaggttattttcatttcggagaatttcttgagagttgtttctgttatagaggataaagggatagaggagtcacagctgcctaaagtcagtgcctctttaaatacaggccttccttgcctccaggacttgatgtcttcctttagtggagggcagctcctcaattgaagagggcgggattgagggagcagttgaagcagcaggttcgcctgggctcatgcttttctcttgtgtggctgctgttacagggaccttcaggcacgttctaggaaagccaattaaagcagaaaaggcccttagaaccaaattgattgcccccagtatagctgttaaactttgagagagcagctgggtgcttcttgtggccctgatagtgccagattgttcatgctgccttaggctttcctgtaacatttttgaaaacccttgttatatccagtttaatgacatgtattgatcagaacaaaaagggctgaggtactgactccaggatcaactcacagacagaaccatacatttctattttttagattctgcaaagcacccaagtcaaacataggattattcccagggtcatgaccatacagcattttatctgtgaagaacagatagtttaagtcctttatttccatttgatttcaaatgtggataaagaaacaactaatttattttcagaaatgtacatcacctctgactctcaaattagcacctgattttcttattttcactttgaaaccgctgtgtgctattttgattctctagaaagagttaaacttctcataggcattaaacccaagtggaaatagttggcccaaggcctaaacttgttctttatgagaaatacaagactcgaagggattctagcctttttagaattatcatagaatgtgtacaggaagcatgacattggcagaaagggaacataggtgccttttaccgtgtttatatggacatgggttctgggttttacagatggggaaatattgtacgagtccatggggatatgtagtgaaatggagagggagagggagaaagaaagagagagagagagagagagagagagagagaaagagatattcttttgtactttcagactgagcagtttacccaagtcagagaagcaagggtatacaggtaaagtacagaatagtctggaataatgtcattattgtttggtctctttacttctttatagggcatctcagagagagaacacagtttctcaaagtggatggaaggtgtattataagtttttaacccagaataaccaaaacaatcttgaaaatgaacaaaattgaagattcatacttcctgatttcaaaacttactacaaagcttaagtaaacaaggcagtgtagtgctggcagagactaggcatagagactaatggagcagaattgagattccaaaaataaacccatacatctatggtaattgattttcaactagaatatcaagcccattcaataggttaagaatgtttcttttcaacaattggtgctggtacaactgcttatccacaggcaaacaaatgaatctggaaccctacctcacaccatatacaagaattagaatggatcaaaagacccaagtgtaaaagctaaaagtgtaaaacccttagaagcaaacaggtatatatctttgcgaccttggatttagcaattttgtttttgtttttgttttgagacagaatcttgctctgtcacccaggctggagtgcagtggtgtgatgtgggctccctgcaacctctgcctcccgggttcaagcgattttcctgcctcagtctcctgagtggctgggaccacaggtgtgggccaccacacccagccaatttttttatttttagtcaagatggagtttcaccatgttggacatgctggtcttgagctcctgacctcaagtaatctgcctgcctcagcctcccaaagtgctgggattacaggcgtgagcgactgcacctggctggcaatggttttttagttatgatgttgaaagcacaagcaactaaaaaaagagagaaaaatcagatttcatcaaaattaaacatttttgtgtgtcaaaagagactatcaagaaagtaaaaaaacaacctacagaatgggagaaaatatatgcaaatcttatattgggtaagggtctagtatctaaaatatatgaaggactcttactattcaacaataaagagacaaatagctcaacttaaaagtggtcaaaacatgtgaatagacacttctctaatatacgaatggccaatacacacatgaaaagatgctctacataattagccgtcagggaagtaaaaatcaaaaccacattagataccacttcacactcactaggatgctataataaatttcttttaaatggaaaataacaagcgttggcatggctgtggagactggaaccttcatacattgttagagggaatataaaattgtgcagccactttggaaaacagtttccagtacctctacaagttaaacacaaagttaccatatgacccagctccactcctaggtatatacccaggagaattgaaggcatatgtttatacaaaaacatacatgaatggtcatagcggcattattaataataacccaaaagcaaaaacaacccaattgtccatcaactgatgattgataaacacaatgtgacatattcatactagacaattaaataaaagaaaactttttttttttttgagacaggatccggatctctctctgtcacccaggctgcagtgcagtggcatggtcttggcttgttgcagccttggcctcccggactgaagctatccttccacctccctcgcagagcccgcttcccccaccaatagctgggattatcagcgtgcaccaccacatacagctaattttagtattttttatagagacagagtttccccatcttgcccaggcccacctgtctcatcctcccaaagtgctgggattacagacgtgcgcctctgcacccagcccagaaaacttcttacacattagcacccactccctattcaccgctccccacagcccttggcaaccacgaatctattttctgtctctatggatttgccaattctggacatttcatataaatagaatcatacagtatgtggccttgtgtgtgtgtgtgcgagtgtgtttgtgtgtatgtctggcttctttccttagcatactgttttcaaggttcacacatgttgtagttatgtaccaatcctttattcccttttattgccaaataatactacattgtctaaagcaagtctaacttaaaggaaaaaaaaaaaaatatatatatatatatatatatatatatatatatatatatatatatatatttcattgtatgattataccacattttgttcatccattcatcaattgatagacatttttgggttatttccacattttgggctcttatgaagaatgctgatataagccttcataaacaaatttttgtgtggtctgtggtcatgttttcacttctcttgggtttttgtatatattttaaatgctgtaaaaactttcctgacttagataataatgattcctttattgacaagtataaagctttctcatcaaaagatagaaaactgactccattttgtatcacagtatcacatccttagaacattgagagctcaaaaagaactcagacacctgctgggtgagaccctgattctattgacaaggcctagagaggtggggtgaccactacaggtaagacagccagtgaatgacagagacagacacagaaccatggtctcccaacctacatccccttcccatctagatggacatcatctttaaccccgtgactcttacccagagtgaaccatcggtctttccagagtctgggaggggaatgtttccatggtgaagatgacttcccagagtgggaccttagggggtagtagacatcccctacctcccccaaaccattccccttctccataacttgctacagtacttgcagtttcaccagcagccaatccactggttgaatggagggctcacaaatgaatggcctatgggggccagagaggaatgaaacagagtggattgggcaggctggcaagctggaaagcacatgccccccccacgaaatagcttaggacaaaagccacaggatctgtgttcgtgaaacatcttggaggcttggggttgagcaagtggcttcttagcccagcgtgcaagatttggcatgtgggccatgctagcctccctgtagcgctggcattctgaaatctcagagatgctgctacagaggaaagccaggcattgcagggcaaggctctcacagtggccgccagcacctcatggtggcacgaaacttgagcaggagaggaagggtgggcttgttcctgagcaccagaagctgcaactaccctggcacccttttgttaactggggagaacctttgaggagatgctggtgaacgttccatgcaggggctgagaaccatcacaatttggcccataatactgcaaacaaagtccagcaagcctaggaaatttaggattcatctctaaaacagtattctctgtttagaagcatatagaatattttataatccaaatgagttgattgcctcttggcttgcgttagcgagatgctatcattgcaataagcggaaatctcaactctgttagcttaggcaaaccatacaactcattggggattcagattgctgttccttggtcttgctgtttgccttgctacatgcgtatgaatgtgcagatgacaagaacagatgccagggcccctggaagatcaaagtcctggcgctgccttagaaaatctgtccatgccacatccctaaatctgcaggaaggccatagtaaatatgcaatagatatttgttccattgaatgaactctaaagcaaacccattcttaaccattcctatgtaagaccaaagcacatgtgcaggcggctgggaccaaaaacaaggagtagtacttttggggacacaattgtcactgctgtttccccactatcttagcattcggccacttctccaatatccagattaatttgctgcaatgaaaatttcctctcttttgtattaaaactaccctaacattattttcatggttatttttccaaaactggaaataagaacacattgtttctagattgtggacagtggttccagagaagggaaaaccagaagggttttatgactcaggaagaaagagctcccagaggggcccaggtggtttttcttccatcctcccctttacgatactctgaatatctttttttttttttttttgagacacagtcttgctctgtcacccagactggagcgcagtggcactatctctgcttactgcagcctctgcctcttaggtttaagcgattctcctacctcagactcccaagaagctgggattaaaggcacccaccaccactcccggctaatttttgtatttttagtggagacaggagttcaccatgttggccaggctggtctcaaactcctgacttcaagtgatccgcccacctcaccctcccaaagtgatgggattataggtgtgagccactgcgcctggcctgaatatctttttaaaaattattttggaaggttttctgacttgcccttcaacatttctagccttccctttctgtccccaacattaatctcccgcaagtctcttctccattgcttctccgcgttggcaggcccatatttttgtgtggcttctctctcctgtttactcaaaagctcataattacttttctcttgtggataaaaataagcagaatgccagtagtatgatttttaaaaagagaagcttcccagatgcctactcctgaccgcatggaatcattctgatgagagcatgcttaatcaatcgaccctgcattgtctgcaaggcttggttcaactggctgactccattatcctgtaaactgtgcaattttctctaaagacatttcaccagcacaactgcataaaacaaatgttgaatgggaaaaaaatcagtagtagatattttttaagacatcctaacaccattaaggtttttttccgctgcaacctgcatctggtagtaaaatctttcttttccagacattgttttctccaaagaatcattcaaaaagttactaccgtatgaaaactctttagccatttacattttgtgggttttaacaagcgtgtcttccaggctgactctggctggtagaggttttcacccattcctcaatgggcaccagaattctgatgagttcatgacattcagtttaagaaattacccgcggccaaagatcttgattggcaaggttagtacattttgccatatgttatgtgctatctctgtccccaaatatgcaactcttatggtgtgacaaattgtgggacgacacacgttgcagcccagacagttagacaaaacactccatcagaactgaaaccgcaggctaggtctctgaataagaaatatgcaaaaccacacctgccggccaacattgctgcttatttcttgctcctcttttttttcttaccacaaagaaaattaaatgtaaaatcaatttaatgttgagaaaaggacccagggtgagcttcccacgtacacttaattgagtcagtgatattttgtgtggcctagttatagcttgagtggtgcagctgagtgtaagctgtttgtgatttggagtttaaatcctatgtttaattattgccagtatcacataggatacagtggctgacaacgcaacagagttagacttaacagttgtctgtggtttgggcctggttatctgtttaagatcaatatattctaacaaaaattcttgccatggttaaatcctcatgtgttctgctattaggactcaatatttatgatacttgagggcaggaatttcttcataatggaaagtgatattattgggagtggtagagattcatttttgaaatccattctgacatggaaacgtcttaaggtcattgaatttcaaaaacttgtcttttaagggatagttttcttctgataatataacgagatgagaatgttgtgctgtcttgagtaaaatgtgtggtatttgtgtctgttgggtattaatgtgtattatgtgcattggaatcatgggtgccttctatattttaagtaatgagaaaaggtccacaattttataagctgtgtgtatgtgtgtgtgtgtgtgtgtgtgtgtgtgtgtgatctgtctatcatctatctatctatctatctatctatctatctatctatctatctatcatctatctatctttatttatatatagtaaagtatatatacaactttgccactgggagcactgtaagtttctataaccacttgcagtttaagaattgtgccaaattggccaggcatggtggctcatgcctgtaatcccagcactttcggaggccgaggcaggcagatcacctgaggtcaggagttcaagaccaggctggtcaacatgttatggtgagacccccgtctctactacaaatacaaaaatcagctgggcatggtggcacatgcctataatcccaattacttgggaggctgaggcaggataatttttttttttttttgaacggagtctcactctgtcacccaggctggagtgcagtggcgtgatctcggctcactgcaagctccacctcccaggttcacaccattctcctgcctcagcctcccaagtagctaggactacaggcacccgccaccacgcctggctaattttttgtatttttagtagagacggggtttcattgtgttagccaggatggtctcgatctcctgacctcgtgatccacccacctcagccttccaaagtactgggattacaggcgtgagccactgtgcctggccaggagaattgtttgaacgtgggaggcggaggttgcagtgagccgagatcgtgccactgcactccagcctgggcaacagagtgagactctgtctcaaaaaaaaaaaaaaaaaaaaaaaaagaattgtgtcaaatcaaaggccagttctttggaggttttgtagatctgcagcaccaagtaggtgcttgacacatattttcaggagttcttttgtcatcactgaatcaaatgcaaccttagtttttccagcccattctgtcagcctagtcccaggttcccttttgcagtgtcctctcaggtgtggccattcagtgcctgtcatccaagtccatttttggatccttgagtcatttttcttctaatctctcaaactccatattcaactcatcagtaaattctttctctggtatctcaaaagcattttcaattaactctgtaactcaactctacgcccttaattttcagtacagatgctcctcggtttatgatggtgttttctcctgatacacccatcacaaattgaaaatatcttaagttgaaaatgctttcgatacctctaacctactgaacatcataggttagcttagcccaccttacattaatctatagttgggcaaagtcatctaatacaaagcctattttataataaggtgtcaaatatctcatgtaatttattgaatactgtactgaaagtgaaaaacagaatggttgtatgggtacttgaagtacggtttctactgaatatgtattgcttttgcaccaccatagagttgaaaaattgcaagtcgacctattgtaagttggagattgcctgcactgccatctctcatctggaaactacagtagcctccaaaatatgcttcctgcttcccctctggtccctcactgatccttgatcacagagcagctggaatgatcatcaaaacgcatccatcagatcatctgacttttcttctcaaaactttggatggcttcccacatctcttacaagacatcctaaattccttaggatggcaacatcttattccctgcttcctgtgtctctcttcaaccttatctcataatctcactttccccctttcttgctcaccacatctctgatcctggttcctttcggttctgggaacaagtcaaactctttccagtctcagggcctttgcacctgttgatatctctgacccaaagtgttacatagccccacccttgttgcatgtaggttttggcacaaatgtcacctcctcagagaggtttttcctcaccattttgttttattttatttatattttttgagacagagtttcactcttgttgcccaggctggagtgcaatggtgccatcttggctcattgcaatctctgccacccaggttcaagcgattctcctgcctcagcctcccgagaagctgggattacagacatgcaccaccacacccagctaatgtttgtatttttagtagagatagggtttcaccatgttggccaggctggtcttgaactccggacctcaggtgatctgcccacctcggcctcccaaagtgctgggattacaggtgtgagccacctcacccagtcatccctcgccattttaaaagtagacacttcctgctattctctattcattccctattctttccttcctggtttctgctaccatctgtgattatgttgcttatttacttgtttattgtttgttttcccccataatactgtaaatctcatgaaagtaggaaccctatctatcatgcaccctcagtgcctagtgcagtgtttggcacaaaggaagtgctcaataaatttgttgaatgaatgaacaaacagaaaatcctttcaaatactgaggaaaaaaaatctgcttacttaaaatttctacagttggttctaattctgtttctactattgtttccaattctaaggcaacatgcaataattctgcagcttcatatacatgatcacatttcagatctttgatacccttttattttttgagacagagttttgctcttgttgcccagactggagtgcgatggtgtgatcttggctcacctcactgcaacctccacctcccaggttcaagcaattctcctgcctcagcctcccaagtagctgggattataggcacccaccaccacgcccagctaatttttttgtaattttagtagagatggggtttcaccatgttggccaggctggtttcgaactcctgacctcaggtgatccacacgcctcggcctctcaatgtgctgggattacaggtgtgagccaccatgtgtggccagatctttgatacccttcttaggcatcttacatctgtgctatttatactgctcaaccttcctttgtatggcatggtttctgactttctcatggcagtaatcactctctgttggaagactctagtttgacaacatccttcactaacaacaacaacaacaacaaaaaaataaaaatagaaaagccagcgtggtggctcatgcctgtaatcccagcactttgggaggccgaggtgggcggatcacgaggtcaggagattgagaccatcctggctaacacggtgaaaccccgtctctactaaaaatacaaaaaaattagccgggtgtggtggtacgcgcctgtagtcccagctattcaggaggctgaggcaggagaatggcataaacccgagaggcggagcttgcagtgagctgagatagcgccactacactccaacctgggtgacagagcgagactccgtctcacaaaaaaaaaaaaaaaaaaaaaaaagtgttctgaccgctgcaaggtctaatagcactcattctccttgattagaatcccatcagatttatggtctgtagttttcagaatctattgtttttggtttttttttttccgcaacgtatattgcaaaacagaacattccccaaggtttctggcgttttccccactctccatgatttctcaaacttaccgctagtggttctgtgattctatctgcaaatttcttttgtactctggaatataatttgtttggacccagaagatttaaaatcttgcctaaattttatatattttattttaaaatatacctagatttttccttgttctctaacttactgtaggctccagttttcccttttcatcatctactttgctgcacagttagaaatcagaatccattctcctcgctccagaagatggaatttgagtatttggtagtttgtactttttgtcacctgttaacatttcaccatcttcttggaccttcacttccttcttcatcttctcttccttatcctcttccttcttcttcccttctttaatctttcatcttttgttctctcctccttccctccctccctccttccttccctccctctccttcttaccttccctccttccttctttccttcttctctcctttctccttctttcctttcctccttcctccctcccttcctccttccctcctgctctacttccttccctctctctctctttcctttccttctttccctccttccttctttccttctttccttcctccctccctccctcccccttccctccttccttccttccctcccttccttccttccttctttccttcctccctccctccctcccccttacctccctgccttccttccggcgggcgtacttgcgggcgggcggggctgcgggggggcgtgggtagggggggggggtggggggggggcgggggggggggggggggggggggggggggggggggggggggggggggggggggggggggggggggggggggggggggggggagggaggggggggtgagagggggggggggggggggggggggggggggggggggggggggggggggggagggggggggggggggggggggggggggggggggggggggagggggggggggggggggggggggggggggggaggggggggggggaggggggggggggggggggggggggggggggggggggggggggggggggggggggggggggggggggggggagggggggggggggggggggggggcgggggcggggggggggagggggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaggagtaacaagaacttaacaaaacacaatagataaataaaaaaaaaaattataccaacatttataaaaaccctataaagcaaaatataaaagagaaaatataaaaaaaataaggaccacaaataagtacaaataaggaaacaataatcgcccaaaaaaccaaaaaaaagtatttgaatagagatagtagtcccaataagaggaaaacaacacaaaaaaataacaattataaaaaacctaataaagaagaaaagaaaacaacagaaaaaataagaaagtataataaaagtgttcacaaatatgggaaacactacaaatagagaccaattaggagcgaaataaataataaagaatataataagaggagatttataaaccaaatgaagaaaaaaatgaggataaaaaaataagaacataatataaaataccacaaaaattttaaaaagagacatttattaaacggaaaaaaagtataatcaattaaaaaataaacatagaaaattcaaaaaagagagaaaagacaataatagtgaaacaaagagagaagaacatatataaggagtaaaattaatcatgaaaaattaaaacaagattaggataaaaaagattaatatataaaaaaagaattacgagttaagaattggagaaataaccaaaggaattatccaaaaaaataaaaatatgtagaagtaagcaccaaggaaaggaaaaagataaaataatgaaaaaaatgaaatattaaaaaaaaataaaaaagagaaataaaacctgtaaatccctgcttcctcccttccttccttctctcccaccccattctctctgaactgaatctatcatggaacacctttttaatctcacttgtttctgagatttcccactagctaaggctttagtcttcctaaaagccttctctcttctttttttttttttgttttgatcttggatatgggtcccttattattgcttgtgaacatgtctttaaaaaaaaaacaaaacatgagttcatgagagttttctgagtggccacactggcttataagtttacttatcctttccctatttacaggattgttcattattccattgccttggaatttatgtaatgctctctttctttgctattatggactcccaaaagacatggtcacattctcccaaggtctctataatttccatatagaaaccagttctttctctttggttaaaattgcatgcagaataccagtttctcctttgatctgagagctgaaattgttagctaggaaagtctcaaaatttttataggctgctctactttagcaaaatatgacctccaacagacataaagatagttcaagttcctatccctatgactgcttgcttgtagttatgtggtctgctttcaggaaggctcctccatgcctgggcacccaacctaagccctcgccctcgaaggaatcctgtttatgttttgcccgtaattcccggctgcttccgttcttactgagtaactttctgtacagaaacgggctatctttttgcatcctcttttcacatataaggctgcttcttcctgcctctctcaaaacaatgactctttctattgctgtatttcaggtaggagtcccatcacatctatgtgagaatggctgtgcttcttatattaacataagttaatttctttctttgcatctcatcctctgtgactcagtgtcagagatattttcgtgtttaagggatttttttttttgatgagtttctctcagttttaacaaaaactgacatatgagtaccatctacaagactccagcagtttccccggtatcccattcttctcatgtttgactctcattctccctcatcccctgagaagatttttccctctaattttctagtgttccatccctttaaaattctctcttggctggatacgttggctcacgcctgtaatccgagtactttgggaggccgaggcgggtggatcacgaggtcaggagttcaagacccgcctggccagcatggtgaaaccctatctctactaaaaatacaaaaaattagcagggcgtggtggcgggtgcctgtaatcccagctactcaggaggctgaggcagagaattgcttgaacccaggaagcagagtttgcagtgaaccgagatcacgccactgcactccagcctgggcgacagagcgagactccatctcaaaaagaaaaagtcttccttaaatttttttttttttttcgagacagagtctcactctgtcacccaggctggagtacagcggtgcgatctcggctcactgcaacctccacctcccaggttcaagtgattctcctgcctcagcctcccaactagctgggattacaggcatgcgccaccacacctggctaatttttgtattgtttttagtagagacagggtttcaccatgtgggccaggctggactcaaactcctgacctcaggtgaaccacccgccctaggcctcccagattgctgggattacaggcgtgagccaccacacctggcccaaattttttcactgagcaaatactcttgtgtatggaaaggcatttctcttggactttgcctgctcctctgctagctgatcatcacagtaactggtggtcaccccaggaaccgggggtgttacagatatagaagataccccgcacaaaccggcaggaaaatgatttctaaatctcaatttagctgaccatgtgattctgatgaagaaccatatgagaagcatagatacaggaacacaacttgtagaagtggccccatgcagactgcaaagcaatgccctttgtggtacaaaattaagtgtctcctttttctttggattaggggaaggggctgtgagcaagggagaaggcggttcttggaagcaggtgggattggaagagggagagggggctttggggaggggagaggtctgcaggatttggccttcccttcccttctttccatcagacaaaccattctgcccctttagctcccctgagactaggaggaagccccttgccattgttctctatcactgcctcttttcttcctgcaggattgtgtcccacctaaacaatccccatttcctgcactgcctgccctggtggcttcttccaggacctcagggaagcaggcagcttcatctccaagtctcccaggcctgtggcctcaccccaccactcccaccctcacctcctttgtcaccccaggagttctctctggcattcatgcctgccccaccttgccccagacactgtacctgaggatgcagatctgggaggttgcatgtactcctgggctgtagtttaaggcttattcaaaggcctgtttgtaggcagtatggtataagcagtcgaaactagataaaggcagatttgggttcaaatccaaattttgctaccttccaaccagttgagttatttaatcattttgaatctcagggaccccatgtataaaatatggatagtaatcctagtaatgcacacagatatttgcgtgcacacacacacatattcacacacatatttcctggcatatatgttcaactgatgtatcaatgtttccccatctatgaaatggataaaataaataaatgacacctactttttttttttttttgagacagagtttcactcttgttgcttaggctagagtgcagtggtctcggctcactgcaacctctgcctcctgggttcaagctattctcctgcctcagcctcctgagtagctggcattacaggcgcccatcaccatgcctggctaatttttgtgtctttagtagagacgaggtttcaccatgttgggcagggtggtctcaaactcctgaccaaggcaatccacctgccttggtctcccaaagtgttgggattataggcatgagccacggtgagccacggcgcctggccatttcttttttttttttttttttttttgagactgagtcttgctctttgcccagactggagtgcagtgacatgatcttggctcaatgtaacctctgccaccaggctcaagcaattctcatgcctcagcctcccaagaagctgggattacaggcatgcaccaccacacctggctaatttttatatttttagtagagatgaggtttcaccacattggccaggcttgtctggaattcctggcctcaagcaatccgcctgcctcggcctcccaaagtgctaggattacaggcatgagccactgttcctggccaaatagcatctacttttagtgtttattttgaggaaagttaaaggaggaaaataagtacaataaattgtatccataattaataggtattgtggagaggtgtgtgggctactggcaagggtgattactttagagtcagattaagtttgagagctagttctgccactaactagctgtgtgatgggcaggatagtcaacctttctaagtctcattttcccaaactataaaatagcaactgtattagtccgttttcatgctgctgataaagacatacctgagactgggcaatttacaaaaaaaagaggtttattggacttacagttccacgtggctggggaggcctcacaatcatggtggaaggtgaaaggcaggtctcacgtggcggcagcaagagagagaacttgtgcaggggaacgcctctttttaaaaccatcagatcttgtgagacttatccactatcacaaaaacagcatgggaaggacctgcccttatgattcaattacctcccacctggtccctcccacaacatgtgggaattcaagatgagatttgggtggggacatagccaaaccatatcagcaacaattatagaacccacactctagaactgtcataatgaaacacgataatccacagacagcatccagtcctgcacttggtgctcagtgagggcttcacaagttgctgctgttactgttactagttgtattggttatttcattctccctgctgccctccctagctctggaccaggagtcacttctgttgccttgtggggaaggagaggaggacaatgagcaaaagaatccagaaggcacaaaatccagccctttggagagaggaaagtgaaaggcaggagcagctgaaagggacaaattcagagaggatgtgggtttagtggggataagcacctggcactttgtcgcttttattcttgtcttatgccttttccatcatttttatgggctggtgtgcagacatttgttgaaaggactcttccacctggatctcattgaaatcatgcagcctttctcttcactgaatatttttctatcccagtaactatataaatgttccatttgtgatgtaattgttctgtttcagattttctttcctaaactaaaaacgagagttaccccaaacattcgagacaatggcttgaatgtaatgctttgaatgatgaacttttcatttccaatggtttacatttattttttctatttagtggtctaccctctggtgctaggtggaggctccaaagggcaagggttacattgagaggaggatggagctgcagagacttactttcgatataaaaatttccactttttagagagaagcatgagctaaacagaggcagcttttacttgtttggaaatgcaatcagggtccttattttagttgcttaatatttctacaccaaacaaccagcttctgccaaaatcacttttacacagaaaatactctgttgcattaacgggctatggcagtgactttttcttgaagctaatgaactgtcattctacttcttggctctgccaaataaccatgcatgggaggaggaaggaggaatcaggaaagggccagagttttgcttaggcattttcaaacatagaagatggaccacatcttgttcaatgaggagatgaggctgactgttaagctgtttagttgtggtagatgaaaggaggacggcttcaagtgggtcaagccccatttctcctattcacttatttatatgggctgtaaatctcgattttattagccataaaatgggaagataatgcctagatagcagggctggctgaagcttagcagaaattagatgtgtgcacaagtgacccttctctcaagccatttgtgtgaatgtgataatatgtatgaggaattttcttttttcactggaggagaaaggggagtttctataataggtgtctttaaatgtagggagccaagagatggcaggaggaaaatggaagggtggtatgacaactgtgtcccatgccttgtcccttatcctgggcataagtttccctgttcctgactcccccacctctggcctaatgaagtacggattggaggacagcatagccttgaagcctaggtagccaggtggctcatgcctgttatccctgtactttgggaggctgaggcaggcggatcacttgaggttgggagttcaagaccagcctgaccaacatggagaaaccccgtctgtactaaaaatacaaaattagctgggcacggtggctcactcctctaatccctacactttgggaggctgaagcaggtagatcatctgacgttgggagttcgagaccagcctggcaaacgtggagaaaccccgtctctattaaaaatacaaaattagccaagcgtggtggtgcttgcctataatcccagctactcaggaggctgaggcaggagaatcgcttgaacccaggaggttgtggtaagccaagatcgtgctattgcactccagcctgggcaacaagagtgaaactccatctcaaaaaaaaaaaaaaaaagaagtcgtctaggtgacagaagtctcacctgaagatgagcagagccactgttgctcattccaccaaaaatctgttgcaccctaagggctcaggagaaacaccagcagcaaagtgctgctctcaaatggcttggaggccatgagtgagcaactctgaggatccggagagtagaggggtgtgtgtccttattcatgagccaatctgagacagcttctaggacacctagaaggcaataaaggagacttcaagtgatgagggtgtggggggatcagggctattgaaggcttgtaggtctacaggtggaggcttcattgtaatgggagctcacaagttggtgaggcctggagacatgtgaaatagttgtcctagataatatttcagtgtgaatttaaaaagagaaagagaaaggccatgtgaaagcactttgcaaattttagtgttatagaaaagtgcagaattggtattatgaagaagacattctgggatcgagcacagcccctgttagggtggctctgccaaggccagactcacgtgagaggtatcaggtaacagggataccgaaatgctccccaaaggccaggtgtggtggctcacgtctgtaatcctagcactttgcaaggccgaggcgggtggatcacctgaagtcgggagtttgagaccagcctggccaatatggcgaaaccctgtctctactaaaaatacaaaaattaaccgggcatggtggcgtgcacctgtagtcccagctacttgggagactgaggcagaagaatcatttgaacccaggaggcggaggctgcggtgagtggagattgcaccactacactccagcctgggcgacagagtgagactctgtctcattgaaaaaaaaaaaaaagtaaaagaaagaaatgctccttgcggcaatacatgggaattttgttgagcacctgctgtgtcctcagaattctttcatctgcttaggattcaaatacaattaattctcagtctctgttcttcagcagctcactgtccaaagggagtctctctccccggtccacatgctgaggcttgctccagagtgaatgtgtgcactggaaagaacccacacaggccccctgagagctgtcagccttgccaggcttctgtgagatccctgggtccgagtagccaagctgggaggagcaccatttgcccactgactcttgggcaacgctgcagcctgcatcccagccggcagaaggcaggtggtatcacagctgagtttacagccacggaaggaaccactgtaggcttttagtagataatatgttttctctgcttcaaatccttattttggttgcttaaaatttctgcagaaaacaaacagcttctgccaaaattggctcacaaaattagcttactagtataatcagttgtatagcaagtatttactgagtagctcttggaaggcagtcaacacaagagggatggatcattcttccagttcatcacacgtgggttggacatgctaacagtccccgatagctatcaggcgagtaaatggatgatcacacaaaggcagaggcatcgcagaaggatgctaactagatgtcatgcgtcaaggatactacagaaggatctctttgctgacaaggagggtacctctaaggttccttcagatgggatggttctctgttcaccgtgatcactactatgcaaaggcctgtgggccatttaggagaaaagcattcagtccaattccacagacacagtgaggatgtaatatgccctaggcatatatgagtggatccaaggaggaaatactcagtcactactgtcaagaactcatgacctgctgcagggtttgccaaactatggcttgtgggccaatctggctcaccacctattttagtaaataatgttttactggaatccagacacgcttgtttgattacatattgtctatggctgctgagcacccactataagggcaaagttaagtagatagagactttatcacccacaaaacctaaaatatttgactggatggccctctacagaaaaagcctgcgaacctgtggtcttgtgggaggacactgctgggcacagttaactctaattcttggctgtagcatcttgaatagggtggcagtccctggctgctgagggggacagctggacggctgcctcccaggggcatttccatgacttgcaggcccagaaactagacttgggcatgaccacagagttcttgatggactgaagatgcccaaaccacagactgacttgtaggctagaaatgaacatgtggggtggaatagtccttttggggactagaataatttctagagagccaccctttctacatgatacggcgcacattcaagtgtggctacttacactgagactttctgatgagcacgactagacagcagggggcccccaggatagtttgttcaggtcaaggtaagatgagaggagaaactagccctgtcccttgctggacaccaccactccagtgcctgaaatccaacctccccacccccatcagcattcctcccctggaaaagattggaaaatgcaagaatgtgcttctttgactctggccttcctctaacagccctgcttctgttaacacagcctttttgcagcttccttgacgtcattggctacaggctacagctgttgctagtcaaaggcattgttcctttgagctagcaggcactttgttctctcccatgacacattgttttatgagctcactctagaggagaaacattctatccctgtgctcaagttcttcaggagcacctcactgtctccctctgcccacccacctgcacctgacagctgtgggctgtgctctcagggaggcaccgtcagatgctaccagactacagaggagagcaccctcaatcctgactgaaggtttgggaaaaggctgctcagaagaggtgatacttgatatgggccctggaggaggagaagcagtttgagaagacagcagtgagagatggcatccgggcaggcgagaaatgtcagtggtcatggaggcagcatgaagggactgttggctgcagaaacctggcaaggctcttagagacagagacgaagagggagatggggctggagatggagatgatagagacagaaagattgaagatggcagagtgggggctatggggaagggtgatgaagcaggaaagatagatcgaacgagactgcgaggagcctgtgtgcctgggctttattttggaggcaatgagaaacagaaagtgtttttgagcatgatgggacaatgaggagttctgtggtttaggaaacccagcagtcacgggaagtgcagattcaaagtaagaaaacgtcccagggtttggtgatgatcttggtgggaagtgacacaggggtagtggggatggaattgaaagaaaggatgaacttccagagtatggctgtgctcagtagacaggaatcagggagggcaggaggagagtaaaagggtcctctgagcttaaatccagatgttgaggagatggtggtactatcaatggaggtggagctcttaagaggaagaaagatgggaaagaaaaggatgaggtttttgacaagttgaatatggggtgagcatgggtccaactgaaagcagtggaaatatagacgtgaaaaatagatgcggtagagttgaaaagttggggataattttcacctgaatgttacctaaggcaaagggaagagaggtcatccaggacaaaagtacagaatgaaaagaaaaagcaactaagcacgaaatcttggagaatgtcctcattgaagggtgagcagatgaagaggagcccacaaaagagactgaggaattgtcttcattcactcattcatgcatgtattcatttggtcaacaaatattttttggcacctcccatggacaggtcctgagcaccaagggtacagtcagaaatgatgaatccagaaatgatgccctccagaacttctggtgaggaaggcactcaggaaaatgcagcaccctatggaggcccagaaaggagggcattcaggaagaacacagtctgatggtgtcaagtgcagcggaggctaagaggtagggaggaaaagatggtaaaaggagagaactggggaggcaagagggacaaatgagggagaagagaagggagaggaaatacaacagaggcacagagtggggatttgtctgattcaagaatcctaggcggggcgcggtggctcacacctgtgatcccagcactttgggaggccaaggtgggtggatcgcctgaggttgggagtttgagaccagcctggccaacatggtgaaaccctgtctctactaaaatacaaaattagctgggcatggtggggcgggtgcccatagacccagctacttgggaggccaaggcaggagaatcgcttgaacccaggaggcagaggttgcagtgagccaagattgcttcatggcactccagcctgggtgacagagtgagactccatctaaaaaatgaaagaaaaaagaatcctatgttctttcccctggccttaccttagaaagcagagtgaatgccgacctaatcaggtttacctccattgccatagcaacctctgggactcactttggtgcacattcttgagacctgaagtgaagaagttaactttatatcaagttacctaccaattaggctagcgatttctctgtcttttaaaacattcttttaaagtcttgtcatgtttcatctttctagaattcatttttcacatcttcattcactgggattctggaccataatatatgtaaacacacaaaatactaaagattgaaaatac

SEQ ID NO: 936 - DNA, 43722 bp, Homo sapiens
  misc_feature (33826)..(34825): n is a, c, g, or t
tccacgttggctggtttgaaactgtggtgagtgaattcagaaaataaatagtgttgattctttagagctttgaggctttgaagaaaataataacccttagtaattaacatgcctgtttgtttttagatcttttgaatgtaatccaggaaaggaatggaaaggaaagaagtgctcagaaagctcccagaagcattttggcactcaccaaagcagccggaagatgaataacacagtggggatagatggctaagtgggtcctatttatgtgttattcatcgacactagaaaacgtgctttaattcaaagcattgttttctcttcaagtgtctccagtcagcatcacgtagctttactaaatgcttttggtaatgctagagttatttcagcgtaccaagtgtctttgagtagtcccttaaggaaataaagctaagaaaagaagagggcagacagagggcattcgaccacaaagagtgagaatttcattggcttgtagaagaatccttcttggaaatggaatagtttatagcagagattcccaggcacacatgttcttaagaacaaaggggcctttggaatgctgtatcagtgaggatgcttttagttgcaagtaactgcagatccaactccagactggttaagccaagaggagatttattatcttgcgtaacaaatgcttaagtagccgtgcttcacccaaggcacactgggcttctggttccacttctctgtggcttctggatttgtcctcttctctttgtgggcttcatcctgcagcagctctgagcatcacatccactcacaacagagtcttgtggtctgtttggccccgccttgcctggacatgtgtatgttcattagggagtactgattcttctcaatgaggaggtgctggaaccagctgccagtgaggacagcagaggttgaaaagactgagaggtactagaaaagtaagaaaggaatgtataattgtgaataggttaaccccagctcttgaggaggacgtgcctaccttcagtcacctttttccgacatctgggataaaacaaaccagcaaatcaagtgagagcaataccgcactccacagtttactgctggcataaccccttaaaagaagaaacaaaatcttaagtgatcgtaaatgaaagaggtactctaagcagagacacatgttttccaagttaaggcaagagcaatagcattattgccttatatttgtttttgtttggttggttggttttattttttccttgacacaagttctcgctctgttgcccaggctggagtgcagtggaaccatctcgggtcactgcagccttgacttcctgggctcaagcaatcctcctgcctcagcctcccgaatagctgggatcacagtggggtcttgccatgttgcccaggctgatcttgaactcctggcctcaagcaatcctccagactctccaagtgctgggattataggtgtgggccactgtgcccagcctttttatttttattttttaagatacggggtttcattctgttgcccagactggagtggagtagcacaattacagctcacagcagtctccaactcttggcctcatgggatcctcccacttcagcctcctcagtagccagtattacaggcgcatgccatcatgccctacctttatatttgttaatataagcattatgacagcaggattttttttttcttattcactactggatctgcagtgattagaccaatgaataacacactgtatattctcaataaatatctgtcaaatgaatgagtcatggtgtgggcagtttaatagtttaaaaagacccagaaagagacagagagggatctgggttacagtgccaactatatcatttactagctgtagaatcttttttgttgttgtttgtttgtttgtttgttttgagacagggtctcactcttgtcgcccaggctggagtgcagtggtgtgatctcagctcattgcaacctcgacctcccagactcaggtgattcttccacctcagcctcccaggtagctgggactacaggcatgcaccaccacgcttggctaattttctgtattattattatttttttagagatggggttttgccacattgcccaggctgatcttggactccttggctaaagtgatcaacctgcctcagcctcccaaattgttgcgatttacaggcatgagccaccaagcccagcctgtagaatcctttctgtgcctcaatttcctcttctgtaaaatggggataatagaaacctgcttcatcgggttgttgtgagaattaaatgaatcaatacatgtaaagtgcttagaacagtgccaagcccatagtaagccctcaggaattgttgactgttcattatcactgctaccacttactaagtttttgacttctataagcctgagtttcctcacttgtaaaatgggaataataaaaggtacctcattttgaggatgaaatgagacattgtttattctttcctcacaacatcaggcacgcgattaggaacaacttggccaaaggtcactataattccttatctatctcagtgctttttatttacaaacttatttttattcccataatatattgattcccacaaaaacttaatgagagaacaggtcaactatatgccccttttacaggtggagaaactaacacatggagcagctaaaagcctgttaagactcactttatagacagatagtagagccagaagtcaacacagcagccacccgatgcttctcattgcagatcttccacattctaacacaatttttaagcagagacttcatagctggagagtgactttattgagcaaacgtacaatattggctcagaaatggaggacttataaaaactgtttctaggtgggatagtgtctggaatttgtgggttcttggtctcactgacttcaagaataaagctgcggaccctcgtggtgagtgttacagttcttaaagatagtgtatccggagtatgttccttctgatgttcagacgtgttcggagtttcttccttctggtgggttcgtggtctcactggcttcaggagtgaagctgcagacctttgcggtgagtgttacagctcctaaggcggcgcgtctggagttgctcgttcctcctgtccggagttgttcgttcctcccggtgggttcgtggtctcggtggcctcaagagtgaagctgcagaccttcacggtgagtgtcacatctcataaagacagtgtggacccaaagagtgagcagcagcaagatttattgcaaagagcgaaagaacaaagcttccacgttgtggaaggggacccaagcaggttgccactgctagctcgggcagcctgcttttattcccttatctgaccccacccacatcctgctgattggcccattttacagagagccgattagtccgttttgacagggtgctgattggtgtgtttacaatccctgaggtagacacagagtgctgatgggtgtatttacaatcctctagctagaggtaaaagttctctaagtccccactagattagctagacacagagcactgattggtgcatttacaaaccttgagatagacacagggtgctgattggtgcgtttacaaaccttgagctagacacagagtgctgattggtgcctttacaatcctttagctagacataaaagttctccaagtccccaccccacccaggagcccagctggcttcccctagtggatgctgcgccggggcaatgggtggagctgcctgccagtcccacacagtgcacccgcactcctcagtccttgggcggttgatgggaccaggcgcggtggagcacggggcggcgcctgtcggggaggctcgggccatgcaggaacccactgcaggggggcttgggcatggcgggctgcaggtcccgagccctgccccgcaggaaggcgtctgaggcccagcaagaatttgagcgtggcgcgggccggccagcagtgctgggggacctggcgcaccctccgcagctgctggcccgggtgctaagctcctcactgcctggggccagcggcaccggccggctgcttcaagtgcgggcccactgagcccgcgcccatccagaactcgcactggccagtgagtgctgcacgcagccctggttcccgcctgtgcctctccctctacccctctctgcaagcagagggagccggctccagcctcggccagcccagagagggtctcccacagtgcagcagcaggctgaagggctcctcaagcatggccagagtggatgccgaggccgaggaggtgctgagagtgagtgaggcctgctagcacgttgtcacctctcaggatgatgtaggggaaggagggaggaagtgaccaggacaggaaataacatttcacaagaagtgctcttaagggaggaaggttagaatgatccatgtggtattggattagagttagagacatcagaatgaactcacgaatttagcttaatatagctacagatggttacaaatagatatttgcagatatgtatcgattcatggattagtatgtatagatacatacattttattgctctgtcagctaaaagggcctagaaaccacaacaccccaatagtaatgagcacccctagcacccagatcttggtttctaataccattctctagtaaaagaaaccaggaatcactggagaaatggctgattctagggctgcactaataacatacaaaaggaaactatagtgccagaaagtaaggaagtgctggggtaaaaagataggggtatgtcaaagggatgcaagagccaactgaaaaggttaccaatggccaaagcttgaacaacttgagcaataaagtaaataatgtagtattggctgataacccaaagtataaaataaatgttaatccacctaacagaaatacatgattgtatgaataaataaatgggggagaagagataaatctcccttgcagaagaattccaaataatttatgtagatactcccccatcaaggaggtggaagatattcttaccccttaagtgggggctgcatataatgacttctttccaaagagtccaggatggaaagaagggagaaaagagtaactttacagtggagaagtctgataaaccctacctcaatcagaagatcaagttaatatcaatagtgataagtcaacttgatagttaggtacccttcaggtgatgccatgagaatggtactttatctcagtggtcttccttccaaaaacccataacccctatctagccatgagaaaaatgccagacaaactcaaagtgaagaatattctataaaatgcctgacacctgaccagtatttctcaaaactattaaggtcatcaaaaataaggaaattctgagaaactgtcacagccaggaggagcttaagtagacatgacaactaaatgtaacattgtatcctggatgaaatcctggggcagaagagagatgtttggttaaaactaaagaaatttgaattaactaaggactgtaattaagaagacatcaatattttttagttttgataaatatgccatatgaatgtgagatgttaataagagaaaccaagaatggaatattcaggaactttctgtactatattttcttttctgtaaatctaaaactattctaaaatttaaagtttgtcaaaaattaattgggctgctagggcagcaacaacaacaataaaaaagacatggaaaacaaaaagcaaatgagaaaatagaaaacaaacagcaaaatgatgaatgtatgctcaaccatataaatatgttcattgtaagtggtctaaacactgcaattaaaagccagatattgtcagagaattttaaaaatacaatatccaggctggatgtggtggctcatgcctgtaatcccagcactttgggaggccaaggcgggcagatcacttgaggtcaggagtttgagaccagcctggccaacatggtaaaaccccgtctctactaaaaatacaaaaattagctgggtgtggtaggacatgtgcctgtaatcttagctaccccaggaggctgaagaaggagaatctcttgaacctgggaggtggaggctgcagtgagccaagatctcaccattgcactctagcctgggtgacagagcaagactccatctcaaaaaaaaaaaaaaaaaaaacaaacaaaaaaaacaatattcagtgtatgctgtctatacaagaaaccactttaaatataaagatacagatagattaaaataaaagatggagatacatataccaatcaagcaataatcaagagaaagctggagtagatacaaagtagagttcataacaaggaatatgatcatagataaagaggacatttcataataaaggcgttatttcattaagaagacaacagttctaatgtgtatgtacttaataatggagctttgaaatatacacaacaaaaactgatagaactgaaaggagaatagagtaagagttttcgttggagatttcaatactcttctctcagtaatgatagaacaagtagaaaagagaaaataagaatacaaagtaagtgaagataaagacttgaacaaattcccacccagaacatcagaataaattgcacgtcttttacatagcacattgatggctgtcactttttaatccagtctaaaaatctatactttctaatttcagtgtttaatctcttacatttgattgatgtaatttctggtggtgtgagtttatgaatcatgttgctttgttttccatgtgttctttctttctttgttccttcttgactgccttctcttagattattttcacattctttttatcttctttattgcttcttacctatgtctctttgggtttttttttttaaataatgatggctctagtgatttcaatatgcaaccttaatttatcattgtctacactgaataaatattatagtacttcatggacagaataatgacttaaaacactataattccatttacagcctttatccctttgtgctattttgttatgtgtttcacttctacgtatgttacaaaccccacaacacttgctattatttttatctaaacactcaaacatcttttcaaaattaaaaaaataaaaactagtcttttatatttacccacatatttaccttttttagtgcttttcattccttcctgtagattccttctgaaatctggcttccatctgggataacttccctttagctgaaaaaaactctagagattttagtgatataaacatataaacaaaatggcccatttcttgtagtttgggtctgttggtaacacattctctgagctttttttttttttttccattaaaagtgtctttatttccccctcattctgaagtttattttcacaggatgtagaattctaggttgataattgttatgtatttttaaaacacttggccaggcacggtggctcacgcttgtaatcctagcactttgggaagcccaggcggatggattgcctgagctcaggagattgagaccagcctgagcaacatggtgaaactcgtctctactaaaatacaaaaaaaaaaaaaaaaattagccggcatggcagtgtgtgcctgtagtcccagctactcaggaggctgaggtgggagaattgcttgaacccaggaggcagaagttgcagtggctgagattgtgccactgtactccagcctggtgacagagtgagactccgtctcaaaaaataaaaacaaacaaacaaaaaaaccatttcaatgatatggttttactctattctgaattctattatttctgataaaaagtcagttgtcatccatgtctctcctcccacattccaaaccccctctttctcccaaatataaagtgtatttttttctttgacttttttttttttttttttttggagacagggccacagttctgtcccaggttagaatgcagtgagttttgtttttgccacaactcactgcagcctcgacctcccaggctcaagtaatcctcttgcctcagcctcctgagtagctaagaccacacaccaccatgcctggctaattttttattttttgtagagacgaggtatcattatattgcccaggatggtctcaaactcctggacacaagcaatctgctcaacttaccctcccaaaatgctaggattatatacctttcaacatttattttatccaattttctttgtccttgctttctgagactccaattctatgtatattagactatttgatattgtccccccaaattaatatttttatttttaatctttttcttctctgtgcttctgttaagataatttctattcacttgtctttaaattttccaatgctttatccccctgtgtccagtattcttaggaatttagttcacatatcctccttttcattgttcactggctttaaaaagtagacagacagacagatatttttcccttggcttgagtaacagtcttttacaactgtctacattttaattggaaatagaaccttgagtgggtcttaagcagtcttatatcatacaaagaacatgctaaaaatgtagtatttctgggaaatactatcagacatcagacaatatctaggatattaaaaaaaaattccttaggtggttctaatgcaggagtccccacacacccttaaagaaacactaatttgttgttagaagctgaagtcaaaataaaagttagcagtcaaatgcaaatgagtttcaattgaggcctcaggaagaccatcaacaaagctatcagattgctttactaaattcaactttcgaaaactcatagccattatgaaaaccagtgtggaggttcctcaaaaaattaaaaatgtaactaccatatgatccagattagtaccttcacctatgagcagacttctgggtatatgtccagaggaactgaaatcagcatcttacagagatatctaacccatcatgttcatggccgcattattcacaatagccaagatatggaatcatcccaagtgtccactgatggatgagtaaataaagaaaatgtagtataggcacacagtggaatactattcagcctttgaaaagaaggaagtcctgtcatctgtgactacacggattaacctggaagatattatgctaagtaaaataagccaggcacagaaagataaatactgcacgatctcatttatatgtggaatctacaaaagtcaaactcatagaggcagagagtagaatggtggttgctaggggctggggagtggtggggtggtagagtgggggtggggagatgttggtcaaagggtacaaagtttcaattagacagaataaataagttttggagatttattgtataccatggtgactatagttaatgataatgttttgtatacttgaaaattgctaagagaatagatcttaaatgttccaaccacaaaaaaaggataagtatgtgaggtgacagatatgttattagcttgatataatcatttcacaatgtatatgtaagaacatcaggttgcacaccataaacatatacaatatttatttgtcaattataccttaataaagctggtggagggacaacttaatttaaataaactggtaaatatggaaacagacatggcctgtaatttccaaaagccatgtagttactccatttcatttgttcttgattttatgctgggctgtagctcctcagtgaaccaactaaagtcataattagacagttttaggagacaagaacgtcttcagtgatgtgtataggcaggcttgcataactctttgaaagatctccaaagaggaatatgaatgattgagaacacatagatctgctatttaccaattaatcctaaggttccatggcctggaacaattaccaagagctaaagacattaacttggatattgtgtggctatcaagaaaggactctaatttttgaacaaatataccagaaattatgcactcaaatgagtgcagttctcttcaacaggcaaaaagaaattgagtatcaaccctgcttcattggtttcactccctagagagttgcattggggattttaaggtagaatatagctcagcgggaaagagtcatctatgagcatggtctgccatgaacatggctagggtccatggcaacagaagtggtacataattgcccttcctgggttaatggtaagagcctcgggtttgaagccttgagcataaatttggctctgccatctactaactgtgagatcttgtgaaaacacattctctgagtctcaatttattttatttaatggtaattggtcacaaaaaatttccactttctatttcataggtatacatgtgatatcccctttgaaacttaacagtgcactaatagcaagttgttcttcaaggaagtcactttggtaggctatgatcttatttacaacaattctgtcattgcacattctttgggagtgcatttataaacagtttgagcaatttgggagaagcacttttacatgtccctgtgatggctaattttatgtgtcaatttggctatggtaagggatacccagaaaatgaaaaaaaaattatttctgggtgtatctggaagggtattttcagaagatattagcatttgaattagtagactgagtaaagaagattacctctcatcagtgtgggcaggtatcagcaaatccatcaagggcccaaatagaataaaaaggcagaggggggcgaattctctctctttttcttgagctagatgtccatcttctcctgcccttggacattagagctcctggctcttgtgcctttggattctaggacttataccggagccctcttgcctccaactgggagatacaccattggctcccgtagttctcaggcctttggatttggactgaaccatgggaattggctcacaaagttatggaggccaggaagtcccatgatatgccatttgcaaactggagaaccagcatcatgggacttcttggcttccataattgtgtgaaccaattcccatagtacatctcctcttatgtatccataattattctatttgttctgtttctccagggaatcctgactaatacacggtgttttgataattcagctagatcacctacaaatcgatcaggaactttggattcaaatgatatcattgttgccaaaaatcgaattcactattagtggatgaagatttgttaccactgggttattaaaaagcgtaggccacaggcttttgaagattcttcccaaagaggaattccaaaaatgatttatgcaattgcagcctcattagtgtaagagtatggtctcccaagggagctatgttgaaggctgaaactcacttgaatatgtaatcttctgttagcttgtttaattaatcggtcattttgcgttagaatctcatggatgtatagcagagttaccatgctttgaatgagaatgatggtcacacactgatcctgcagtaatctctaagaatataaacaaggtagcccagatgaactctcaccctctgatagagagggaattggagctttctggcgcttactgataacataacaagaatatcttcagtgatgtgtataggcaggcctgtataactctttggaagacctccaaagaggaatatgaatgataagtctccaagcaaacaactatttgtaaccccagaattataaaatatagatgtaatacggttgtgaaaatcctttctgtttgggccaggcacagtggcttatgcctgtgaatcactttgggaggccaaggtgggaggattgtttgagcccaggagttcaagaccagcctgggcaacatagtgagatcctgtctttacaaaaaaattaaaaattagccagttgtggtagcacatgcctgtggtcccagctgtttggaaggctgagatggaggactgcttgagcccaggaggttgaaactgcagtgagccatatctacaccacagtactccagccacttcagctttgaggacagagcgagaccctgtctcaagaaataaaaaaaaaataggaatgaaaaaagaaaatcctgtttgttcaaaagtaactactatggttaggcaaaggcaggaaatgttagaagaaatgcagcgagaagtccttggaaggagtatattttagcattggagtctgggctacgtgaaggagatgttgacacagatccaatcctaaactgttagggagggtgcagtatctctctgagactgtgtcatgagggatctctgcccttttcctgagctttagagggtcatactctagactttttctctctatgagaagaggagtccacgggctaaagggttgtgccccccttaagcccactgtggtagaaggaattctaagatggcacccaagattcacgcactctctatcttccccctctttgagtgtgagtgtgacctatgaatcacactccatgattaggtgacattatatggcaaaagtggagggatttgcagatataattatcgtttctcatcagttaactataagtcaacaaaaaaagattgtcctggatggaccttacttagtaaggtgaaatcctttaaaagagggctgaacccttcatgaaaagagagaatctgctggtcttgaagaatcaagttgccattagttctatagccacaaggaaatgaattctgccaatgaccatttgagcttgaaagaggactctgaacctcagatgaaactgcagccctggttgacaccttgactgcagtccagtgagaccctgagcagaggaaccagttaagccacactcagactcttgacccaaggaaatcatgagataatggacatgtgttgttgtaaggcattaagttggtggtgacttgagatgcagcatggaacaggaattcacccatgcctcatcttctagtctaatggcacgcaaagtttgatctgtttactgctggtccaggatgagctaagtatagaaagtgagagtaagtggtactttttatggcaatttaacactgctgaaatatttaaattatattttacaaaaatgtggatccacagtagagtgaactttttaaaaaaagcatttttcaccagataagtactgttctagttcatgatctgccttcttagaattctgaattctctgcccacctgaccctgaaagaggaatgaattagctcttcaagggcctgctcagtcctctttctttggtctgcctgtataagggcagacagtgctgctgctgaactaacccctagccctgacagttggccaagaaacagctctttatgggggttgaagatggagcttcagatgtgtgggttggcaggttcacacatgactataagcacctggaagtgctggatagaaagatgggaagagaagagaggaataaccaggggccagaagctatgaatggctgttcatatgtaacctcaaaattccctgctaaaacatgggaaatcccaaatttttaagttcaaatacagctttcgggtcattgtgaaggtctattggccaaagtagaaggaaagaacatattttatttaatattatgctagcttggcttatgtttttaaacattctagacatatgctatgccggccttcatttgttctcctgtactggccttgtaaatatgttaagagtgggcctggagagtggtctcttctggaacacttccatctacttctcccagagattgcaaacctagaatctggagctgctgaagtggaagggttttgttcttttttgttgttgtttttagtgatgcctcatcataattaacacaaaaaggttttctgcactaatgatgcttagatttttttaacccatttttctctaactgcatgatggtaggtgctatggtttgaatgcctcccaaaatctgcatgttggaaacttaatactcaggcagcattgttgggagttggggcctaatgagaggtgattaggccataagggggaagtaaatggattaaaacccatttatgcctagtgttccattattggaacactaagcatgtaggagttatttatatctactgctcaaggtctgattggcaaaaattcaaaaaattgcaacctcaggcagaaatggtttaatactgttatcatggaaatgggtttgttataaaagggtgtgtctggcccccttttatctctctctcttttgcccttccaccttgggatggcacagcaagaagcccctctccggatgccggcccctcttggacttcccagcttccagaattgtgagccagtcaatttctgttcattataaattacccagtctcaggtattctgttatagcagcacaaaacagactaagacagtgggttatcctaaatccatactatgccagcgagaaccaaggggtgtagcatgtttcctgagcagtgtttcagatccccagcagaaggtaaatgctgtaaattactgtgcatttgccacagtgtagtagactgaatagtggccaccaaagatatccaggtcctaatccctaacacctgtgaatactaatgtaatgtgtcaaaacaggctttgtagatgtgattaagtcaaggaattttcgatggagagagtatcctagattaacttggtgggacctaaatgcaatcacaaatgaccttataagagagaggcagagggagacttgacaccatataaagaaatgggacattaaggcaagaggctgaggtattggctttgaagatggaggaaggggccacaagccaaggaatgcaaagagtacatctctagaagctcaaaagataagaaaaaggattctccccaaaagcctccagaaggagtgcaaccctaccgatgccatgatcttgggctaatgtaactgattttacattctgacccccagaactattggagaataaaagtgtgttatttgaagccactaagtttgtggtaatttgtcacagcaggtaaagtaaactaatatacacagcaaacaatgagaatatttttaaaatctgaattaaaagtctgggattttggtgtgtgtgcaaccactaccagttttctagatactcttctagagacaaggtattgtgaaacagacaatataagtgagaatggaagagagtaacacagacccaaagggcatgcttcaaaagccacaggggaggccagatcccagctgacacaccactttagaataagagtgtttcctcaaaataactgaaggaacaccgagaagggctatagatgtgttcagctttattcccacagttgacatttataatgtatcagtccctccctgttaatagcttgactgacagacaatcaaaggatgtgtgggactcataaatagtccgaagcacacccaagagggagcatttgtaatgcagccttcagagactaggtagaaaggaaaggaagggagcaaaggaaaactcagggaggaatttaagggacaagtgttcctgaccaaaatgtcagagcctggactaagctcttgatcacaaagaaatggtgagaagccccgtagctgaaattactgtgagagcccgttggagtcagaggaagtatttgtggtgggattacagggaaacttttctacttcttgtctccacataagccccaggttagtcccaaaggactgtggatgctgttgaggcttagtgaacacccagtaatgggagaagaagagactcgctttcagtaccatattcccttgggtacagagaaaaagctcaggccgttttgaaaacagctgctgcacttttcccaaatgacctttctttgttcccttcagctccaagcccttggactcattctccatttttctctttatgcaggtgtatgtttaagctcaggctggaaaaggatcactgaaagtcacttggatggtgtctcgtgtgtctgtgatgagcttgctgttgctttctttctccttgacaggtgggtttatttcttatggaatcagaccttttggctacagtgttctctaaacagctgtaataccatctcactcagttaacctaactttggatctgatgtacatcagaataaaacctatagagaatagagctgacttccccaaatccatgtgcctccactaacccccaaggagcttagtgtggctggttgtgaatgacagtgatctccgtgatgagaagtaatccctcctctagaaatactttacctgttttctttggtgcttaacaccctctgcatgagacattgctctatgggctttcatctcccctgtgacaaaggacacatctttctcatttccacattccctcctcttgcttctcccccatgccacctcccctttgtccctctaccaacacataggtacctgcgtcagttaggcacctactctacagcccatggaacaaataaagctttcaaacattagttatttaatcaatgggtcaaaaaaaaacagtatctgaatatgcgcagcatctaacctttttgatgggcttttgaatctagtgcctcattttgtctcttcaacatccctctgaactcagtataacaagtagtaatagccccattgaacatataaaaaaacctgacatctgggaaagttttaacttaggaaaaggtcacattgcagattattggcagagttcacattagaatctgtttcttactctgttgtcctcaccactatactatggtgctttcgttcattgagttgacctatggtaaagttataagccttgctgtttttgcaagtggggagactgggacttgggcatctgaattttgacctggaggttaatggtgtcaataggaatgtaactgcatgcagtctcttagatggatggatggtaagaaaacctttactttctatataactccagaagacaattctgtcattttaaactacaaatatcaactatggtttttttgggaggaatatttattatttaattttaaaaaattatttttgatacaaagtcttgtgctgttgcccaggctggagtgcagtggcgccatcttgacttatgtagtctcttcctcccaggctcaagcaatcctcctgcctcagcctcctgagtagctgggactacaggtgtgcaccaccacaccggactaatttttatattttctgtagaggcgggtttcaccatgttgcccaggctggtctcaaactcttgggctcaagcaatcctcccgcctctgcctccaagtgttgggattgcaggtgtgagccactgcacccagccaattttttttttaagtttcttgtgggtaccctgtaggtgtatatatttgtggagtacatgagatgttttgatacaggtctgcagtgtgtaataatcacatcatggagactggggtatcccttctctcaatcacctcccttttgttttactatttatttatttttaaatgaactcttatttatgtgagatgactttgttaagggtgaggacagggacagatacttgcttccttttctgccatgtcactgccagtccatattagagcccactctggaggctaatgaatttttcttctctctgtgtcccgtcagccccagtcccctctgcccattggacccactcttcccaggaccccgggttcacagctaatgcctttcagtcagaggcaggagtagattatttagtttcttcccagagaaactccccacagcccaaaccacatttatcctgcaaatattaaccacttttcatagcagtgcatccatgagttattatgctaacagctgcctctgcttcattgtgcaaaagatattttcccagcaaagggtggggacgcagggcagaggagggtgagaagggaggaaaatcccaccctgtcacgctcgtttaaagttatcatgtgccgcccgccccccattcattcaacacacatttaccttctggcagcaactgcgttatgagatataaatatgaatagaatgcaatgctctacctaagggaattcatggctaagaaaaagaaatagacacaaataggtttgttgtaaagcgaagtggaattagagcaggtccagcaaagaaaggcagcagggacaagggacaggcattccaggcagcaggacagggtgagccgaggcatggaggtgggaaacagctcactgtgtgtgtcgtatctctccaggcaaagctccctgaaagaggaaagagccagggaagtgacaagcagagcccagaggggcttgcaagccatgttaaggagcttaggggtggggtgggaactgaagggtttcaagcaggggaacaatggcagatgcgcagttgcgtggatggtagatgggaggatggatcagattagggcaaaactgaaagcagggaccagtcacaagaggaacttcattccagggagagatgttgagggtctgaactgaggcagtgcagtgggaagagaaggatgaattagaaaacagttgcagagggacttgggaggtcatgggagctagatggggatgagggctgagggagaagtagcagtctggaggggtctttgagtaaggctggaacccctctctagaactctctgcccagtgcccagagaacctcacaggagataagaagatggacacacagagttgatggctgctcaagacattgtcccctcccctacaatcccccgttcaaagctggtgaggagtatggccaagcagtctgaccccaggactgtggtcctcagcagggcgagggtggggaggatttcgaaagtgggagaccagagtgaagcaagaggctgtcagcggaaggactggaagggccaggcccacgtggtcacgtgtttgcagctttagctaattcatcctcccaacgtctctatgagggtgacacagttattgccccattttacaggggagaaaattgaggctcagcaggtaatctgtggccaagttacagaccacagtgctggcatgtggagggcatttcctccagctcagcataactggcatgggagaaagactggcttcaccacagcaagccccacagggccatcagagtggaccagggaatagtgcagccggggagacctaagcagaacttccagtgacaaggagaggattctctggaggcagctgggaggggcccatgagacgcctttgggcattcacaaaaggtgtgagggctttggggtcccagcagatttcctcagggtggggtagggtagaggtagggaaagaggctgaaaaagatcatgattttgttgcaattttattaaccatctttcttagtttttacctgcatttatatgcaggctaacagcccctgaaagagttcataaactcagcctctgaatctgtcccatcatccccacaagcatcctgggaaagagagtcttttcattttctctgtctctgtctctctctcaacagatgagaaaacagtggcttcaaaggttaaacaacttgtcttcgattgcacagctaacaagaggtaaaactggaatttgaatcgtggtactgtgacttcagaggccaggttcgtagcgctacactaacacagagaccagaagaagccttgacattatcataaaaccacagacatgatacaaggccaggaagaaggaggcttgggagcttattagctgaaatatattgatcaccttttcacagctttctcttattatcctcccaatgtctctgtgaggacagtacagttatcaccccattctagagatgaggaaactgaagctcagaggtgttaagaaacttgttctaggtcacacagctagtaatgcttgggatcaggatttgaatttagatttgtcatattccaaagtttacctatagtctcagctactagggaggctaaggcaggagaattgcttgagcccaggagtttgatttcagattgagcaacatagtaagatcccatgtcaaaaaagaaaaataaacaggtgaaattaattttaacaatatgctttacctaacccaatatatgcaaaatattacattttaacatgtaatcaatattttcaaagttaataatgaataccagaaataacacatgtgctaataacatgtacgctgcaacactaatatcttacctgatacaacagttaaaatcaagtcccaccagagcaataaagttgtgtctaccagaaaaatattttacactgcttccatttttaaatttacatttaaattaattgacattaagtaacatttaaaactcagttcctcagtcacacgggctacattttaagtgtgcaacaaccacatatggctagtggccacagtggtgctggttaatgagcacagctctaagccttccttgtgtgtttttttaaaaattcaattcagattccacttccattgtttgcttgtttaaccttaaaatctgtgtgttttaacagacctgtgtttaagccttataagtcccatcacaaagtgtcagtggtttggagagaggttctagaacgttctctttgtaacattatcacaaatctgtggttgttaggctgctcttggtttatgtttgagttaaaccctttgtgtggtgtcagaccaattcaggcttatgttttccccggagagaggaataagctgctattttggaccctgtcgtgatccctgcccagagtcaaaagtaattcccaagcagactgatttttacagggtcatgctcctctgatcttctctccaggagtgtgattttcaacgggatagagaaaggcaaactcctgaggaaaaatttctctgggaaagcccaggctgaagtcgaggagggaagaggacgaaaggctgacagggttgccgtctctgagggagatccactcacacacctcaggaggcattgtgggatggtcaaagtggggaggaagaaagggaatcttcgaaagaaacttgcggcggggcacggtggctcacgcctgtaatcccagcactttgggaggctgagatgagtggatcacaaggtcaggagttcgagaccagcctggtctggccaacatggtgaaaccctgtctctactaaaaatacaaaaattggccgggctcggtggctcacgcctgtaatgccagcgctttgggaggccgaggcaggtggatcccctgaggtcaggagttcaagaccagcctgaccaacatggagaagccccgtctctactaaaaatacaaaaaaaaaaaaaaaaaaaattagccaggcatgatggcacacacctgtaatcccggctacttgggaggctgaggcaggagaattgcttgagcccgggaggcagaggttgcggtgagccgagatttcaccattgcactccggcctgggcaacaagagcaaaactctgtctcaacaacaacaacaaaaaattatccgggcgtggtggcatgcacctgtaatcctagctacttaagatgctgaggcaggataattgcttgaacccggtaggcagaggttgcagtgagcagaaatcgcaccactgcaccccagcttgggtgacagagcaagactctgtctcggaaaaaaaaagaaaaaaagaaagaaacttaggctgaaaggtttaaatggacacagaacagcaaactcaaggacttccatagctactgggaaccagcacagggctgacacctccattgaactctctttgctattctagaatattttaataatgagacacacccaaaacatgtttagaatcatgccacctgctgcttctcatggccagcattatttgtcatcaaatctgatcccaatgtttgccatattattggatatcctgtgaaatagaatctaaaaatatacattttttccctctaaatcggtcctaaccttacagctagggttgcaactgtaatattgttgtctgtttcattttactttccaggattaggtaataatattaaattccccatctcatgttagtttctgtttgaacttggcctggtatttgaagaatatatttagaagttaaagcgtgctactttttatcccatgcaagccagttgtgggttcatagatctgtggtatctcataacattttctgtcctaaactgaacacatccagtctctccaaattgaagttcctcagctgaggttattttcatttcggagaatttcttgagagttgtttctgttatagaggataaagggatagaggagtcacagctgcctaaagtcagtgcctctttaaatacaggccttccttgcctccaggacttgatgtcttcctttagtggagggcagctcctcaattgaagagggcgggattgagggagcagttgaagcagcaggttcgcctgggctcatgcttttctcttgtgtggctgctgttacagggaccttcaggcacgttctaggaaagccaattaaagcagaaaaggcccttagaaccaaattgattgcccccagtatagctgttaaactttgagagagcagctgggtgcttcttgtggccctgatagtgccagattgttcatgctgccttaggctttcctgtaacatttttgaaaacccttgttatatccagtttaatgacatgtattgatcagaacaaaaagggctgaggtactgactccaggatcaactcacagacagaaccatacatttctattttttagattctgcaaagcacccaagtcaaacataggattattcccagggtcatgaccatacagcattttatctgtgaagaacagatagtttaagtcctttatttccatttgatttcaaatgtggataaagaaacaactaatttattttcagaaatgtacatcacctctgactctcaaattagcacctgattttcttattttcactttgaaaccgctgtgtgctattttgattctctagaaagagttaaacttctcataggcattaaacccaagtggaaatagttggcccaaggcctaaacttgttctttatgagaaatacaagactcgaagggattctagcctttttagaattatcatagaatgtgtacaggaagcatgacattggcagaaagggaacataggtgccttttaccgtgtttatatggacatgggttctgggttttacagatggggaaatattgtacgagtccatggggatatgtagtgaaatggagagggagagggagaaagaaagagagagagagagagagagagagagagagaaagagatattcttttgtactttcagactgagcagtttacccaagtcagagaagcaagggtatacaggtaaagtacagaatagtctggaataatgtcattattgtttggtctctttacttctttatagggcatctcagagagagaacacagtttctcaaagtggatggaaggtgtattataagtttttaacccagaataaccaaaacaatcttgaaaatgaacaaaattgaagattcatacttcctgatttcaaaacttactacaaagcttaagtaaacaaggcagtgtagtgctggcagagactaggcatagagactaatggagcagaattgagattccaaaaataaacccatacatctatggtaattgattttcaactagaatatcaagcccattcaataggttaagaatgtttcttttcaacaattggtgctggtacaactgcttatccacaggcaaacaaatgaatctggaaccctacctcacaccatatacaagaattagaatggatcaaaagacccaagtgtaaaagctaaaagtgtaaaacccttagaagcaaacaggtatatatctttgcgaccttggatttagcaattttgtttttgtttttgttttgagacagaatcttgctctgtcacccaggctggagtgcagtggtgtgatgtgggctccctgcaacctctgcctcccgggttcaagcgattttcctgcctcagtctcctgagtggctgggaccacaggtgtgggccaccacacccagccaatttttttatttttagtcaagatggagtttcaccatgttggacatgctggtcttgagctcctgacctcaagtaatctgcctgcctcagcctcccaaagtgctgggattacaggcgtgagcgactgcacctggctggcaatggttttttagttatgatgttgaaagcacaagcaactaaaaaaagagagaaaaatcagatttcatcaaaattaaacatttttgtgtgtcaaaagagactatcaagaaagtaaaaaaacaacctacagaatgggagaaaatatatgcaaatcttatattgggtaagggtctagtatctaaaatatatgaaggactcttactattcaacaataaagagacaaatagctcaacttaaaagtggtcaaaacatgtgaatagacacttctctaatatacgaatggccaatacacacatgaaaagatgctctacataattagccgtcagggaagtaaaaatcaaaaccacattagataccacttcacactcactaggatgctataataaatttcttttaaatggaaaataacaagcgttggcatggctgtggagactggaaccttcatacattgttagagggaatataaaattgtgcagccactttggaaaacagtttccagtacctctacaagttaaacacaaagttaccatatgacccagctccactcctaggtatatacccaggagaattgaaggcatatgtttatacaaaaacatacatgaatggtcatagcggcattattaataataacccaaaagcaaaaacaacccaattgtccatcaactgatgattgataaacacaatgtgacatattcatactagacaattaaataaaagaaaactttttttttttttgagacaggatccggatctctctctgtcacccaggctgcagtgcagtggcatggtcttggcttgttgcagccttggcctcccggactgaagctatccttccacctccctcgcagagcccgcttcccccaccaatagctgggattatcagcgtgcaccaccacatacagctaattttagtattttttatagagacagagtttccccatcttgcccaggcccacctgtctcatcctcccaaagtgctgggattacagacgtgcgcctctgcacccagcccagaaaacttcttacacattagcacccactccctattcaccgctccccacagcccttggcaaccacgaatctattttctgtctctatggatttgccaattctggacatttcatataaatagaatcatacagtatgtggccttgtgtgtgtgtgtgcgagtgtgtttgtgtgtatgtctggcttctttccttagcatactgttttcaaggttcacacatgttgtagttatgtaccaatcctttattcccttttattgccaaataatactacattgtctaaagcaagtctaacttaaaggaaaaaaaaaaaaatatatatatatatatatatatatatatatatatatatatatatatatatttcattgtatgattataccacattttgttcatccattcatcaattgatagacatttttgggttatttccacattttgggctcttatgaagaatgctgatataagccttcataaacaaatttttgtgtggtctgtggtcatgttttcacttctcttgggtttttgtatatattttaaatgctgtaaaaactttcctgacttagataataatgattcctttattgacaagtataaagctttctcatcaaaagatagaaaactgactccattttgtatcacagtatcacatccttagaacattgagagctcaaaaagaactcagacacctgctgggtgagaccctgattctattgacaaggcctagagaggtggggtgaccactacaggtaagacagccagtgaatgacagagacagacacagaaccatggtctcccaacctacatccccttcccatctagatggacatcatctttaaccccgtgactcttacccagagtgaaccatcggtctttccagagtctgggaggggaatgtttccatggtgaagatgacttcccagagtgggaccttagggggtagtagacatcccctacctcccccaaaccattccccttctccataacttgctacagtacttgcagtttcaccagcagccaatccactggttgaatggagggctcacaaatgaatggcctatgggggccagagaggaatgaaacagagtggattgggcaggctggcaagctggaaagcacatgccccccccacgaaatagcttaggacaaaagccacaggatctgtgttcgtgaaacatcttggaggcttggggttgagcaagtggcttcttagcccagcgtgcaagatttggcatgtgggccatgctagcctccctgtagcgctggcattctgaaatctcagagatgctgctacagaggaaagccaggcattgcagggcaaggctctcacagtggccgccagcacctcatggtggcacgaaacttgagcaggagaggaagggtgggcttgttcctgagcaccagaagctgcaactaccctggcacccttttgttaactggggagaacctttgaggagatgctggtgaacgttccatgcaggggctgagaaccatcacaatttggcccataatactgcaaacaaagtccagcaagcctaggaaatttaggattcatctctaaaacagtattctctgtttagaagcatatagaatattttataatccaaatgagttgattgcctcttggcttgcgttagcgagatgctatcattgcaataagcggaaatctcaactctgttagcttaggcaaaccatacaactcattggggattcagattgctgttccttggtcttgctgtttgccttgctacatgcgtatgaatgtgcagatgacaagaacagatgccagggcccctggaagatcaaagtcctggcgctgccttagaaaatctgtccatgccacatccctaaatctgcaggaaggccatagtaaatatgcaatagatatttgttccattgaatgaactctaaagcaaacccattcttaaccattcctatgtaagaccaaagcacatgtgcaggcggctgggaccaaaaacaaggagtagtacttttggggacacaattgtcactgctgtttccccactatcttagcattcggccacttctccaatatccagattaatttgctgcaatgaaaatttcctctcttttgtattaaaactaccctaacattattttcatggttatttttccaaaactggaaataagaacacattgtttctagattgtggacagtggttccagagaagggaaaaccagaagggttttatgactcaggaagaaagagctcccagaggggcccaggtggtttttcttccatcctcccctttacgatactctgaatatctttttttttttttttttgagacacagtcttgctctgtcacccagactggagcgcagtggcactatctctgcttactgcagcctctgcctcttaggtttaagcgattctcctacctcagactcccaagaagctgggattaaaggcacccaccaccactcccggctaatttttgtatttttagtggagacaggagttcaccatgttggccaggctggtctcaaactcctgacttcaagtgatccgcccacctcaccctcccaaagtgatgggattataggtgtgagccactgcgcctggcctgaatatctttttaaaaattattttggaaggttttctgacttgcccttcaacatttctagccttccctttctgtccccaacattaatctcccgcaagtctcttctccattgcttctccgcgttggcaggcccatatttttgtgtggcttctctctcctgtttactcaaaagctcataattacttttctcttgtggataaaaataagcagaatgccagtagtatgatttttaaaaagagaagcttcccagatgcctactcctgaccgcatggaatcattctgatgagagcatgcttaatcaatcgaccctgcattgtctgcaaggcttggttcaactggctgactccattatcctgtaaactgtgcaattttctctaaagacatttcaccagcacaactgcataaaacaaatgttgaatgggaaaaaaatcagtagtagatattttttaagacatcctaacaccattaaggtttttttccgctgcaacctgcatctggtagtaaaatctttcttttccagacattgttttctccaaagaatcattcaaaaagttactaccgtatgaaaactctttagccatttacattttgtgggttttaacaagcgtgtcttccaggctgactctggctggtagaggttttcacccattcctcaatgggcaccagaattctgatgagttcatgacattcagtttaagaaattacccgcggccaaagatcttgattggcaaggttagtacattttgccatatgttatgtgctatctctgtccccaaatatgcaactcttatggtgtgacaaattgtgggacgacacacgttgcagcccagacagttagacaaaacactccatcagaactgaaaccgcaggctaggtctctgaataagaaatatgcaaaaccacacctgccggccaacattgctgcttatttcttgctcctcttttttttcttaccacaaagaaaattaaatgtaaaatcaatttaatgttgagaaaaggacccagggtgagcttcccacgtacacttaattgagtcagtgatattttgtgtggcctagttatagcttgagtggtgcagctgagtgtaagctgtttgtgatttggagtttaaatcctatgtttaattattgccagtatcacataggatacagtggctgacaacgcaacagagttagacttaacagttgtctgtggtttgggcctggttatctgtttaagatcaatatattctaacaaaaattcttgccatggttaaatcctcatgtgttctgctattaggactcaatatttatgatacttgagggcaggaatttcttcataatggaaagtgatattattgggagtggtagagattcatttttgaaatccattctgacatggaaacgtcttaaggtcattgaatttcaaaaacttgtcttttaagggatagttttcttctgataatataacgagatgagaatgttgtgctgtcttgagtaaaatgtgtggtatttgtgtctgttgggtattaatgtgtattatgtgcattggaatcatgggtgccttctatattttaagtaatgagaaaaggtccacaattttataagctgtgtgtatgtgtgtgtgtgtgtgtgtgtgtgtgtgtgtgatctgtctatcatctatctatctatctatctatctatctatctatctatctatctatcatctatctatctttatttatatatagtaaagtatatatacaactttgccactgggagcactgtaagtttctataaccacttgcagtttaagaattgtgccaaattggccaggcatggtggctcatgcctgtaatcccagcactttcggaggccgaggcaggcagatcacctgaggtcaggagttcaagaccaggctggtcaacatgttatggtgagacccccgtctctactacaaatacaaaaatcagctgggcatggtggcacatgcctataatcccaattacttgggaggctgaggcaggataatttttttttttttttgaacggagtctcactctgtcacccaggctggagtgcagtggcgtgatctcggctcactgcaagctccacctcccaggttcacaccattctcctgcctcagcctcccaagtagctaggactacaggcacccgccaccacgcctggctaattttttgtatttttagtagagacggggtttcattgtgttagccaggatggtctcgatctcctgacctcgtgatccacccacctcagccttccaaagtactgggattacaggcgtgagccactgtgcctggccaggagaattgtttgaacgtgggaggcggaggttgcagtgagccgagatcgtgccactgcactccagcctgggcaacagagtgagactctgtctcaaaaaaaaaaaaaaaaaaaaaaaaagaattgtgtcaaatcaaaggccagttctttggaggttttgtagatctgcagcaccaagtaggtgcttgacacatattttcaggagttcttttgtcatcactgaatcaaatgcaaccttagtttttccagcccattctgtcagcctagtcccaggttcccttttgcagtgtcctctcaggtgtggccattcagtgcctgtcatccaagtccatttttggatccttgagtcatttttcttctaatctctcaaactccatattcaactcatcagtaaattctttctctggtatctcaaaagcattttcaattaactctgtaactcaactctacgcccttaattttcagtacagatgctcctcggtttatgatggtgttttctcctgatacacccatcacaaattgaaaatatcttaagttgaaaatgctttcgatacctctaacctactgaacatcataggttagcttagcccaccttacattaatctatagttgggcaaagtcatctaatacaaagcctattttataataaggtgtcaaatatctcatgtaatttattgaatactgtactgaaagtgaaaaacagaatggttgtatgggtacttgaagtacggtttctactgaatatgtattgcttttgcaccaccatagagttgaaaaattgcaagtcgacctattgtaagttggagattgcctgcactgccatctctcatctggaaactacagtagcctccaaaatatgcttcctgcttcccctctggtccctcactgatccttgatcacagagcagctggaatgatcatcaaaacgcatccatcagatcatctgacttttcttctcaaaactttggatggcttcccacatctcttacaagacatcctaaattccttaggatggcaacatcttattccctgcttcctgtgtctctcttcaaccttatctcataatctcactttccccctttcttgctcaccacatctctgatcctggttcctttcggttctgggaacaagtcaaactctttccagtctcagggcctttgcacctgttgatatctctgacccaaagtgttacatagccccacccttgttgcatgtaggttttggcacaaatgtcacctcctcagagaggtttttcctcaccattttgttttattttatttatattttttgagacagagtttcactcttgttgcccaggctggagtgcaatggtgccatcttggctcattgcaatctctgccacccaggttcaagcgattctcctgcctcagcctcccgagaagctgggattacagacatgcaccaccacacccagctaatgtttgtatttttagtagagatagggtttcaccatgttggccaggctggtcttgaactccggacctcaggtgatctgcccacctcggcctcccaaagtgctgggattacaggtgtgagccacctcacccagtcatccctcgccattttaaaagtagacacttcctgctattctctattcattccctattctttccttcctggtttctgctaccatctgtgattatgttgcttatttacttgtttattgtttgttttcccccataatactgtaaatctcatgaaagtaggaaccctatctatcatgcaccctcagtgcctagtgcagtgtttggcacaaaggaagtgctcaataaatttgttgaatgaatgaacaaacagaaaatcctttcaaatactgaggaaaaaaaatctgcttacttaaaatttctacagttggttctaattctgtttctactattgtttccaattctaaggcaacatgcaataattctgcagcttcatatacatgatcacatttcagatctttgatacccttttattttttgagacagagttttgctcttgttgcccagactggagtgcgatggtgtgatcttggctcacctcactgcaacctccacctcccaggttcaagcaattctcctgcctcagcctcccaagtagctgggattataggcacccaccaccacgcccagctaatttttttgtaattttagtagagatggggtttcaccatgttggccaggctggtttcgaactcctgacctcaggtgatccacacgcctcggcctctcaatgtgctgggattacaggtgtgagccaccatgtgtggccagatctttgatacccttcttaggcatcttacatctgtgctatttatactgctcaaccttcctttgtatggcatggtttctgactttctcatggcagtaatcactctctgttggaagactctagtttgacaacatccttcactaacaacaacaacaacaacaaaaaaataaaaatagaaaagccagcgtggtggctcatgcctgtaatcccagcactttgggaggccgaggtgggcggatcacgaggtcaggagattgagaccatcctggctaacacggtgaaaccccgtctctactaaaaatacaaaaaaattagccgggtgtggtggtacgcgcctgtagtcccagctattcaggaggctgaggcaggagaatggcataaacccgagaggcggagcttgcagtgagctgagatagcgccactacactccaacctgggtgacagagcgagactccgtctcacaaaaaaaaaaaaaaaaaaaaaaaagtgttctgaccgctgcaaggtctaatagcactcattctccttgattagaatcccatcagatttatggtctgtagttttcagaatctattgtttttggtttttttttttccgcaacgtatattgcaaaacagaacattccccaaggtttctggcgttttccccactctccatgatttctcaaacttaccgctagtggttctgtgattctatctgcaaatttcttttgtactctggaatataatttgtttggacccagaagatttaaaatcttgcctaaattttatatattttattttaaaatatacctagatttttccttgttctctaacttactgtaggctccagttttcccttttcatcatctactttgctgcacagttagaaatcagaatccattctcctcgctccagaagatggaatttgagtatttggtagtttgtactttttgtcacctgttaacatttcaccatcttcttggaccttcacttccttcttcatcttctcttccttatcctcttccttcttcttcccttctttaatctttcatcttttgttctctcctccttccctccctccctccttccttccctccctctccttcttaccttccctccttccttctttccttcttctctcctttctccttctttcctttcctccttcctccctcccttcctccttccctcctgctctacttccttccctctctctctctttcctttccttctttccctccttccttctttccttctttccttcctccctccctccctcccccttccctccttccttccttccctcccttccttccttccttctttccttcctccctccctccctcccccttacctccctgccttccttccggcgggcgtacttgcgggcgggcggggctgcgggggggcgtgggtagggggggggggtggggggggggcgggggggggggggggggggggggggggggggggggggggggggggggggggggggggggggggggggggggggggggggggagggaggggggggtgagagggggggggggggggggggggggggggggggggggggggggggggggggagggggggggggggggggggggggggggggggggggggggagggggggggggggggggggggggggggggggaggggggggggggaggggggggggggggggggggggggggggggggggggggggggggggggggggggggggggggggggggggagggggggggggggggggggggggcgggggcggggggggggagggggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaggagtaacaagaacttaacaaaacacaatagataaataaaaaaaaaaattataccaacatttataaaaaccctataaagcaaaatataaaagagaaaatataaaaaaaataaggaccacaaataagtacaaataaggaaacaataatcgcccaaaaaaccaaaaaaaagtatttgaatagagatagtagtcccaataagaggaaaacaacacaaaaaaataacaattataaaaaacctaataaagaagaaaagaaaacaacagaaaaaataagaaagtataataaaagtgttcacaaatatgggaaacactacaaatagagaccaattaggagcgaaataaataataaagaatataataagaggagatttataaaccaaatgaagaaaaaaatgaggataaaaaaataagaacataatataaaataccacaaaaattttaaaaagagacatttattaaacggaaaaaaagtataatcaattaaaaaataaacatagaaaattcaaaaaagagagaaaagacaataatagtgaaacaaagagagaagaacatatataaggagtaaaattaatcatgaaaaattaaaacaagattaggataaaaaagattaatatataaaaaaagaattacgagttaagaattggagaaataaccaaaggaattatccaaaaaaataaaaatatgtagaagtaagcaccaaggaaaggaaaaagataaaataatgaaaaaaatgaaatattaaaaaaaaataaaaaagagaaataaaacctgtaaatccctgcttcctcccttccttccttctctcccaccccattctctctgaactgaatctatcatggaacacctttttaatctcacttgtttctgagatttcccactagctaaggctttagtcttcctaaaagccttctctcttctttttttttttttgttttgatcttggatatgggtcccttattattgcttgtgaacatgtctttaaaaaaaaaacaaaacatgagttcatgagagttttctgagtggccacactggcttataagtttacttatcctttccctatttacaggattgttcattattccattgccttggaatttatgtaatgctctctttctttgctattatggactcccaaaagacatggtcacattctcccaaggtctctataatttccatatagaaaccagttctttctctttggttaaaattgcatgcagaataccagtttctcctttgatctgagagctgaaattgttagctaggaaagtctcaaaatttttataggctgctctactttagcaaaatatgacctccaacagacataaagatagttcaagttcctatccctatgactgcttgcttgtagttatgtggtctgctttcaggaaggctcctccatgcctgggcacccaacctaagccctcgccctcgaaggaatcctgtttatgttttgcccgtaattcccggctgcttccgttcttactgagtaactttctgtacagaaacgggctatctttttgcatcctcttttcacatataaggctgcttcttcctgcctctctcaaaacaatgactctttctattgctgtatttcaggtaggagtcccatcacatctatgtgagaatggctgtgcttcttatattaacataagttaatttctttctttgcatctcatcctctgtgactcagtgtcagagatattttcgtgtttaagggatttttttttttgatgagtttctctcagttttaacaaaaactgacatatgagtaccatctacaagactccagcagtttccccggtatcccattcttctcatgtttgactctcattctccctcatcccctgagaagatttttccctctaattttctagtgttccatccctttaaaattctctcttggctggatacgttggctcacgcctgtaatccgagtactttgggaggccgaggcgggtggatcacgaggtcaggagttcaagacccgcctggccagcatggtgaaaccctatctctactaaaaatacaaaaaattagcagggcgtggtggcgggtgcctgtaatcccagctactcaggaggctgaggcagagaattgcttgaacccaggaagcagagtttgcagtgaaccgagatcacgccactgcactccagcctgggcgacagagcgagactccatctcaaaaagaaaaagtcttccttaaatttttttttttttttcgagacagagtctcactctgtcacccaggctggagtacagcggtgcgatctcggctcactgcaacctccacctcccaggttcaagtgattctcctgcctcagcctcccaactagctgggattacaggcatgcgccaccacacctggctaatttttgtattgtttttagtagagacagggtttcaccatgtgggccaggctggactcaaactcctgacctcaggtgaaccacccgccctaggcctcccagattgctgggattacaggcgtgagccaccacacctggcccaaattttttcactgagcaaatactcttgtgtatggaaaggcatttctcttggactttgcctgctcctctgctagctgatcatcacagtaactggtggtcaccccaggaaccgggggtgttacagatatagaagataccccgcacaaaccggcaggaaaatgatttctaaatctcaatttagctgaccatgtgattctgatgaagaaccatatgagaagcatagatacaggaacacaacttgtagaagtggccccatgcagactgcaaagcaatgccctttgtggtacaaaattaagtgtctcctttttctttggattaggggaaggggctgtgagcaagggagaaggcggttcttggaagcaggtgggattggaagagggagagggggctttggggaggggagaggtctgcaggatttggccttcccttcccttctttccatcagacaaaccattctgcccctttagctcccctgagactaggaggaagccccttgccattgttctctatcactgcctcttttcttcctgcaggattgtgtcccacctaaacaatccccatttcctgcactgcctgccctggtggcttcttccaggacctcagggaagcaggcagcttcatctccaagtctcccaggcctgtggcctcaccccaccactcccaccctcacctcctttgtcaccccaggagttctctctggcattcatgcctgccccaccttgccccagacactgtacctgaggatgcagatctgggaggttgcatgtactcctgggctgtagtttaaggcttattcaaaggcctgtttgtaggcagtatggtataagcagtcgaaactagataaaggcagatttgggttcaaatccaaattttgctaccttccaaccagttgagttatttaatcattttgaatctcagggaccccatgtataaaatatggatagtaatcctagtaatgcacacagatatttgcgtgcacacacacacatattcacacacatatttcctggcatatatgttcaactgatgtatcaatgtttccccatctatgaaatggataaaataaataaatgacacctactttttttttttttttgagacagagtttcactcttgttgcttaggctagagtgcagtggtctcggctcactgcaacctctgcctcctgggttcaagctattctcctgcctcagcctcctgagtagctggcattacaggcgcccatcaccatgcctggctaatttttgtgtctttagtagagacgaggtttcaccatgttgggcagggtggtctcaaactcctgaccaaggcaatccacctgccttggtctcccaaagtgttgggattataggcatgagccacggtgagccacggcgcctggccatttcttttttttttttttttttttttgagactgagtcttgctctttgcccagactggagtgcagtgacatgatcttggctcaatgtaacctctgccaccaggctcaagcaattctcatgcctcagcctcccaagaagctgggattacaggcatgcaccaccacacctggctaatttttatatttttagtagagatgaggtttcaccacattggccaggcttgtctggaattcctggcctcaagcaatccgcctgcctcggcctcccaaagtgctaggattacaggcatgagccactgttcctggccaaatagcatctacttttagtgtttattttgaggaaagttaaaggaggaaaataagtacaataaattgtatccataattaataggtattgtggagaggtgtgtgggctactggcaagggtgattactttagagtcagattaagtttgagagctagttctgccactaactagctgtgtgatgggcaggatagtcaacctttctaagtctcattttcccaaactataaaatagcaactgtattagtccgttttcatgctgctgataaagacatacctgagactgggcaatttacaaaaaaaagaggtttattggacttacagttccacgtggctggggaggcctcacaatcatggtggaaggtgaaaggcaggtctcacgtggcggcagcaagagagagaacttgtgcaggggaacgcctctttttaaaaccatcagatcttgtgagacttatccactatcacaaaaacagcatgggaaggacctgcccttatgattcaattacctcccacctggtccctcccacaacatgtgggaattcaagatgagatttgggtggggacatagccaaaccatatcagcaacaattatagaacccacactctagaactgtcataatgaaacacgataatccacagacagcatccagtcctgcacttggtgctcagtgagggcttcacaagttgctgctgttactgttactagttgtattggttatttcattctccctgctgccctccctagctctggaccaggagtcacttctgttgccttgtggggaaggagaggaggacaatgagcaaaagaatccagaaggcacaaaatccagccctttggagagaggaaagtgaaaggcaggagcagctgaaagggacaaattcagagaggatgtgggtttagtggggataagcacctggcactttgtcgcttttattcttgtcttatgccttttccatcatttttatgggctggtgtgcagacatttgttgaaaggactcttccacctggatctcattgaaatcatgcagcctttctcttcactgaatatttttctatcccagtaactatataaatgttccatttgtgatgtaattgttctgtttcagattttctttcctaaactaaaaacgagagttaccccaaacattcgagacaatggcttgaatgtaatgctttgaatgatgaacttttcatttccaatggtttacatttattttttctatttagtggtctaccctctggtgctaggtggaggctccaaagggcaagggttacattgagaggaggatggagctgcagagacttactttcgatataaaaatttccactttttagagagaagcatgagctaaacagaggcagcttttacttgtttggaaatgcaatcagggtccttattttagttgcttaatatttctacaccaaacaaccagcttctgccaaaatcacttttacacagaaaatactctgttgcattaacgggctatggcagtgactttttcttgaagctaatgaactgtcattctacttcttggctctgccaaataaccatgcatgggaggaggaaggaggaatcaggaaagggccagagttttgcttaggcattttcaaacatagaagatggaccacatcttgttcaatgaggagatgaggctgactgttaagctgtttagttgtggtagatgaaaggaggacggcttcaagtgggtcaagccccatttctcctattcacttatttatatgggctgtaaatctcgattttattagccataaaatgggaagataatgcctagatagcagggctggctgaagcttagcagaaattagatgtgtgcacaagtgacccttctctcaagccatttgtgtgaatgtgataatatgtatgaggaattttcttttttcactggaggagaaaggggagtttctataataggtgtctttaaatgtagggagccaagagatggcaggaggaaaatggaagggtggtatgacaactgtgtcccatgccttgtcccttatcctgggcataagtttccctgttcctgactcccccacctctggcctaatgaagtacggattggaggacagcatagccttgaagcctaggtagccaggtggctcatgcctgttatccctgtactttgggaggctgaggcaggcggatcacttgaggttgggagttcaagaccagcctgaccaacatggagaaaccccgtctgtactaaaaatacaaaattagctgggcacggtggctcactcctctaatccctacactttgggaggctgaagcaggtagatcatctgacgttgggagttcgagaccagcctggcaaacgtggagaaaccccgtctctattaaaaatacaaaattagccaagcgtggtggtgcttgcctataatcccagctactcaggaggctgaggcaggagaatcgcttgaacccaggaggttgtggtaagccaagatcgtgctattgcactccagcctgggcaacaagagtgaaactccatctcaaaaaaaaaaaaaaaaagaagtcgtctaggtgacagaagtctcacctgaagatgagcagagccactgttgctcattccaccaaaaatctgttgcaccctaagggctcaggagaaacaccagcagcaaagtgctgctctcaaatggcttggaggccatgagtgagcaactctgaggatccggagagtagaggggtgtgtgtccttattcatgagccaatctgagacagcttctaggacacctagaaggcaataaaggagacttcaagtgatgagggtgtggggggatcagggctattgaaggcttgtaggtctacaggtggaggcttcattgtaatgggagctcacaagttggtgaggcctggagacatgtgaaatagttgtcctagataatatttcagtgtgaatttaaaaagagaaagagaaaggccatgtgaaagcactttgcaaattttagtgttatagaaaagtgcagaattggtattatgaagaagacattctgggatcgagcacagcccctgttagggtggctctgccaaggccagactcacgtgagaggtatcaggtaacagggataccgaaatgctccccaaaggccaggtgtggtggctcacgtctgtaatcctagcactttgcaaggccgaggcgggtggatcacctgaagtcgggagtttgagaccagcctggccaatatggcgaaaccctgtctctactaaaaatacaaaaattaaccgggcatggtggcgtgcacctgtagtcccagctacttgggagactgaggcagaagaatcatttgaacccaggaggcggaggctgcggtgagtggagattgcaccactacactccagcctgggcgacagagtgagactctgtctcattgaaaaaaaaaaaaaagtaaaagaaagaaatgctccttgcggcaatacatgggaattttgttgagcacctgctgtgtcctcagaattctttcatctgcttaggattcaaatacaattaattctcagtctctgttcttcagcagctcactgtccaaagggagtctctctccccggtccacatgctgaggcttgctccagagtgaatgtgtgcactggaaagaacccacacaggccccctgagagctgtcagccttgccaggcttctgtgagatccctgggtccgagtagccaagctgggaggagcaccatttgcccactgactcttgggcaacgctgcagcctgcatcccagccggcagaaggcaggtggtatcacagctgagtttacagccacggaaggaaccactgtaggcttttagtagataatatgttttctctgcttcaaatccttattttggttgcttaaaatttctgcagaaaacaaacagcttctgccaaaattggctcacaaaattagcttactagtataatcagttgtatagcaagtatttactgagtagctcttggaaggcagtcaacacaagagggatggatcattcttccagttcatcacacgtgggttggacatgctaacagtccccgatagctatcaggcgagtaaatggatgatcacacaaaggcagaggcatcgcagaaggatgctaactagatgtcatgcgtcaaggatactacagaaggatctctttgctgacaaggagggtacctctaaggttccttcagatgggatggttctctgttcaccgtgatcactactatgcaaaggcctgtgggccatttaggagaaaagcattcagtccaattccacagacacagtgaggatgtaatatgccctaggcatatatgagtggatccaaggaggaaatactcagtcactactgtcaagaactcatgacctgctgcagggtttgccaaactatggcttgtgggccaatctggctcaccacctattttagtaaataatgttttactggaatccagacacgcttgtttgattacatattgtctatggctgctgagcacccactataagggcaaagttaagtagatagagactttatcacccacaaaacctaaaatatttgactggatggccctctacagaaaaagcctgcgaacctgtggtcttgtgggaggacactgctgggcacagttaactctaattcttggctgtagcatcttgaatagggtggcagtccctggctgctgagggggacagctggacggctgcctcccaggggcatttccatgacttgc

SEQ ID NO: 937 - DNA, 45366 bp, Homo sapiens
aagaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggaagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtacatgcccagagatcatttagggtgggtgccaggatgagattggtttatggttcttttgttcttcagaaccaaattatgcctgggttgttcagtaagcacattccattatgactggtcatgccaagttgctccttgtttatgatattcttagaaaatcactcagcagaacccagcagttattttactagctgaagggctatttgctgaaggcctttgagccaaacgagttgtttaatttattgcccactaagtacatacagttgttcagtcatcaattctaacttcttagagcagccttccttctaaaatctatgtcctgtttctggggactttatagttgaatatgtcagggtggcagttgggaattgctttcccagtatacgaagcagctagtttggctgtgtggctgggagtgtattagtgaataaagcataaataatatttttttaaaaatcaagtgatatctgtaaaaagtataggctgagtcttaaagtttaaattctaaaaaaggaagggaagtagaaaaggggtagcagtatgcattcgtcattacttgaattaaggattgtttaaaaccatgtccgtattagtataaaacaagtaaagaattaaccaggggtagtggcgcatgactgtagttgcagctacttgggaggctgaggtgggaggatcgcttgagcccaggagctctcagccagccagcttaggcaacatagggagaccccgtctccaaaaagaaaaaaaaaaaagtgaaaaattattttttaaaagctaagttaatttcttggtgggttatgtgtaaaacatccttacaatatattgctcaaaccagaacatacttcagagtaaaattatgccagatggcaggcatacactgggaacttctgagcaaattggttggtatggtcactctacttcaaggcaacaataggaaacaaataaggaaactaacaaactaatgttttacaatgataattggtttgaagaaaacaaaacaggatgatatgaatgtggaaagtaggaatgggcttaatgtatctttaaaatgctacaaatgaattcttgaaacctgcagctttctttaatcactagtagaaggcttttctttttcacgctcctatcattctctctcttctttttttttttttttttttttgtgatggagtttcactcttgttgcccaggctggagtgcaatggcataatctcagctcactgcaacctccgtcacctgggttcaagcaattctctcggctcagcgttccgagtagcagggattacaggcatgcaccatcatgcctggctaattttgtatttttaatagagacgagggttctccatgttggtcaggctagtctcgaactcctgacctcaggtgatttgcccccccttggcctcccaaaactctgggattacaggcatgagccaccgcatccggctgtatcattctcgttttaaaaatcatcctgcattgtcactcattgaagaagagtgtatctgtccttcatggtgcagctcaaacccattgccttcattactctttctttagcctccctaatcagaccatgggctccccaccccagatcttcggctttggatgtgtttctagcatcctttaatcctgccttgagtgactccctttcccctgactcatgacctatgacctgctgccttttgcacattgagtgcttaggaaaagcaatgctctgactgcatagacctaaagccctaaatccagagatatgtttaccacttcctggccctgccttcttaataatctccttctggataggtccaacattcctgtaaacatggtggtttctaatcagctctgatgtttgtcatttccaatacctgttcttggaggaatgttttacttcctgcaatccataggcatttgtctttgaggttgaagggatttcattgttgttattatgaagatcccattccagctttgagtctggttttggtgattgccctctctccttctaaaatgtggggtgggatcccttgtttactttctccagccactttgttttcatcctcatgttcctttgtgcctcatcataagatatattttgttgctgtgctggcttagatcaaaaccctcttgctgcctgttgataccgtgtgagatcttgcagctacccatatgggggaactggggtacagagacagaaataagcagcctgtcaggccaggcgtggtggctcacgcctgtaatcccagcactttgggaggccgaggcaggtggatcacgaggtcaggagattgagaccatcctggctaacacggtgaaaccccgtctctactaaaaaaatacaaaaaaaatcagctgggcgtggtggcgggtgcctgtattcccagctatttgggtggctgaggcaggagaatggcgtgaacccaggaggcggaggttgcagtgagctaagatcgcaccactgcactccagcctgggcgacagagcgagactccatctcaaaaataaataaataaataaataaataaaataaaataaaataaataagcagtgtgttataggggaaaagcccagatcccaggtgtcgaatgactctgtgctttggaattagtgaccttcagcctgcggtgtggcctctgacagtctaattctaggaagtcacatcaggattacacagaaagttactggagattgaattctagactcaagttgctgaatatgcatttgggactctgaactagaaggagaaaacacattatctgctcattatcctacaaagttctaaatacaaagtttcatttccacatgtcttctcagccaagcctagaattctcttctgtataaattcctgggttcctatataagtgaacaagggaaatagtccaaatttagcaagttcaaaggcagtctgagagtggaaacaaagactcctcaaatattggcacaaacttaccttctgtgttgaggttgcactccttctcagaccccgtgcactgacaacatttatcacctttttaaattaattgatgcatttacttatttatttatatttattatttttttttttttgagatggagtctcactctgtcacctaggctggagtgcagtggcacaatctcacctcactacaacctccgcctcccaggttcaagcaattctcctgcctcagcctcccgagtagctgggattacaggaatgcaccatcgtccccagctaatttttgtattttttagtagaaatggggtttcaccatgttggccaggctggtcttgacctcctgacctcaagtgatccacctgtctcagcctccctaagtgttgggattacaggcgtaagccactgtgtcctgccttctcacccttttttagacatgccctgtctattcttgctccctcctttcctttgctgtgcctggaagcccttcactctgatcccctttgcccacaccatcctggaccttctctgtccttaccctcaggggtcatcagcttcctctgcccctgggggtcaagggccaatgccctgatgcccttaaagcactttctgcagctcttccttagctcttcagtctgatcatcatcccacccctgcctgcagacacttccgagaccaacaccgcccaaaagaaatacaatgggagccacataagaaattgtaaattttgtagtagccacattaaaaaaaggaaaaaagaagcaggtgaaattaattttcatatgttctgtttaatccaatgtatcatttcaacacataatcagtataaaaatatatacatattgttatttttttttgtattttaagacggggttttatcatgttacccagactggtctcgaacacctgagcccaaacaatctgcccaccatggcctcccaaagtgctgggattacaggcacgtgccaccatgcccggcccagtataaaaatattaatgagatttttacattctttctttttgtacagggtcttcaaaatccaatacatgttgttcccttacagcacatctcaattccaaccagccaccctgcaagtgctcagtagccacatgtggctcttagacagaacagtgcagtgtagaccacatgaccgacaggggccatgcgttactctgctctgttccttgacacttagcccagcagctggcatagattagctgctcaaaaaccatgtgtagaataaatgaacaataccacagtcttggttttaaatataaaatatgagtaagtcacagagattttttttaatgctatgttaaatgtcatcgattactgatagatgactaatttgattttctctttcttttttttttgagaaagggtcttgctctgtcgcccaggctagagtacagtggtgtgatcttgagtcattgtagcctccgattcccaggttcaagagattctcctgcctcagcctcccaggtagctgggatcataggcatgtggtactgtacccagctaatttttgtatttttaatagagacggggttttgtcatgttggccaggatggtctcgagctcttgaccttaggtatcctcccaccttggcctcccaaagtgctgggattacaggcgtgaaccactacacccgacctaatttgatattttttgtagagctagatcttcctatttgaattatactcaaattcaacaaaattctaagtatttttgccttcatgtaaatatttctatcttaggcatatttgttatattttttgtcctttaactaaaacaaagtagggtttattcatgactttgacttttttcttcaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtaagttgaatggaaagtgggcaagatggggatgaggtttgagagaagcactttttcaaatgtttacttaaagcatttcttctccttaactgtcatatactatttctttccctccctccctcccttccttctttctttccttcccgctttctctttcttcctttccttcccttcccttctgtttccttttttcctttctcctttcctttttccttccctatctcctttcttcccctcccctcccctcccctctcctttccctgcttttttttttttttttccaggcagggtcttgctctgtctcccaggctggagtgcagtggtgcaatcatggctcacttcagcctccacctcctgggctcaagcaatcctcctaccttagcctcccagtgtattggggttacaggcgttagccattactgtgcctggcctgtcatatgttattctaatacaatctttccctagcatttgaaatgtcttttactcattaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactgggtaagtatcaacctgtctgacttacaaaggggtaaaaggcagatatgtagtgattgaactgatttagtaaaacccttttgagggaaaaatgaatgaatatagtttatcggaagggggcaagtttctgaaagaaatagaaataaggtttccagttgttatttactcaggcttccaattattatttagatttctgatttcatcatagagatgatgtgttctagcaaattcaaacctattttctctccttccacccttccttcacttcctacccggtccaacttggattccatgtcccattagtttgataaccatttttctactatccatacccctttgcatttttttttcttgagatgtagttttgctcttgtctcccaggctggagtgcaatagcacaatctcagctcactgcaaactccacctgggttcaagcaattctcttgcctcagccttaccagtagctatgattacaggcgcgcgtcatcatactcggctaatttttgtatttttagtagaggtagggtttcaccatgttggccactctggtcttgaactcctgacctcaggtgatccacctgcctcggcctcccaaagcgctgggattacaggtgtaagccaccgctcctggccccctttgcctttctgactttttgtctcctctgtctgacaaaaccctagccatgaatgaacccaattatctattttctttttgcctaaaccttagtagttgagtctctggagacatcacaccttcattgtccccacctgaactgagccatccactcttcttgggaattttgctaatttcaaccgatcaactttccctccctccctcatttcaaacatcgtatctgcctctaccccatcttatcactctcagcagcaaactcgacttcacagagaaaacagaagccatcaagcctgcctgccccattcccaccctcttcctactcactccttttacaacagaagccagatccctcctttctggggtgaccagatttagcaaataaaaattcagaatgcccagttaaatctgaattttggacaagcagtgcataaaaaattttttagtgtggaccatactttcttttttatttttatttttcagagacagggtcttgctctttctcccaggctggagtgcagtggcttgatcatggcttactgcagtggcttgatcatggctcaccgcagtctttgcctcctgggctcaagcaatcctcccagctattcctcccaagtagctgggaccacaaatgtgtgccaccatgcccagctaatattttatttttttgtaaagacagggcctcactctgttgtccaggctggtcttgaactcctgggctcaagtgatcctcccgcttcggccttgcaaagtgctgggattacaggtgtaagccactgtgcccggccacatgagtaatacttatactcaacaatatgcgtgttgatctgaattcagatgtaactgggcatcctgcacttcatctggcagttctgcttctgtctcaggccagagcttccccttgcccgggtttgtgttctctcctgcctttattctggatcatccctccctcctccagtccctccttctctcttctggaccttctccataaatatttaaacatcaacttttaggtgatccaaggacactcagaattgatatatttgcaggtcaactttgtgatgtgtgattttctccctataaccttccgtctcccaggttcagtgaatggtactaccatgcagcctgaggaacaggctgtcagcaagtcctggcagtttcacctctttttttcctccagttcactgacttgttaaaattgcaatgacattagcaaacatttacaaaatacttactctgtgccaggctctgtgctaagtgttttatattcattaatttagttaatccactctataatcctatgagtctggtgtaattcctgttttgcagataggcagactgaggttactcagctaataaatgacagggctaaagatgggatctagtcatttcagctccatagtctgcttttaaaaattgctgccatactcaaactatatcatttcttgcttatagaatgatcacagctgccttgtgatccagtttttccattgcttttttagttctccactatagtcaaggttgcattttctaatgtaatagttaatatgttcaaaaatatgtatatgtatatgatggataaacaccttgtagtatatcatatatataaccatatattgcaagacttcgactctaaaaaaattattttttagtttcctctattttgaactttatgaaaagtgtcatgctaggtatagtcttcttaactaactttttcatgatttattcatgtaacttcaggtagctatggttcatacattttcattgttgtatatttcacagtgtgaacaatccatggtttacttatccactcttcagttgatgggaagttgggctacttccgttttttttattatgaacaatgttactataaacactgtcattaatctatcttggggtacatgtgcaagggcttcttttttttatttttgagatggtcttgctctgtcgcccaggctggactgcagtggcgtgatcttggctcactgcaacctctgcctcctcagttcaagcgattctcctgcctcagcctctcaagtagctggaactacaggcacccatcaccatgcccacctaatttttgtatctttagtagagacagggtttcaccatattggccaggctggtcttgaactcctgaccttgtgatctgcccacgtcggcttcccagagtgctaggattacaggcgtgagccaccacgcccaaccaagggcttcttttaggtaaataactaggagtaaaattgctgtgcaggatatcgcatgctcagctctacaggatagtgtcaaattcattatcaaaatggttgtaccaatttatatcccccacagaagtataaaaaatacacattctcattaattcctgatattgcccaactttgtaatttttatttaaaaattattattattttgtgtcagggtctcattctgtcacccaggctgaagcatagtggctcaatcatagcttactgcagtctcgagctcctaggctcaagcaatcctcgccacctcagcctccttagtagctgggaccacaggcacacaccatcatgtgtggctgagtttttttatttttttgtaaatatgggctctcactatgttgcccaagctggtcttgaacttctggcctcaagcagtcctcccgcttcagctctcaaagtgctgtgattactggcatgagctaccatgcccagcccagacttaaaacaatattgccttgagatcttaattttatatttatttaattactaatgatgatgtgtctaattcctaatacagtaattatctaattcctaatgatgttgaacatcttttcttacatttattcatttaagtgtccatttctgtgaaacacctctttatggtttctttcccctactttcttttgaattatttatccctttgaaattgctttcttcagttccttttgtattctggatactgattttttattgtttatgtacactaaaaatctcttgccctggttgtgtccaggtgggctgtgtgttgaattggaaagggtgcatgtccttgaaaggcagcagctactactcagcatctgcctgtgttgccatggacatgtggactcagtgtaactacgtcttccaactcaaaaagatttatgtaaaatctcccagttgttaaatgttttccagatgttctctttaacatgaaatggacaaaaggcctaggacagagccccatgaaactctcacattcaagggcccacagcgttgacttaaggagtggccagagatgtgggagggcagccgggagagtcataccatggggccataaatgtgagcatttccagacagaggagaccagcgacatcgtcaactattgctgagtaccaacacttgaagttgctttttattcttggagactggtagagattttaagtgaaggattctaataattttctggggatataatttaaatattcagtctatctgggctcaagctccaagatgagcggaatgtttctttcttccaaattgactaccattttgcttctcttcacaaacaagagtttggatcctggacagaagattcaagaaaatacattagtaatgtcagttccttaagttgaccttgtcttgggtttgagaacattggtttgctgttgcagttgttacaaacagcatctactgtaaaaatacgttgcaaccatgtttgtgaggcattaggccaatggggtggggggtatttggaaggggtttctttaacctgctgctctctgtagaaggaaaactctcaggatttacatactctgcctgcaaaggatcagggagggcaatgatctttatttgtgggcaataccattataggtcactgatgtgctgttttctttgtttgccagttaagtgtgtatggaaactccagttggcactttgacgaagtgcgaaaccaatgttattttcatcagtttatgaaagagcaacctgatttaaatttccgcaatcctgatgttcaagaagaaataaaagtgagtatagatacccacacagacttctccattaatggaggtttaggtatttatttaaaacactttatattgcacagtaattgtgtaggcaaaatcaagtctttaattatttgaaatactctatagttatttgaaacactttatattgcacaataattgtgtaggcaataatcaagcctgaattaaatcccaggattaagctctctggtgcaaatgtagactctcagacatgtctgtgactccttccttcatctaactcagagtaccctaaatggaaggagtcagaaacacctgccaccctagctccaagttgccccgccacctgtgacagtgagctgtacggtgcctgtgacggtgagctgtgcggtgcctgtgacggtgagctgtgcggtgcctgtgacggtgagctgtgcggtgcctgtgacggtgagctgtgcggtgtctgtgacggtgagctgtgcggtgtctgtgactgagctgtgcactgtctgtgacggtgagctgtgcggtgtctgtgacggtgagctgtgcggtgcctgtgactgagctgtgcggtgtctgtgactgagctgtgcagtgcctgtgactgagctgtgcggtgtctgtgacggtgagctgtgcggtgcctgtgacggtgagctgtgcggtgcctgtgacggtgagctgtgcggtgcctgtgatggtgagctgtgcggtgtctgtgacagtgagctgctgcagggaggtgggtcatttggggtctggctcctgcatctaaaatgggcttcttgatggttatttggctttcatgtcttagctgtctcatctatgaaacacagttggtggcaatatttgtctcatagggctgtttggaagattagatgagataacacatgcacgacacttctgtactcattgagtaaatattaacatattgcctactccgtgccaggccctgttctaagcactgggaatgcagcagtgaataaaagaagccttaccctcaaggagtctccaatatactgaggggaaagcaggcaattagccactaaatatatatatgttaggtggtggtgaatgccaaggggaaggggcatcggagtgtcaggtagaagtggctcttctatataaagtgtgtaggagacaccttcttatgatgagatgctgtttggacaaaaacctgaagtgagaaaggaaccatgtgactatctgggggaagagaatttcgggcagaaagaagaacaaatggaaaggtcccgaggtgagagtgtggttcatgtgtttcagggatggcatggaggccagagtgtagggttgccaaacttagcaaagaaaaatacaggatgtccagttaaattttaaatgaatgatgcaacatttgagacatactgctaccaaaaaattgttcattgattacctgaaattgaaatgtaattgagtgtcttgtattttatctggcaaccctaccagtatgctggagtgaaatgggttagggcgctgaagtaagaggtgggggctgatcatttctcacaatacaattcacaaaacatatcagctatgttcttgttcttgttcttgctgctcctatggctacagtgggcagaaacttaggggagtaggggagtcctctgagccaagtaggtgggaaggagaccctaacagaacggggagcattgggtgcctttccacagctcaccacgtcagccagatagagtggatgcaagctgtcatgctggagtcactaggggcacctagaacccttggtttagtttaattttgaaataacagtttaattgacatataattcacataccataaaattcaccccttttgagtgtgtaattcagtggttttagtatcttcacagagtttcacaatcactactaatttctgaactttttttttttttttgagacagtcttgctctgtcgcccaggctggagtgtagtggcatgatcttggctcactgcaacttgtgcctcccaggttcaagcgattctcctgcctcagcctccgagtagctgggactacaggcatgtaccaccatgcccggctaatttttgtatttttgtagagacagggttttgccatgttggccaggctggtctcaaactcctggcctcaaatgatccacccgtctcagcttcccaaaatgctgggattacaggtatgagccactgcacctggcctaatttcagaacacttttatcttctcaaaaagaaaccccatatccatcaacagtcactccttatggccccctccctttcttcccccaccccctgggaaaccacaaatctactttctatctttttacccacctaagcctcagttagataggttttgcctattctggacactttgtacaacagaatcatgctgtatctgtatatccctggtaggtgtctgtatctgtgtttatttgagaaactgccaagttgtttttcaaagcagctgcataattttacatttccattaacaatgggtaagcgttctaatttctccacattctcaccaacacttgttattgcatatattttttattacagtcaccctagtgggtatgaagtggcatctcactggttgtatttgccaaatggctaaagacgttgaacatctttttatgtgcttatagttcatttgtatatctgcattgtagaaatgtctatttaaatcctttgcccatttttatttcatttttatttatttattttttttgagatagagtttcactctgtcacccaggctggagtgcagtggtgcagtctcggctcactgcaaccccagtctcccaggctcaagtgattcttgcgcctcagcttcctgagtacctgggactataggcacgtgccaccatgcccaactaatttttgtattttttgtagagatggggtttctccatgttggccaggctggtctcgagctcctggtctcaagcaatcctccctccttggcctcccacagtgctgggattacaggtgtgagccaccgcacctggccctttgcccattgttaaacagggttgtctttttattattgggttgtaaaagttcttacatattctttttctttttctttttttctttttttttttgagacagggtctcactctgttacccaggctggagtgcagtggcgtgatctcggctcactgcaacctccacctcctgggttcaagtgactctcctacctcagccacccaagtagctgagattacaggtgcgcatcaccatacctggcaaatttttgtatttttagtagagacggggtttcaccatgttggccaggctggtctcgaactcgtggtctcaagcaatcctcctgcctcagcctcccaaagtgctgggattataggcatgagccaccacacctggcctcttttcatattcttgatacatgatttacaaataatttttcctattctgttggttgtctttttactttcttgatggtgccttttgaagcacaagcgtttttaattttgatgatgtcctatttatttatttgttttttgagacagagttatgctcttgttacccaggctggggtgcagtggcgcaatctcagctcactgcaacctccgcctcctgggttcaagtgattttcctgctgcagcctcctgagtagctgggattataggtgcgcaccaccatgcccagctaattttttgtatttttagtagagacgcgttttatcatgttggctaggctggtctcgaactcctgacctcaggtgatccacccgcctcggcctcccaaagtgcagggattacaggcatgagccactgcgcctggcccaatttatttatttttttcttttgttgcttgtgcctttagtgtcgtatctaagaaccattgcttaatccaaggtcatgaagatttactcctatgttttcttctcagtttcacagttttagtcttacattttagattgtctgtgatccattttttgttaatttttatatagggtgtgaaggtaagctgtccgactttttttttttttttttgcatgtggctattcagttattccaatcacgtatgtttaaaaatactattctttccctactgaattgtctggcaacttttgttgaaaatcaattgaccataaatgcatgggtttatttctggactctcagttctgttccattcatctatatgtctgtccttatgtcagtaccacacactgtctgaattactagcgctttgtagtaagttttgaaatcgggaagtgagaatcctacaactttgttctttttcagtattgtttcactattccaagtcctttggatttccatgtgaatttctgagtcagcttgacaatgtttgcaaagaagcctgctgtggttttgatagggattgcattgaatctgtggttcactctggggaacatagccatcttatgttaagtcttccaattcatgaacatgagatgtctttccatttatttacgtgttctttcatttctttcaacaatgttttgcagttctcagagtacatgtcttgtacttctttcgttaaatgtattcctatagactacttatttttaagactttttttttttttactgtatatgtttggtgtttccagaatttgtatgaattgttttggaattggttctggaagtaagcaccatgagtgagggcaccttgcctccatggggttgtggggttgtggggttgtggggtgggtagttgtagacatggtcagcagactaactaggggttagttttaaacttctctggtagcctgtggactctcctcttcttcatcaccaaaactccttatcacccacgcctcatgctctccccacacattctatgtgctaagtgctgttcctggataatttaatgctcagaataagcctaatttacgaggttttgtgatcattttacagagaaggaaattgaggcttagataggtaaagtcaccatccttgggagtcatggagcaggactgaaatccagacactcggacttgagttcatgctcttaaccacaatcctacacctgctttgaggcaatgtatgtgtttccctctccatgcttcactttttctgcacagatttgtcaaggaggttttcagttataaattgataaatgtgagtataaaccagctggtttacagttggtttatcaggcagtagatttttccaggctccttgtggcaatagtgatgaattgtctggggatgtttagacaagtgtgataaattctgcaaaaatgtgccagccaatacattaattatttttttgactaacccagctgtgctcttccagatacccaagccgtggagtgtgtggacaggatccttatttactggtcttctggctgaaatccctcatgtgatgaatcattaatgcctccggttgagagattagactttatttgcaagactggtttagaagatttactattagaagtaaataagaaatgctgagaagctgagaggaaagcctctttgctcctggaaagggacctttggcatgaaggagacttctgtcaccctcctccccaccttacccccagcagcgcttgtttctgcaatagagttaagcaggttaataatttgcagctcagagggtttgtgtggaggcggcgtttggaatgacttgcttgcataccaacttgtactcctggagcctgagcccacttcctccccgctcctatcagattttgctttatctgcacagtgggaagctggcatgctggggaaatccagcagagagcaccctctgctgtccttctctttctcctcctctttgtactggccatcaggggacttggctctgctctgaacctcttggggcttgagtgctttcagctgaagaagtcagaaaaccttctctgaggtatcaggggtatatatttgtataatactttatactttcccaatcactttggtttttactggtcctccacatttcttatttgacaaatgaggaaactgagacacagagaggtgaagtaacccagcgggttagcagcatggcaaggaagagactccagatggcctggcctcgtatctggggtttggagtgatcctacacctgccatatgggaatgctgagccccagggtagggactgctggggagacccagctgagagggaacccagagcacaggcgtaggctccgttctgtccctactaagcatgatactgctggaggcagcagctcaattcaaaacacaattcgctcactacctgcttgattagccatctctatgcttgataataataattgtgccatttattgcacctcctctatgccaggcactttattataatcattcactcatttaatgataggtattgtgtgtcttgaccatgtgctaagggtgtgggggctggtaagatagatacctcttgtggccatcctggggcttatattctggggtgggaggtggacaattaaacaggcgattacaataaaatgtgccaagcggtcatgacagtaggaggtaggaatacacagggcaagcgcctaacctggacacatttgcagaggaggtgagatacctgaggaacaggcatgagctaagtgaagaggcatgggtgggagtgtttccagcagaggaaagcgtggatcgtgacacattagaggtgctgggagttgtccagtatcactgggatgtgatatatagagcagggagtgacccgatgagactagagaggtcactgggggtgaggtcaggagcaccactgaaggccctggtaaggatttgggcttaaaaggtcttaggtatttattttttatttttattttttttcaatttgagaaatcagtctggttttggagaaggggtttgagtagggcaggtttggaggctttggggccagggaggaggatggtgcagtaatcgggaaagaaattctggtggctttaggccagtgatggaggcatagaggtgcagagaaatcatcagggctctgagaggagtcccctgtgaatcccaggtttcagatttgaatatggggtgggtggcagaaccattgtctgagatgggagacacaggaagagagagggaaatatcttaggtatgtagagttggagctgcctgtgacacatccaagtgttcagtggacagttagatataaggacactgggctgggcacagtggcttatgcctgtaatcccagcactttgggaggctgaggcaggtggatcacatggtcaggagttcaagaccagcctggccaacatggtgaaaccccatctctcctaaaaatacaaaaattagccaggcatggtggtgggcacctgtaatcccaactacttgggacgctgaggcaggagaattgcttgagcccatgaggcagaggttgcagtgagccgagatcatgccactgcactccagcctgggcaacagagcaagacaccgttttaggggggaaaaaaaaaagatataaggacacggagctcagggaaaagtctagtctagagataaaactttgggacttgttgatgtggctgatgtctacagagctcaggcaggtgtttggtgagagaagcaggctgggtaaggtgagcaagagggccaactgcaacgtagctggagcgaattgctcacatgtgaatgagggcctggtgttggtagaccttccaattaaaagaaaaatccaagggagccaggctagcaaataagtcagggcgccgtacagttgcaattctgctgccaccacttaccaaccatgaccttgtcaaaggcacatcatcttcctgagccacagtttcctcactggtaaagggggaacaataatggtacgtacctaatggggttacttgaagattaaatggtttaacctttgtaaagcacttaggatgctattttttttactgtatacagtacttgttaaatagtcagtaaattggtaagtaaataaatactattgtgaagtgcaatgtcgagagggtgtaagatggagccccaaggagcactgacatcaaagagctgcagaagagacagagaagggagacaaaccaaggggcagggtataacggagctaaggtatctgagtgtttccagaagacgagattggtcaacagtgtcaaatgatgcagagagattgggtaatataaagactgaaaggggtctgggcgtggtggctcatgcctgtaatctcagcactttgggaggctgaggtgggtggatcacttgaggtcaggagttcgagatgagcctggtcaacatggtgaaactccatctctactaaaaatacaaaaattagccagatgtggtgacgggcacctgtaatcccagctactcaggaggctgaggcaggagaattgcttgaacccgggaggcaaaggttgcagagctgagatcacaccactgtacgccagcctgggtgacagagtgagactccatctcaaaaaaaaaaaaaaaaaattgaaaagtcaattgactctggcagcaataccttatttactccatacagaaaccctccatactatgttattgatggagacactgaggcttagctggtcttgcagatgccctatgtcatgcagctggacagcgagagagctgggttgtacccagagggtcaaattctgaagtccttgatctttcctctacttcctgcttctggaggagttagcaaagaatttttccaagatttctgaacatgagtagggtcagttttctttctcttgcctctaagtagagaaccagtttcctctgtactctgaaacatcctttctcattccttcttgagatggacaacctgtgatttatgacattttcaagatgatgtcttctgtttgtttttttggtttgtttttgttttcttaatagagacagggtctcactttgttgcccaggctggtcttgaactcctgagcttaagtgatcctcccacctcggtctctgaaagtgctaggattacaggcatgagccaccacacctggcttaagaggatgtcttctctatcatcccatgtaagagtagacagagcttttcccaaacatgggtttttaggtaaacgggcccccaaatgtcagccatctgaaaaggaaaggcttggctcaaggttccatgtatttggatatgttaacttgcttccttaatgttgacttgctttcttttcactcagagcagcgagctatttaaagagaaaggagttaaaaggtgcccagtggaaaaaccaggagtgcgtgatgtcatgggagtcagacaggagtcaaggacgtagtgtatagtccagttcccagagtccacggcacctacatgggtcactagacctagctgacccaggctctgtgcccatttttgcatctggaaccctgagagaccttcatgggagtaaagagggttaacaattaaaatctgaagctctcttttccctcctggttgagagaataaatagcatgaagcaaatatttttcaagagcaaactttggattatcttggtgataatctgaattatcagcatttaaaatgactttcagaaaatgtccatcaagcttttactgttttgtctcattaaacaatgatattatttctgattatgctagggccataaaccttctgtgcggtacaagtttctcatgtttaatgtcaggtcaacatttcacaatgctgagatccggactccgtaaagaaaaggactggctttattttaggaaatcagtgcccaaaagcttgatgtttacacagaatggtgcttaatgttttcccacatttttgtcagaggccgcttggatgccttcagttattcgtgctctgccccaaccaatgttcacacttttaaagaacagcaccacctgggtgtggacccaggttgcgcggggtctgaagctgatagtaaattagggccttcttaaaatagagcacaaaattaagtacagaaaagttggtatttacttaaaatgagcaaagaaggggagttagatgagtgcaagtgagaggtcttgaagcttaagtttggttagcttcatagtaaggtcactcctgaagccactgaaaacctgttctagaaatgaggtgcctttctttgccccaccagacttctctagcccattctctgatgaatggctgtcacttcctgtttgccagctgcaaaccctccccagggtgaattgctgttttaccctcttgtattaccatgtttctctcctttgtctcagctgtgatttaaatatttttgtgttgctatttgtctagctggagattctaaaataatccgggagacctaggactgtgtctgttgtatttttcttgtggttgtagttccagggcttgcctaagtgcctggtatacactaggagttcaaatacttattgaatgaatgaatttggtaaaagataaaggcactagtaagaacaaatttgttttttatgccccagagaaaaattccactgggtagagattactggaggttatttgggtcacctgtgcccatgataagagttattcaccccagaacttgctcttaggcataaaaaattgattcaagcttcaccattcaaaatctcagcttaaagtgaattgacaggagcagtattaacccttgcatttagctgttgagacccttgacttgacttgaaacctccatattcacgtgcagatagaaacgcacttcaagtcaaacaagttgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgtgagtcaattaaacagctttacaaattacccagtcttagatatgtctctattagcagcatgagaacaaactctaatacacaagtgaactgtgggatagttgtcatttgggatctgtggctctgtttccctccataggtgaaaattggctgtttagtactttacagatggttctgctctaaaatgatatatacattcctgtgaaaccttccatacagcaagggatgagaaaagtagggagagccactgttcctttgcagagcttgtgagcaggtgccggagccggagcaggccttgctgggagaggctggctgtggggttgaggcaggtagctgaggctcaggacctctgcttttcacggtcacctggtcctcccacctgtcccagtacaggccagcctctgcctccacacttggctcatgttgtcccattcccaccctccattgaaatcccaccaggtcatctaggtcaagttcaagctctagctcttccttctcctgctgtgcccacccacatattttgaaatgtcttgaagctcttgcagccctgtaggcagaggtgtctcctctcatgaggacctgcattattaggtaaccatcccttgtcccacatgtccccaactgttctgtagacctgaagccagggaacatgctgtacttctgtaatgtttggtcattcaggctcaatatgtcattctttcatgctacaatttgttcactaagtaccaggtgctgtttcagaggcctacagacatgtaccaccacacgcagctaatttttcattttttgtagagacagggttttgtcatgttgcccggctggtctagaactcctgggctcaagcgatcctcccacctcagcctcctaaattgctgagattacaggtgtgagccgtcacacctggctagaaaaatcttttcaaggttcatccatgtcgtagcatgtgtcagcacattgttcctttccatggccaaatattcatcgtatggatagaccattgggttgtttccactttctggctattatgaataatgctgctatgaatatttgtgaacaagtttttgcgtggacataagttttcatttctctcgggtatatacctatgcgtgaaattgctgggtcttatggtaacttgatgtttaaccttttgaggaaatgccatactatacagttgattcttcatacatcagatctttaaaaaaaatgttaagtcagcccacagccttttctgattaaaaatccctccaggggtttcccatcaccctcacaaaaatcccagatctttcctgttaactacaaagctgagcatgatgagttagttttctttacctcctcctactcttacttatgctcctctggccacactggccacccccctatccctgccactgcctttttttttcttgaaacaggatctccttctgccacccaggctggagtgcagtggcatgatcttggctcactgcaacctccgatttttaggttcaagcaattctcatgctcagcctcccaagtagctgggactacaggtgcatggctccatgcccaactaatttttgtatgtttagtagaggcggggttttaccatgttggccaggctggtcacaaactcctggcctcaagtgatccacttgcctcggcctcccaaagtgctgggattataggcgtgagccgctgcgcccggactaaccacttatttgcaccagtcttcatctctctaatctttggcttcagcattaaaaatgcctgggaacaaggcagcccacgatgatgctctcaggagcaggtgaggcaggggagaggctgagcaggcaatgactaccttctctctagcaaggtgtgttggaagagtagggcaggagaggagagtgagccaggggcagtcatacaataattgggtttctagcacacacctttggaagaaagtctgtcaccaaagaataaaattaaatgtatgagaacctggatttttagcttaaccatttgtgtttgggatcaatttatttgtgaaattaaagccagtggaataatgtagattccttttttttttttttttttttttaaaagacagagttttgctcttgttgcccaggctggagtgcaatggcccaatctcggctcaccacaacttccacctcccgggttcaagtgattctcctgcctcggcctcccgagtagctgggattatgggcacccgccaccatgcctggctactttttgtatttttagtagagacagggtttcatcatgttggccaggctggtgtcaaactcctgacctcaggtgatccgcctgcctcggcctcccagagtgctgggattacaggcatgagccactgtgcccagcccatttcatcttttattatctgagtgtattcaagacaacactagtatctgagttttaccacaggatcgtcactattcttagttatttacttggttgatggttgattctattttttttctgtgtgttccttccatattactcctagcaggagatcctttaatatctaagcacttcacctctcatctgccttcctagtaaggagtgaaatatttaactattgaacaatgtgttattttctttgagtttgcagtgacagttaaggagttgggcatgagggagatgagaaactttcctagtttattctgagtcctatcttttcttatggtttcattctttcatttttagtagactctctaaactttgaaaacatccttataacatccattacaaatgtaactaattgtaattctgaattcacatatgaaggaggtgtgggagtcgctaaatgcagttagagtgcattttagtaagacagttatgctaaatagataaaaatagactgtgaatactgtgcttgttctgtatgtagatatctgttttatgatgccaagttgttaacagtcaaaactttgattaaacgttgtgataataacgtagttaatgtaaccaagcattttgcttcttcatctttaggaaattttacggttctggctcacaaagggtgttgatggttttagtttggatgctgttaaattcctcctagaagcaaagcacctgagagatgagatccaagtaaataagacccaaatcccggtaaagttttattttaaacgtttttcttttgccttttctgaaaatgtcatcagagtgttttctttctcagcctgagataccagttacaaagatgagttttgtcctgtgtctagcaagtaccctgatttatttctttaggaaatgtgcaagagtttgaaatgcatatgcactcgatgtttttttccactggttccctccagagcgagggatcccttgaggagtccttcagtgacaagggttctgaagacatggacagtgtgggctctaccaagggccacaaaatagaggacatttactcctgcaattttatcatctgacataggctcaagtgaggaggccttggcttggatgagatgtaattttttgttttgattctaggagattattgtcatcctagaaagacatagaaatgagacactgacatagaaatcctacaaagatacagaaactaggaaaaatttactgaaaccccgagaaagtataacagttaggagaaaggatagtgatggtaaagaaacaaatttaagtgcatgatgttaatagttttgtgagcagataaagtatacatgtaataatgagctctataaccactaagatctttttttttgtttttaaaagggtctgaaacattttgacaattacgtgttgagaactttgtaatcagtgttttgcttggtaaaatttatttgctaaaatgggtgacagtttattagagaaatattgcttagtagatttataaagttaacaacttgagcatcaaatgaagcattcttctccatccacaaaaccatgtttgagtgtgcgtctcgcttggcttgagccctttgaagaggttgtctacattcatatagagcgagctgtgggcatgcaatgtatgaaatgagggtaaccatgtcgtcctggttttcaaaggacacggtcacacaatactcggagctgtaccatgacttcaccaccacgcaggtgggaatgcacgacattgtccgcagcttccggcagaccatggaccaatacagcacggagcccggcagatacaggttgaccacggcatatgctctcatttcttcccaggcttagtgtgtgatctgcagtgtatccctcacaaccaagtgtatttggaggttcaagtaataatgtaacaagcctgcataactctaattgattacagtttggttgtaccagggcctgccatattcctttcctgtttgcttattttgctgactttcagtttcctcttttgtaaaatgatgcagatcacactacgtacttcacaggagttttgtgaaaattaggttaatgaaaaagagattatattagctaaatgttagccatgagctattattttttctttttcaaaaaccagttccaggccgggcacagtggctcacgcctgtaaacccagcactgtaggaggccaaggcaggcggatcacgaggtcaggagtttgagaccagcctggccaacatggtgaaaccccatctctactaaaaatacaaaaattagctgggtgtggtggtgggtgcctgtaatcccagctacttgggaggctgaggcaggagaatcacttgaacccgggaagcagaggttgcagcgagtcaagattgcaccactgcactccagcctgggcgacagagcgagactccatcacaaaaaaaaaaaaaaaaaagaaccaaaaaaacaaaaccagctccacctgggtgcggtagctcatgcctgtaatcccagcactgtgtgaggtcgaggctggtggatcacctgacggtgttcgagaccagcctgggcaacatggcgaaacccctcctctactagaactacaaaaatgggcaaggtggcacatgcctgtaataccagctactcgggaggctgaggcaggagaattgcttgaaccggggaggtggaggttgcagtgagctgagatcatgccactgtgctccagtctgggcaacagagcaatactccatctcaagaaaaaaataaaaataccagctccttctctgcagtattatttttatcattgttattggatctatagtttcctagtacagtatataaatccatatgtttcagctaaagtatcaggaacacagctttggaatcaggtaggtctgaaggagtcctgctctgtagctgtgtgacctagggccagttaattaacataagtctcagttgtctcatcaataaaaaagtgatagcaataacctctataaggctgttgtgagattaaattagataatgtatataaagtagtgcctggatcatagtaaacactcaataaaattacccatcattaagtttacatagatcactcaacagaatcaataggaaggaattaaagaaatttcatctccttaaagtaggtactccgattactctgtctccattttatagacaaggaaactgaggctctgagcatgtaagtaatgtccacaggtaggagtggcagctatgggatttgaactgaagcagttgggctccagagaccatgcacttatccataaatatgctgcctcaaatagctaaagccagcattgatcggagtcatttcaggtgaatgtgtcttcccccagggttttgctttcagcaattgagagtgcacaccaataataaggcaagatgttatagggactccaatacaagggggaagttcttttgaagaaaataccccacctaatttgcagacataaactttagattctaaatggagtgatgagaattgctaaagaaagtcttcatggatgtcaacgagttttagtgtcaggatgttactgaattttgattctaggagattatttctcctaggattctaggtttagaaagaaaagaacaggcttggtgcggtggctcatgcctgtaatcccaatagtttgggaggccaaggcaggcacatcatcagaggtcaggagtttgagaccagcctggccaacatggtgaaaccctgtgtctactaaaaacacaaaaaaattagctgggcgtggtggcgggtgcctgtaatcctagctactcgggaggctgaggcaggagaatcacttgcacctgggaggtggaggttgcagtaagccaagatcatgccattgcactccagcctgggcaataagagtaaaactctgtctcaagaaacaataacaaaaaaacaaccaatatagactgagatccaatttttttttttttttttaaagacattctcactttgttgcccaggctggagtgtggtggcatgatctcatctcactgcaaccttcacctcccaaattcaagtgattctcctgccttggccttccgagtagctgggattacaggcgcatatcaccacacctaatttttgtatatttggtagagatgtttctccacgttggccaggctggtctcaaactcctgacctcaagttatccacctgcctcggcctcccaaagtgttgggattacaggtgtgagccactgcacctggcacccaaatgtgtttcattttttttggggggggtggatttttctgccttattttttattattatacttttagttctggggtacatgtgtacaacatgcaggtttgttacataggtatacatgtgccatgttggtttgctgcacccatcaacttgtcatttacattaggtatttctcctaatgctatccttcccttagccccccacccactgacaggccccggtgtgtgatgttccctgccctgtgtccatgtgttctcgttattcaactcccacctatgagtgagaacatgcggtgtttggttttctgtccttgtgatagtttgcttagaatgatggtttccagcttcatccatgtccctgcaaaggacatggactcatccttttttatggctgcatagtattccatggtgtgtatgtgccacattttcttaatccagtctaacatttggtgacagcttgattatgctttctagaaggtgctagtcctatatggttaatagtgtgcattcagcccctacatcttgtacatgcaagataagcagctgtggagtgccttcccagtcttctgacaggccccgatgacactgaaccttgtcaactcttataggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatggtaagtcctcatgacagcagagtacataatgtgctgctgttgcctttgctgtccagttatctctaaaatgcaatggacctttgtctctaagtgaccatcacctctgccttatttggtgattgttcagtggtcaggcctgtcacagcctctgccaggttcttttcattaagggagggagactgcccactgaatggaatgaatattgaatgagtgcttgtctatgctcagaacactgctaggctttttggggatggatatcaaaccataatttctccccacatatctcagagtttatgatgtcaatgggaagaaagaggatttcgggtgtagaagaggtacacagcaattcagggcaacataaaactgtgacaaaacaccaatttgtggggcaggatgcactgcaaaaagcatttaaactacagagattgtcggagaaagaatttctcccccttctgtactacactcttgaaaacaatttttttttttttttttttttttttttgagacaggggctcactctgcacccagcctggagtgcaatggtgcagtcatggctcactgcagcctcgacctctgaggctcaagcaatcctcccacctcagcctcctgagtagctgggactacaggtgcatgccaccatggctggctaattatttttgtttttgtatttttagtagggagggagtttcaccatgttggccaggcttgtcttaaactcctgacctcaggtgatctgcctgcccaccttggtctcccaaagtgctgggaatacaggcatgagctaccacgcccagcactaacatttttcaagactggcaatacattacttcagtgaagaacagaagatacagcaatacatacctgtggtaacagaccagtattctcacttccacacccatcagggttgctttccctgatctgatttttctgtctttgggtttgagttagaggtcaatattaggctccttcgtaagatgtctgtagtattatagatgtaagccctgctgcttcaaagtcccacggtaatagtggtttaaacaaaatgcaagtttctttctctcatataaaagacaacctttcttttcttactttttttttttttttttttgagacggagcctccctctgttgcccaggctggagtgcatggcgtgatcttggcttactgcaacctccacctcctgggttcaagcaatttttctgcctcagcctcctgagtagctgggattacaggtgcacgccaccatgcctggctaatttttttatttttagtacagacggggttttaccatgtttgtcaggctgttcttgaactcctgacctcgtgatccacccccacctcagcctcccaaaagtgctgggattatgggcatgagccaccactcctggcccttcctttctttaatatattataaatgtaaactctaaaatgcctctttagtctcgataatcctccatctctctgtatctctaccaccttagactgtttctgtggtctcatcgtttaggtctcaggtaggtgtcaccacaggaagccttctggagcccccaaatgaggtgtcaggtctacctattgtatactatagcacccgttcattctctttccttaaagtccacacaattccacgatgtctgctttccccactagacagttcactggttaagggcagaggcaggttcccagcatccttgcacggtgcccacctcacacggaggtgctcaggctcagggtttgtttgttactggtgctgttgttattcgtatgcagttcagcgacttaccaaaggtgtgccttatatatagagagagagttgccttacactagtcaatatcttctgttgtacccccacaatacctgtaggtttgatctgggccctgaaaagtggtatgattttgatacttttcgcacagatcctgccagctatcttacacagcctgatgaaaacctgaaaggataaaggagaaaatgcagcctaggcagaaaaacactggcagaatctgtgaaccacaattaagcttatttcaatcttttctgatgctttaataggcaggaatgtgtgtttccattgccagagcctttctccgtctggtgaggggaaagaggctcaaatttttaggcatggtaaaagctttaatttgttaaatgtaagtattaaaactatacaatttttaaataacagctttgtcgagatataattcacataccataaaacttttttttttttttttttttttgagacggagttttgctcgttacccaggctggggtgcagtggtgtgatcccggctcacttcaacctctgcctcctgggttcaagtaattctcctgcctcagcctttagagtagctgggattacaggtgcccaccaccacacccagctaattttttgtatttttagtagggacacggggtttcatcatgttggccaggctggtctcgaactcctgacctcaggtgatccacccatcttggcctcccaaagtgctgggattacaggtgtgagccactgagcccagccaaaatttaccgttattaaagtatataattaagtggattttcggtatattcacagaattatgcaaccatcaccaatgtctcattccagagcattttcatcacccccaaaataaaccacatctccactagcaataactgcgcatggcccctccctctctgtcctcagtctctggcaaccactcacctactttccgtgtctatggatttgcctattcagggcatttcatataaatggagctatacgatatgggacttttgtgtctagcttctttcacttaacatagtgttttcaaggtttatccatgttgtagtatgtctcagtacatcgttcctttttatggctgaatagtaacttccataaagcccattttgtttatctgatcatgaattgacagagatttgttttcacttttggactattacgaatagtgatgctatggacatttgtgtacaagtttttataaaaacatgttttcaattctctctgatatatatccaggagtggaattgctccactgggcatatggtaagtctacatttaactatttgaggaactgccaaactgttttccaaagtagttactccattttacattcccaccagcaatgttacgagggttccaatttttccacatctcatcaagccttgtgatggtctgcctttctgatgatggccttcctactgagtgtcaagttgttatctcattgcatttttttttttttttttgcatttccctgatggctaattttgttgagggtattttcatgtgcttattggacatctgcatgtcttatttggagtaatgtctgttcagattctttgcctataattaaatttggttgtctttttattgtttagttgtaagaattcctgatatatactggataggtgatttgcaagtattttctcccattctgtgggctttcatgtcactttcttgatagtgtcccttgaaaagcacagaagtttttaatttttatgaagtccagttgttttgttgttgttgttacttgtacttttagtgttatattagaaaccattgcctggtctatttattccagcaccacatgctaaaaagactattctttgcttcattggattatcatggaatctttgttgaaaaatcaactgattgtaggctgggcgtggtggctcacatctgaaatcccagcactttgggaggctgaggtgggagttgagcccaggagttcaagtttgccttgagccatgattacactccagggtgaactccagcctgggtgacagagtgagaccccgtctctaaatgtaaaacaaaacaaaaaaaagaaaatcagttgattagatttccagactctcagttctgttcatctatatgtctgtctctatgcctgaacaccctgagttgattagtgtagcttagtaagttttgacatagagaagtatgggtcctccaactttgttatttttcaagattgttttagctgttctgggtaccttatatttccatgtgaattttaggatttccatataaattttagaatagccaactgggattttgatagggattgcattgaatctgtttatcatttttggcaatcatgccatcttgtcttctaatccatgaagacagatgtatcttatttaggtctttaatttcttttgatgatgttttgtatttttcattgtacaagtcttagactttttgttcagtttattcctaagtattttgttcttttgatattattgtaaactgaagtgtttgcttaatttcattattggattcttcattattagtgtatagaaatacaatagatttgtgtatattgatcttgtatcctaaaacattgctgaacttgtttttcgtttctaatagtttattgtgaattcctgaagaatttttttttttttaatttgaggcagagtcttgctctgttgcccaggctggagtgcagtggtgtgatctcagctcattgcaagctccgcctcccgggttcatgccattctcctgtatcagcctcccaaatagctgggactacaggtgcctgccaccatgcctggctaacttcttgtatttttagtagagacggggtttcaccgtgttagccaagatggcctcggtctcctgacctcatgatctgcctgcctcagcctcccaaagtgctgggattacaggcgtgagctactgtgcctggccttctgaggaattttttgttttaaaattattgcaaaatatacataaaacaattttaaacattcaaaagtgtgtaattcaatgcattaaatacattcaaaatgttgtacaaccatcaccattatcagtttctagaacttttatcatcccaaacagaaaatctgtacccactaaacaataattcctcacttccaccactaacccctgatatcctccattctattttcagcctctataaatttgcctattctaggtacctcatataagtggaatcataacaatatttgtccttttgtgtctgcctcatttcacttagcttaatgttttcaactttccttcatacatacaatagcatgtatgagatcttactccttcttatgactgaataacattccatggtacctatgtaacacgttatctattcatctgttggtgacgtttgtggttttgcctccttttggctgttggaataatgttacaaaccaatggtgtacaagtatctgtttaagccccagatttcaattcttttggatctataccatggagtggaattgctggatcacataatacttcttttgttttgttttttgagatggagtctcactgtatcacccaggctagagtgcagtggtatgatctcggctcactgcaacctctgcctctgggttcaagcaattcttatgccttagcctcctgtgtagcttggattacaggcatgtgccaacatgactggctaatttttgtatttttagtagaaatggggttttaccatgttggccaggctggtctggaactcctggcctcaagtgatttgctgccttggcctcccaaagtgctgggattacaggcataagccactgtgcccaggctttttttttgagacagggtctcactttgtcatcacctaggctggagcactgtggtgtgaacatggctcactgcagccttgacctcctgggctcaagcaatcctcctgcattagctcccacaaagtagctgggactataggtgcataccaccatacctggataatttttgtattttttgtggagatggggttttgccatgttgtccaagctggtcttgaactcctgagctcaagtgatcttcccaccttggcccttaaagtgttaggattacaggtgtgagccactgtgcccagccttggatcatatagtacttctgtgattttgaggaactaccaaactgttttccatagtgacttctccgttttacattcccatcagccatgtacgaaggttccaatttcttttcatcctcaccaacacttttctgtcttgatttaaaaaattatactcatcatagtacaaatgaagtggtatctcattttttcattattgaataacagttttgctggatatagaaatcttggtttacagttctttctttcatcactttgaatatgtcatcccattgccctctggccttcatggtttctgataagaagtcagttgctaatcttattgagactccttacatgtgatgtaccaattttctttgctcctttaaagattctgtgtcttttaacggtttgactgatatgtctaagtgtgggtttttaaaaattttgtcctacttggagttcattgaggttcttagatacacaatttttaaaaaaatcaaatttgggaagttgttggctattttttttttaaatattgtttctgaccatttctcttccttctctccttttgagactcccattatgcatatgttggtatgcatgatagtatcccacaggtctctgagagtctggtttttttttttgagacagggttttgctctgttgcccaggctggagtgcagtggtgtaaacatggctcactgcaaccttgatgtcctgtgctcaattttcccatctcagcttcttgagtagctgagactacaggtgcatgccaccatgcctggctaaatttttaatttttttgtagacatggggtctcaccatgttgcccaggctggtttagaactcctgagctcaagcatcttcctgccttggcatcccaaagcactgggattacaggtgggagccacagtgcctggcctcattcttctttttctttctggttctcaggccagatactctcaattgagtcttcaagttttctgattcctttgctagttcaaatttgtcaagtccctctagtaaacgtctcactttagctattgtactttttaactctaacagttttattttttcataatttctcttatctatttgataactgttcatatactttaaattcttcaggcacaggttttttctttgaatatcaaaatattagctggtttaaaatctttgtctagtaagtccaatgtttggtcttcctaagcaatatttgctattgactccccccaccattatatgagccatattttcctgttttctttgactgttttgtatatttgttgttgttgttaaaaaccggacattttaagtagtatgacaattctggaaatcacattcttcctttcccagtgtttgttgtgctctatgtccagaagtcttgagaaatcaaagggtttcttgtcagaagatctcatgacagtgaaaagaataaaaggatggaggcaaaaattgacctaattttctggccataaacatagaaaaatacttcacaatggtctataaaaacgtaattataaagatcattttcatacagctaaggaagttaaaaaaaaaaaaacccaacctcctatttcttgaattgtagcaattaagtcttgtcctaagactcaagttcgaacgctagttctgtcttagactactacttgaataaatgatgtaatttctcagagcttgtttcctcatttgtaaaacggagatagtacttgctagcactgttgtgtgaaggagggaaatataggtgtgaaagtactttttaaaaagtaaagtgccatgctcagcgtatgcacatgagggtttgagttgtgggttatggagagagttgtcaggtgatttaaataaattcttatttaaacaaacttatttaaataagggctagaatatacctagaacgtttaacatggaaatatatttacaaatagaaaacactttataaaatttcatcttggagtatgtaaattctttctaaaagttgatttactttaaaaattttgtctgaataattcataagtcaaaacaattttttaaaagaggacacatcagaagtctctcatgcctgtccctttcacctgggttcccttgtcttgctctctgccacagttttgcttcctttcctgtcaatattctcttatccaaatatgagaaaatatgactatgtaccctctgagttttatttgcaatatcattgtacaataaattcttatcacccttttcttgctcatcagtggccaagataataaattggtcagttacacagcaaatagcaggcctaggactcaagtccaggcttgctagtaccaaggtaccacatctactttgttttgctacgttgtgaactttctgtgaaatagggtaaatctttcagaaaactgtgtatacagctgtgttcttaaaaatatctgcctttcagattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattgtaagttgaatacaacttgactattcatcacagctataaaaccaagtattcattttttattttttgccaaatcagagaacttactatctctctattgcattgctgaaaatcatggttactttgcttttctttcttactgttagtaagaattctcagctttcttggtggtctgagagcttattttaaaaatgctttggagccatacaactaaaagtttcttgggtagggcattttaaagatgttttctacctgataggcacattaaaatttatttatttattttgccaggaatactgtgttgagaggcacactaaaattggagaaccggtggtttagtttagaatatgactcatttccctctacttgaaatgtggagttaggaacacttatttctttagttctcatttgtcctgtttggtcttgggtgaccacagcacaaggacccttttcttttctgttatcaggtgcagtgcacagcctcagagttaagcagtttttattttgtagctacagatttcagaattgtgttgctgggtagacgactatcttgcaactttaattgcctagttagctttcaactatatgagatccaatttccctaatatttgattaaggtgaagcttttttccctctatcagctcctacatttgtgtgtgtgcactcatgagcaataatcaggctgaataaacgagtaggacagaattcatactcacttgtacatggcagtgttcttaaattcaccaacactgtaccatagtagaagtcgtgtaaactggcaatagcacattttgaaatcctgtattattgatttttaggaaaaagcagcagagatttcaagcatgtattaaagttcgattagtattgtctattcaaactcaaaatgttattaggtactttctagttaaaagggtgaaactggtttatgtaccgaaagttgaggccttttcatcacaaatgctaatgagtacaaacactagctaagaactatggggaattaaataattatgaagtaaatcaggaccaaagcacatttcttctaataaccaaaccactgttttccctttctggtcttttgacatagaatacccttcgctcaaagtcaccaatgcagtgggacaatagttcaaatgctggtttttctgaagctagtaacacctggttacctaccaattcagattaccacactgtgaatgttgatgtaagtatcagtgaaaattttatgttgattctagaaacaaagaaatgggtttctactgaaagtacacactcaccctgaatgtgtctaaaccttaacggatactctttaaatcaatcacagacttccttgcagttttccatttgtaaggagtttgtaaatcatgcctttgtgaaaatacaaactggtacaaatctaccaagtgaagtgaagtatcatatagaatatacaagtcttcattgcaatgacctttactaaggcctttgagctatgaaggaaattttatgaagttttttagctagcccagctgcctttcctcctctcttcccctcaaaaggcagggagagaggcgagtggataggcagccatgcaggcagtaaggagatcaatcaatcaacccagagcaaggctcaaatccacactactgttctgaagaaacagaagccatacatgatccttaaagtggttgctctggcatactaatacaactttggcttttacccttttttctgttcccatagtgatcaagcactaatgtcattcactagtgaaaacttcactggaaaacaaactaaaccaatttaggggaaatgaaattatagatgccacatggagatagttaagaaatgcatagcaccctctgccacacacacacacacaccatgcccatcccactctactgagtaatctgaggaaactccccaggatattcagatatagaaagccacacaaaccctcctgctcccacagctccctgctacaagcaccactgagaattcttggatagtataagctttgttttatatagttgtaagtcttgaagacacaaaatatatatgggttgaatgcctcttgattctcattatgtctaaaatattcccataggccaaggccaatctgaatacagtatgtaggaagtcctacataaaaatgcataccagcaaagatggagaaaatgcaaattaaaacagtgattttttttttttttttttttttttttgagatggagttttgcttttgttgcccgggctagagtgcaatggtgtggtcttggctcaccgcaacctccatctcctgggttcaagcgattctcctaccttggcctcccaagtatctgggattacaggtgcccgccaggcgcctgccaccatgtatggctaatttttgtatttttagtggagacggggtttcaccatgttgggcaggctggtttcaaactcctgatctcaagtgatccgcccacctcggcctcccaaagtgttgggattacaggcgtgagccactacgcccagccaacaatgacacttttttctaagtcataaatcccagacaatgccattttaataaaatacatccaaatgaccctggaaaggaacagaaaatttaagtaatttctaaaatacataaagtaaaattagggctgggcaccatggctcacagctgtaatcccagcattttgggaggcaaaagccagaggaatgcttgagcacaggagtttgagaccagcctaggcaatatagtgagaccttgtttctaccttccccctacccccgccaaaaaaaaaaaaaaagggaaattagctgggcctggtgacatgtgcctgtcatcccagctactcaggaggctgagcccaagagatcaaggttgcagtgagttgtgattaccccaatgcactccagcctgggtgccagagtaagaccgcctcaaaaaaaaaaaaaaaaaaaaaagcagagaatagaagtgggagtctaaaacatacaggagaaaaacagttctaacagagacagcactgtaggaatttcctgaactcctgcaatttgccatggcataatttccctaaggaaaaaaaaatctagaactgtttggtgatcacatgcatggcagaattagtagaacaaagcctgaagcttctacaagtgcatcaaagaaagaaaagaaggaaaacaagacctaactctagcactgtcccctggcgagaattcactgtggaatgctctcagaaaggagagcttttactactcagctcagagtcacagacaccaggagaaaaaaggtgggaatctagaaagcttatcaccttcaagtaggaaaagaaccctacatcccaatgtcccaaagacaagtcagacccacatccaacttggcttcccattatgagaggcaggcaaccaaagacaggcaaacaaggaaggtcaaaacacaaaagcaaacagatcaagaatcacacagcatctgagaaaaaccaaggccataaaagggagacaccattcctaacagaacactgtagaaagcagagaaaattatagcaaacataagacttaaatataagtataaatacccccagtagattgctgtttaatggagctccttgacattctttcaagaagtgattagatctctcagaagtataaaagactgtcaaacaatgaaataaaatagaacataagtgctaattagtgtgctgaaaaattgatccaggggcttgtccagaacgtactgaaaaagacaaagaattaagagcataagaaaaaatcgggatacatggaagatagatacagaattccgtacatgcagtaacaacaattgcacaggagaacagactggaggaaacatacaaagaaataaaatacataacccagagataaaggaagactttgtcttctttcagaacaggtaggataaagagaactccaaaactactcagaaagaaaccaaacctgaaaatagattgcctgagaaaagggttgagaattggactagcatcagacttctcaattggatactacaccacattagaactctatcttcaaagttgtaatggaaacggaattctgtatccattcaaagagcaaaacagagatggaaaagcaaggacccacattttaccatgtgtggccactttctgaaagaatagtcaagggactatccaacaaaacataacaattctaagagatacaatgtattaaagaaggaaaaggaaataacttgatttaaataatttttgatacacaatgtaaaacaaggtattctggaacaaaaatcttagtgatttgattctatatgggaaatgttagcagggagggtgtgtgggtgggagggggcacacaggagcaagcaaatgagagagcagtgtttgttttgcacaggaaaaagagtaactctagatttgagctgttcagtagccattaaccactgtgactattacattaaatagaattaaacatttagttcctgctgggtatggtggctcacgcctataatcccagcactttgggaggccaagactggaggatcacttgatcctaggagtttgagaccagcctaggcaacatagtaagaccctatctatctcttaagaaaaaaattagctgggcatagtggcacacacctgtagtcccaactactcaggaggctgaggtgggaggatcacttgagcccaggatgttgaggctgcagtgagccatgatcatgccactgcactccagcttgggcaacagagggagattgtgtcaaaaaaaaaaaaaaaattcagttcccatgtcatagcaacacttcaagtgctcattagctgccatattggatggctctgatatagaacatttccagcattacagaaagttctattggccagcattgttctagacattgagaaacattattttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaa

SEQ ID NO: 938 - DNA, 42141 bp, Homo sapiens
ttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggg

SEQ ID NO: 939 - DNA, 42141 bp, Homo sapiens; identical to SEQ ID NO: 938
